United States Patent 6,639,063 (EST'S AND ENCODED HUMAN PROTEINS) - sequence listing, part 3

SEQ ID NO: 12305 - DNA, 246 bp, Homo sapiens
atgcagcgcgcggcgatggagttcaagaccagcctggccaacatggtgaaacctgtctctactaaaaatacaaaaattagctgggcgtggtggcgcacgctgtagtcccagctactcgggaggctgaagcagaagaattgcttgaacctgggaggcagaggttgcagtgagctgagatcatgccactgcactctagcctgggtgacagagtgagactgcgtctaagaaaaaaaaaaaaaaaaargy

SEQ ID NO: 12306 - DNA, 489 bp, Homo sapiens
atttgccagccaggctagtgacagaaatggattcgaaatatcagtgtgtgaagctgaatgatggtcacttcatgcctgtcctgggatttggcacctatgcgcctgcagaggtaacaataatatttttagtgttgagggttcaaaggagctagagtaagtggaagctgaccaggttgtcaggcttgtgttcctatgttactctgcatgactcccctttaaacgtcagtctttgttctgcaatgccatcttgtcacagggtcatctactgcttatttgtggcactgttttgtcttctgtttatgtttatttcacagcttgtcagagtctatacaactcagcagaaagaacacggcttgcctgctccctctcttgaagattgattgcaatgggagtggtttctctgtttctttgtatagtcgaacagatatttacttcttccaagaagatacaattcagaggaatttttatggcaaaagttagtggagacgg

SEQ ID NO: 12307 - DNA, 262 bp, Homo sapiens
atacaattagccaggtgtggcggcgtaatcccagctggcctgtaatcccagctacttgggaggctgaggcagaactgcttgaacccaggaggtggaggttgcagtgagccgtcatcgcgccactgagccaagatcgcgccactgcactccagcctgggcgacagagccagactgtctcaaataaataaatatgagataatgcagtcgggagaagggagggagagaattttattaaatgtgacgaactgcccccccccccccc

SEQ ID NO: 12308 - DNA, 162 bp, Homo sapiens; identical to SEQ ID NO: 11920

SEQ ID NO: 12309 - DNA, 92 bp, Homo sapiens
ctttaggtgtattaagatataaggccaggctgggcatggtggctcatgctgtaatcccagcactttgagtggctgaggtgggaggatcactt

SEQ ID NO: 12310 - DNA, 296 bp, Homo sapiens
taaaaaagaaggtgggctgggcgcggtggctcacacctgtaatcccagcactttgggaggccgagacgggcggatcatgaggtcaggagatcgagaccatcctggctaacacagtgaaaccctgtctctactgaaaatacaaaaaattagccaggcatggtggcgggcgcctgtagtcccagctactcgggaggctgaggcaggagaatggtgtgaacctgggaggtggagcttgcagtgagcagagatagctgcactgcattccagcctgggtgacagagcgagactctgtctcc

SEQ ID NO: 12311 - DNA, 149 bp, Homo sapiens
  misc_feature 78: n=a, g, c or t
gttaaatattgtctaatcaggccgggcgcggtggctcacgtctgtggtcccggcactttgggagcctgaggcaggcgnatcatgaggtcaggagatcaagaccatcgtggcttacacggtgaaaccacgtctctactaaaaaaaaaaaa

SEQ ID NO: 12312 - DNA, 401 bp, Homo sapiens
ttagatagctgtattatagtgagtcctctgggactgtttggttcttttggtatgatggtatttttgttatgtcaaatactgtctgaaaaaattataagaaaatatgtgttctttttggccgggtgcggtggcttaccgctgtaatctcagcactttggaaggccgaggcgggtgagtcacctgaggtcagaagttcaagccagcctggccaacatggtgaaacccatctctagtaaaaataaaaaaaattagtctggcatggtagtgcgtgcctgtagtcccagctactttgtaggctgaggcaggagaattgcttgaacctgggaggcggagggtgcaatgaattgagattgcgccactgcactccagcctaggcgacagagcaagactccatctcaaaa

SEQ ID NO: 12313 - DNA, 235 bp, Homo sapiens
aaggatgtcaaaatgaaaatggtaccataaatagccaacgttgattaaaattaaacatgattactttaacaaaaagaaacttaaggccaggtatggtgggtcatgcctgtaatcckagtskrctttgggaggctgaagtggaaggatcacttgagcccaggagttcaagaccagcctggagaacacagagagacccccaccatctcttccaaaaataaaaactagccaggcatgg

SEQ ID NO: 12314 - DNA, 444 bp, Homo sapiens
attctaatccgtttcacacacggtgctgctacctcgtttgcttcgtgcgtgcgtgcgcagatgtgggccccgcgggagcagctactgggctgggctgcggaasctctgcctgccaaggattctgcctggccctgggaagagaagcctagatatctgggaccagtgactttcgaggatgtggctgtgcttttcacttaggcagagtggaagagactgagccttgagcagaggaacctatacaaagaagtgatgctggaaaatctcaggaatctggtctcattggtgctctcctatcaaatctagaattggaagattgatggacagcaactgaggtgctaccaggataccaaaaagtctgctggataaacaccatctctattctaatattatggagagatcaggatctcctgtgcccaaatcaaacctgttaatacactcagctgt

SEQ ID NO: 12315 - DNA, 135 bp, Homo sapiens
  misc_feature 127: n=a, g, c or t
ctttaggtgtattaagatataaggccaggctgggcatggtggctcatgcctgtaatcccagcactttgagtggctgaggtgggaggatcacttgagcccaggatttcaaggcgagcctgggacacantggtgaaa

SEQ ID NO: 12316 - DNA, 372 bp, Homo sapiens
gtgagccgagatcttgccactgcactccagccagggtgatggagtgagactctcagaaaaaaattagtgccaggcacaggggctcacacctataatccccgcactttggcaggccaggtgggcaaattgcttgagcccaggagttcgagaccagcctgggcaacatggcgaaaccctgtctaacaaaaaaaatacaaaagttagccaggagtggtggcacaagcctgtagtccctgctgctagggagactgtagtgggaggatcacttcagcctgggagaccaaggctgcagtgagtcatgagtgtgccattgcaccccagtgtgggccacagagcgagaccttgtctccaaaaaaaaaaaaacccaaaara

SEQ ID NO: 12317 - DNA, 400 bp, Homo sapiens
ttatcactccaagaagaaaccccagacccattagcagtgtgcctttccttcactcttccctcccccagctcattaatctacttttgctttctgtaaatccatagagagatttgctgtgagagtgtgaaagtggctgtagatagtacgtaaactgcccattccagaacttcatgtaaatggtataacacaatatgtgatcttttgtctctggcttctttcacttagcgtaatattttcaagtttcatccatgttgtggcattgatcagtattttatttctttttattgtcaaatactgttccgttgtatagatataccacatttttttgtggatttggattgtttccactttttggctactgtgaataatgctgttatgtacatttgtgtacaaaattatg

SEQ ID NO: 12318 - DNA, 475 bp, Homo sapiens
tcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcgatctatcaattttgttgatcctttccaaaaaccagctcctggattcattgattttttgaagggttttttgtgtctctatttccttcagttctgctctgattttagttatttattgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatcttta

SEQ ID NO: 12319 - DNA, 337 bp, Homo sapiens
  misc_feature 16: n=a, g, c or t
aatggtagagacakgntttcaccatgttggccaagctggtctcaaactcctgacctcatgcctgtaatcccagcagtttgggaggccaaggcgggtggatcacctgagatcaggagttcaagaccagcctggccaacatggcgaaaccccattctactaaaaatacaaaaaattagccgggcatggtggtgggtactgtagtcccagctacttgggaggctgaggcaggagaatagcttggacccaggaggtggaggttgcagtgagcccagatcacgcaaatgtcactgtactccagcctgggtggcagggtgagaatccatctcaaaaaacaaaa

SEQ ID NO: 12320 - DNA, 225 bp, Homo sapiens; identical to SEQ ID NO: 11617

SEQ ID NO: 12321 - DNA, 81 bp, Homo sapiens
ctttttttcgcaacgggtttgccgccagaacacaggtgtcgtgaaaactacccctaaaagccaaaaaaaaaaaaaaaaarg

SEQ ID NO: 12322 - DNA, 82 bp, Homo sapiens; identical to SEQ ID NO: 11689

SEQ ID NO: 12323 - DNA, 200 bp, Homo sapiens; identical to SEQ ID NO: 11569

SEQ ID NO: 12324 - DNA, 310 bp, Homo sapiens
caaacagatataacactagggccgagtgaggtggctcatgcctgtaatcccaacactttgggaggctgaggacggtgtattgcttgagcccaggagttcgtgccaggtttggcaacatggccatctctataaaaaatacaaacattgaccaggtgtggtggcatgggcctgtggtcccagatacttgggaagctgaggtaggaagatcgcttgggcccaggagatgtaggttgcagtgagttttatcacaccactgcactcctgcctgggtgacagagcaagagcctgtcgccaaaaaaaaaaaaaaaaa

SEQ ID NO: 12325 - DNA, 117 bp, Homo sapiens
gttaaatattgtctaatcaggccgggcgcggtggctcacgtctgtggtcccggcactttgggagcctgaggcaggcgatcatgaggtcaggagatcaagaccatcgtggcttacacg

SEQ ID NO: 12326 - DNA, 289 bp, Homo sapiens
aaaaagtccctgggaagcggccgggcgcggtggctcacccctgtaatcccagcagtttgggaggccgaggcgggtgcatcatctaaggtcaagagttcgagacaagtctggccaagatggtgaaaccccgtctctacgaaaaatacaaaaattagccgggcgtggtggctcatgcctgtaatctcagctactcgggaggctgagacaggagaattgcttgaacccgggaggcggaggttgcagtgacccgagatctcgccaccgcactccagcctgggcgacagagcgg

SEQ ID NO: 12327 - DNA, 128 bp, Homo sapiens
ttccatctggatgaccaaaccgtcagctcctaaagggccgcagaggctgagggcgctgctggcagccggccctctgtggacatttgctgaataaacagaagatatgtgcaaaaaaaaaaaaaaaaagc

SEQ ID NO: 12328 - DNA, 141 bp, Homo sapiens
ctttaggtgtattaagatataaggccaggctgggcatggtggctcatgctgtaatcccagcactttgagtggctgaggtgggaggatcacttgagcccaggatttcaaggcgagcctgggacacatggtgaaacctgtctc

SEQ ID NO: 12329 - DNA, 314 bp, Homo sapiens; identical to SEQ ID NO: 11579

SEQ ID NO: 12330 - DNA, 123 bp, Homo sapiens
gtcagacaataaagtctttgtaaaaagagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12331 - DNA, 174 bp, Homo sapiens; identical to SEQ ID NO: 11671

SEQ ID NO: 12332 - DNA, 53 bp, Homo sapiens
aaaaaaaaaaaaaaaaaaaaaaaaaaaaaaaaaaaaaaaaaaaaaaaaaaaaa

SEQ ID NO: 12333 - DNA, 302 bp, Homo sapiens
tttaaagatgttgccatttttggctgggcacagtggctcacacctgtaatcccagcactttgggaggccgaggtgggcagctcgcttgagtcaggagtttgagaccagcctggccaatatggtgaaaccctgtctctactaaaaaatacaaaaattagctgggcatggtggcatgtgcctgtaatcccagctactcgggaggctgaggcaggagaattgcttgaacccaggaagcagaggctgcagtgagccaagatcataccactgcactccagcctaggtgacagagcgagactccatct

SEQ ID NO: 12334 - DNA, 163 bp, Homo sapiens
ctttaggtgtattaagatataaggccaggctgggcatggtggctcatgcctgtaatcccagcactttgagtggctgaggttggaggatcacttgagcccaggatttcaaggcgagcctgggacacatggtgaaaccctgtctctgcaaaaaaaaaaaaaaaaa

SEQ ID NO: 12335 - DNA, 162 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacacatggtgaaacctgtctctgcaaaaaaaaaaaaaaaaa

SEQ ID NO: 12336 - DNA, 173 bp, Homo sapiens; identical to SEQ ID NO: 11575

SEQ ID NO: 12337 - DNA, 142 bp, Homo sapiens; identical to SEQ ID NO: 11732

SEQ ID NO: 12338 - DNA, 155 bp, Homo sapiens
ctttaggtgtattaagatataaggccaggctgggcatggtggctcatgctgtaatcccagcactttgagtggctgaggtgggaggatcacttgagcccaggatttcaaggcgtagcstgggacacatggtgaaacctgtctctgcaaaaaaaaaa

SEQ ID NO: 12339 - DNA, 366 bp, Homo sapiens
gtgagccgagatcttgccactgcactccagccagggtgatggagtgagactctcagaaaaaaattagtgccaggcacaggggctcacacctataatccccgcactttggcaggccaggtgggcaaattgcttgagcccaggagttcgagaccagcctgggcaacatggcgaaaccctgtctaacaaaaaaaatacaaaagttagccaggagtggtggcacaagcctgtagtccctgctgctagggagactgtagtgggaggatcacttcagcctgggagaccaaggctgcagtgagtcatgagtgtgccattgcaccccagtgtgggccacagagcgagaccttgtctccaaaaaaaaaaaaaccc

SEQ ID NO: 12340 - DNA, 314 bp, Homo sapiens
gatagattaaaaattttctgggctgggcgcggtggctcatgccggtaatcccagcactttgggaggccgaggcaggcggatcacaaggtcaggagatcgagaccatcctggctaacacggtgaaacctcatctctactaaagatacaaaatattagtggtgtgtggtggcgggcgcctgtagtcccagctactcaggagcctgaggcaggagagtggcgtgaacccaggaggcagagctttcagtgagccaagatcgcaccactgcactccagcctgggcgacagagcgaggttccgtctcaaaaaacaaaaaa

SEQ ID NO: 12341 - DNA, 80 bp, Homo sapiens
aaaaaaaaaawtttaatttggaasacttctggttttggtgsagttttctctgttatattttactttttaaaaagaaaaag

SEQ ID NO: 12342 - DNA, 360 bp, Homo sapiens
catataacctttaaaaaataccatacatatttatgaatgcaatgataaaaccagctataggagtacggctggcgtggtggctcatgcctgcaatctcagcactttgggaggcagaggcgggcggatcactcgaggtcaggagttcaggaccagcctggccaacatggtgaaacctgtctctactggggatacaaaaagtagctgggcatggtggccgcacgcctgtaatcccagctacttgggaggctgaggcaggagaatcgcttgaaccccggaggcggaggttgcggtgagcggagattgcgccactgcactccggcctgtgtaacagatgagactctgtctcaaaaaaaaaataaa

SEQ ID NO: 12343 - DNA, 225 bp, Homo sapiens; identical to SEQ ID NO: 11617

SEQ ID NO: 12344 - DNA, 187 bp, Homo sapiens
tgaatataattagtctcatttgaaatttagtagctgaacatatactgtattaattaacaatactggtcaggcacgttggctcatgcctgtcatcccagcactttgggaggccggggcaggaggatcagtcaagaccgggagtttgagactaacctgsgcaacagagcaagaccctgtctctacaaaa

SEQ ID NO: 12345 - DNA, 173 bp, Homo sapiens; identical to SEQ ID NO: 11629

SEQ ID NO: 12346 - DNA, 147 bp, Homo sapiens
ctttaggtgtattaagatataaggccaggctgggcatggtggctcatgctgtaatcccagcactttgagtggctgaggtgggaggatcacttgagcccaggatttcaaggcgagcctgggacacatggtgaaacctgtctctgcaaa

SEQ ID NO: 12347 - DNA, 354 bp, Homo sapiens
gtgagccgagatcttgccactgcactccagccagggtgatggagtgagactctcagaaaaaaattagtgccaggcacaggggctcacacctataatccccgcactttggcaggccaggtgggcaaattgcttgagcccaggagttcgagaccagcctgggcaacatggcgaaaccctgtctaacaaaaaaaatacaaaagttagccaggagtggtggcacaagcctgtagtccctgctgctagggagactgtagtgggaggatcacttcagcctgggagaccaaggctgcagtgagtcatgagtgtgccattgcaccccagtgtgggccacagagcgagaccttgtctccaaaa

SEQ ID NO: 12348 - DNA, 108 bp, Homo sapiens; identical to SEQ ID NO: 11964

SEQ ID NO: 12349 - DNA, 225 bp, Homo sapiens; identical to SEQ ID NO: 11617

SEQ ID NO: 12350 - DNA, 224 bp, Homo sapiens; identical to SEQ ID NO: 11519

SEQ ID NO: 12351 - DNA, 307 bp, Homo sapiens
cacgagactccatctttaaaaaaaaacaagacgggccggcacgtggctcacgcctgtaatcccagcactgagaggccgatcacttgaggtcaggagttcgggaccagcctggccggcatggtggaaccccatctctactgaaaaatacaaaaattagccgggcatggtggcacacacctgtaatcgtagctggggcaggagaatcgcctgaacccgggaggcggascttgcagcgagccgagatcgtgccgctgcactccagcctgggcgacagagtgagactccatctcaaaaaaaaaaaaaaaaa

SEQ ID NO: 12352 - DNA, 144 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacacatggtgaaacctagtctct

SEQ ID NO: 12353 - DNA, 200 bp, Homo sapiens; identical to SEQ ID NO: 11569

SEQ ID NO: 12354 - DNA, 132 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacacatggtga

SEQ ID NO: 12355 - DNA, 318 bp, Homo sapiens
aaaaagtccctgggaagcggccgggcgcggtggctcacccctgtaatcccagcagtttgggaggccgaggcgggtgcatcatctaaggtcaagagttcgagacaagtctggccaagatggtgaaacccccgtctctacgaaaaatacaaaaattagccgggcgtggtggctcatgcctgtaatctcagctactcgggaggctgagacaggagaattgcttgaacccgggaggcggaggttgcagtgacccgagatctcgccaccgcactccagcctgggcgacagagcgggactccaccccaaaaaaaaaaaaaaaaa

SEQ ID NO: 12356 - DNA, 373 bp, Homo sapiens
attgtccactaaggtctggcaggtctgattgcctcttttcaggcactgagtggtggggtatgccatcctcccctgctggaaccagccttggcctgccctgttagtcatcaaaaatagatctcaccagggaacaatcttctcaggttgttgtgtaatttgagtgagccaaggaccagaggagcgagagcagcaagaaccacacccagcagcaatgtcagcggaagtggaaacctcagagggggtagacgagtcagaaaaaaagaactctggggccctagaaaaggagraccmaaatgagaatkgctgasctctcggrgctcctgaaaggaagggmccaaggaagcacacgaccgggcagtatttctaaaaaaaa

SEQ ID NO: 12357 - DNA, 200 bp, Homo sapiens; identical to SEQ ID NO: 11569

SEQ ID NO: 12358 - DNA, 173 bp, Homo sapiens; identical to SEQ ID NO: 11575

SEQ ID NO: 12359 - DNA, 173 bp, Homo sapiens
ctaaaaattagccaggsctggtggcaggtgactgtaatgccagctactcgggaggctgaggtaagagaattgcttgaacctgggtggaagaagttgcagtgagccaagattgtgcsactgcactcctgcctgggtgatagagtgacactccttctcaaaaaaaaaaaaaaaaa

SEQ ID NO: 12360 - DNA, 200 bp, Homo sapiens; identical to SEQ ID NO: 11569

SEQ ID NO: 12361 - DNA, 344 bp, Homo sapiens
taaatgatatcgtttggatgtttgtaccctccaaatctcatgttgaaatgtgatcttcaatcttggaggtggagcctaatgggaaatgtttggatcatgggggcagatcctttataaatggattggtgccttcccagcagtaaatgtgagtgagttctagctctcctacttcatgcaacagctggttgtttaaagagcttggcaccccctcttctctctcttgatcactctcttsaccttgtgacacccctgctctccttttgccttctacsaccattgtaagcttcctgaggccctcatcagaagcagatgctggtgccatgccttttttttttttttttttt

SEQ ID NO: 12362 - DNA, 213 bp, Homo sapiens; identical to SEQ ID NO: 11736

SEQ ID NO: 12363 - DNA, 96 bp, Homo sapiens
  misc_feature 76: n=a, g, c or t
ctttaggtgtattaagatataaggccaggctgggcatggtggctcatgcctgtaatcccagcactttgagtggctnaggtgggaggatcacttgag

SEQ ID NO: 12364 - DNA, 143 bp, Homo sapiens
ctttaggtgtattaagatataaggccaggctgggcatggtggctcatgctgtaatcccagcactttgagtggctgaggtgggaggatcacttgagcccaggatttcaaggcgagcctgggacacatggtgaaaccctgtctct

SEQ ID NO: 12365 - DNA, 444 bp, Homo sapiens
ttaaaataatacttagaggctgggtgaggtgctcacgcctgtaaccccagcactttgggaggccagggcgggtggatcacctgaggtcaggagttcaagaccagcctgaccagcatggtgaaacccgtctttactaaaagtaccgagattaggccaggcgtggtgggtcacgctgtaatctcagcactttcggaggccgaggtgggcggatcatctgaggtcaggagttcgagaccatcctgaccggcatggcggaaccctgcctctactaaaaatacaaaaaaaattagtccgttgtggtggcagatgcctgtagtcccggctactcgggaagctaaggcaggagaatcgcttgaaccgaggaggcggaggttgcagtgagccgaaatcacgccactacactccagcctgggcgacaagagcaaaactccgtctcaaaaaaaa

SEQ ID NO: 12366 - DNA, 371 bp, Homo sapiens; identical to SEQ ID NO: 11983

SEQ ID NO: 12367 - DNA, 89 bp, Homo sapiens
ttaggcccaagaattacctgaacctgggasgtggaggttgcggtgagccaagatcgcaccactgtaccctagcctgggcaacagagtga

SEQ ID NO: 12368 - DNA, 82 bp, Homo sapiens
gtcagacaataaagtctttgtaaaaagagaaaaaaaaaaaaaaaaaaaaaaaaaaaaraaaaaaaaaaaaaaaaaaaaaaaa

SEQ ID NO: 12369 - DNA, 108 bp, Homo sapiens; identical to SEQ ID NO: 11953

SEQ ID NO: 12370 - DNA, 173 bp, Homo sapiens; identical to SEQ ID NO: 11575

SEQ ID NO: 12371 - DNA, 105 bp, Homo sapiens
gttaaatattgtctaatcaggccgggcgcggtggctcacgtctgtggtcccggcactttgggagcctgaggcaggcgatcatgaggtcaggagatcaagaccatc

SEQ ID NO: 12372 - DNA, 202 bp, Homo sapiens
tgaatataattagtctcatttgaaatttagtagctgaacatatactgtattaattaacaatactggtcaggcacgttggctcatgcctgtcatcccagcactttgggaggccggggcaggaggatcagtcaagaccgggagtttgagactaacctgggcaacagagcaagaccctgtctctacaaaaaaaaaaaaaaaaagg

SEQ ID NO: 12373 - DNA, 313 bp, Homo sapiens
gatagattaaaaattttctgggctgggcgcggtggctcatgccggtaatcccagcactttgggaggccgaggcaggcggatcacaaggtcaggagatcgagaccatcctggctaacacggtgaaactcatctctactaaagatacaaaatattagtggtgtgtggtggcgggcgcctgtagtcccagctactcaggagcctgaggcaggagagtggcgtgaacccaggaggcagagctttcagtgagccaagatcgcaccactgcactccagcctgggcgacagagcgaggttccgtctcaaaaaacaaaaaa

SEQ ID NO: 12374 - DNA, 130 bp, Homo sapiens
ctttaggtgtattaagatataaggccaggctgggcatggtggctcatgctgtaatcccagcactttgagtggctgaggtgggaggatcacttgagcccaggatttcaaggcgagcctgggacacatggtg

SEQ ID NO: 12375 - DNA, 449 bp, Homo sapiens
gactgacaactcacacggctgggtactcttctgagacaaaacttccagaggagcgatcaggcagcaacatttgctgttcaccaatatccattgttctgcagcctctgctstgatacccaggcaaacagggtctggagtggacctccaaactccaacccacctgcagctgagggtcctgactgttagaaggaaaactaacaaacagaaaggacatccacaccaaaaccccatctgtacatcaccatcatcaaagaccaaaggtagataaaaccacaaacatggggaaaaaacagagcagaaaaactgaaaattctaaaaatcagagcgcctctcttcctccgaagaatgcacctcctcaccagcaatggaacaaagctggagggagaatgactttgacgagttgagagaagaagccttcagaagatcaaactactccgagctaaaggagg

SEQ ID NO: 12376 - DNA, 375 bp, Homo sapiens
tatattgtttcccaagaagttctacttggtttcatttcaaacctgcctggtttttttgtttgtttgtttttatttttgttttgagacgaaktgggggtttcactcttgttgcccgggctggagtgcaatggcgtgatctcagctcactgcaacctccaccacctgggttcaagcaattctcctgcctcagcctcctgaggtcaggagtttaagaccagcctgacgaacatggagaatctccgtctctaataaatatacaaaattagccagacatggtgatgcatgcctgtaatcccagctactcaggaggctgaggcaggagaatcacttgaacccgggagttgaaggatgcagtgagctgagatcatgtcattg

SEQ ID NO: 12377 - DNA, 55 bp, Homo sapiens
acttttttttcttcagsgaggcggccgagctgacgsaaacwtgcagatctttgtg

SEQ ID NO: 12378 - DNA, 134 bp, Homo sapiens
ctttaggtgtattaagatataaggccaggctgggcatggtggctcatgcctgtaatcccagcactttgagttgctgaggtgggaggatcacttgagcccaggatttcaaggcgagcctgggacacatggtgaaa

SEQ ID NO: 12379 - DNA, 137 bp, Homo sapiens
ctttaggtgtattaagatataaggcctggctgggcatggtggctcatgcctgtaatcccagcactttgagtggctgaggtgggaggatcacttgagcccaggatttcaaggcgagcctgggacacatggtgaaaccc

SEQ ID NO: 12380 - DNA, 305 bp, Homo sapiens
cacgagactcsatctttamaaaaaaacaagacgggccggcacgtggctcacgcctgtaatcccagcactgagaggccgatcacttgaggtcaggagttcgggaccagcctggccggcatggtggaaccccatctctactgaaaaatacaaaaattagccgggsatggtggcacacacctgtaatcgtagctggggcaggagaatcgcctgaacccgggaggcggasttgcagcgagccgagatcgtgccgctgcactccagcctgggcgacagagtgagactccatctcaaaaaaaaaaaaaaaa

SEQ ID NO: 12381 - DNA, 200 bp, Homo sapiens
  misc_feature 27,81: n=a, g, c or t
tgaatataattagtctmatttgaaatntagtagctgaacatatactgtattaattaacaatactggtcaggcacgttggcncatgcctgtcatcccagcactttgggaggccggggcaggaggatcagtcaagaccgggagtttgagactaacctgggcaacagagcaagaccctgtctctacaaaaaaaaaaaaaaaaa

SEQ ID NO: 12382 - DNA, 162 bp, Homo sapiens
gttaaatattgtstaatcaggcsgggcgcggtggctcacgtctgtggtcccggcactttgggagcctgaggcaggcgatcatgaggtcaggagatcaagaccatcgtggcttacacggtgaaaccacgtctctactaaaaaaaaaaaaawtacaaaaawtca

SEQ ID NO: 12383 - DNA, 175 bp, Homo sapiens; identical to SEQ ID NO: 12172

SEQ ID NO: 12384 - DNA, 243 bp, Homo sapiens; identical to SEQ ID NO: 12213

SEQ ID NO: 12385 - DNA, 343 bp, Homo sapiens; identical to SEQ ID NO: 11941

SEQ ID NO: 12386 - DNA, 433 bp, Homo sapiens
gcatttcctattagatctcttttggcagataaactgtgtgcccccttcctcccaacagattcctgtgttgaagctctcactccccagtacctcagaatggtactgtatccctttaaggaggggattaagttaaaatgaagccttagggtgggccatgatccaatctgactgtgtccttatatgaagggaaatgggccgggcacgtggttcacgcctgtaatcccagcaccttggaaggccaaggtgggcagatcacctgaggtcaggagattaagaccatcctgaccaacatggtgaaaacctgtctctactaaaaatacaaaaattagctgggcgtggtagtgggtgcctggtaatcccagctacttgggagcctgaggcaggagaatcgcttgaacccaggaggcggaggttgcagtgagctgagatcaca

SEQ ID NO: 12387 - DNA, 354 bp, Homo sapiens
ataatacataagatatggtattgtgtgcctgggctcttagacctagcatagtattttcaaggttaatgtgtagcatgagtcactacttcattcctttctgtgtctgagtaacattccattgtatggatatgccacattattcattcatcatttatggacattgggttatcagaattactttagagtaaaactgatgcttgaagaagtgtcagcaatggtcaggcgccaggggcccatgcctgtaatccaagcattttggaggccaacatgggaggatcacttgagcccaggagtcaagaccagcttgggcaacagtgcaagaccctgtatctacccaaaaaaaaaaaaaaaaag

SEQ ID NO: 12388 - DNA, 162 bp, Homo sapiens; identical to SEQ ID NO: 11920

SEQ ID NO: 12389 - DNA, 111 bp, Homo sapiens; identical to SEQ ID NO: 11891

SEQ ID NO: 12390 - DNA, 72 bp, Homo sapiens
gtcagacaataaagtctttgtaaaaagagaaaaaaaaaaaaaaaaaaaaaaaaaaaaaaaaaaaaaaaaaaa

SEQ ID NO: 12391 - DNA, 170 bp, Homo sapiens; identical to SEQ ID NO: 11644

SEQ ID NO: 12392 - DNA, 101 bp, Homo sapiens
gtgtgttaagaaatgagctgtaggctcagtgcagtggctcatgcctgtaatcccagcactttgggaggctgaggtgggcggatcatgaggtaaggagttcg

SEQ ID NO: 12393 - DNA, 302 bp, Homo sapiens
caaaaactagccaggcagggctkggcgcggtggctcacgcctgtaatcccagcactttgggaggccgaggcgggcggatctcgaggtcaggagattgagaccatcccggctaacacggtgaaaccccgtctctactaaaaatacaaaaaaaattagctgggcgtggtggcaggtgcctgtggtcccagctactcgggaggctgaggcagaagaatggcgtgaacttgggaggtggagcttacagtgagccgagatcacaccactgcactccagcctgggggacagagcgagactccgtctca

SEQ ID NO: 12394 - DNA, 253 bp, Homo sapiens; identical to SEQ ID NO: 11749

SEQ ID NO: 12395 - DNA, 123 bp, Homo sapiens
atcgaaaaattagctgggcgtggtgtgtgcctgtggttccagccacatgggaggctggcgcatccccatgcttgagcccaggaggtttaggctgcagtgagctgtgttcatgccactgcactc

SEQ ID NO: 12396 - DNA, 200 bp, Homo sapiens; identical to SEQ ID NO: 11569

SEQ ID NO: 12397 - DNA, 111 bp, Homo sapiens; identical to SEQ ID NO: 11767

SEQ ID NO: 12398 - DNA, 78 bp, Homo sapiens
aaagaagaaaagatatataggkggctcacgcctgtaatcccaaagtgctgggattacaggtgtgagcactgcgcctgg

SEQ ID NO: 12399 - DNA, 369 bp, Homo sapiens
  misc_feature 150: n=a, g, c or t
gtgagccgagatcttgccactgcactccagccagggtgatggagtgagactctcagaaaaaaattagtgccaggcacaggggctcacacctataatccccgcactttggcaggccaggtgggcaaattgcttgagcccakgagttcgagncagcctgggcaacatggcgaaaccctgtctaacaaaaaaaatacaaaagttagccaggagtggtggcacaagcctgtagtccctgctgctagggagactgtagtgggaggatcacttcagcctgggagaccaaggctgcagtgagtcatgagtgtgccattgcaccccagtgtgggccacagagcgagaccttgtctccaaaaaaaaaaaaacccaaaa

SEQ ID NO: 12400 - DNA, 153 bp, Homo sapiens
tgaatataattagtctcatttgaaatttagtagctgaacatatactgtattaattaacaatactggtcaggcacgttggctcatgcctgtcatcccagcactttgggaggccggggcaggaggatcagtcaagaccgggagtttgagactaac

SEQ ID NO: 12401 - DNA, 148 bp, Homo sapiens; identical to SEQ ID NO: 11566

SEQ ID NO: 12402 - DNA, 174 bp, Homo sapiens
  misc_feature 94: n=a, g, c or t
tacaaaaaattagctgggcgtggtggcaggcgcctgtggtcccagctactcgggaggctgaggcaggagaatagtgtgaacccaggaggcgganttgcagtgagccaagatagtgccactgcacttcagcctgggtgacagagtgagactctgtcacaaaaaaaaaaaaaaaaa

SEQ ID NO: 12403 - DNA, 108 bp, Homo sapiens; identical to SEQ ID NO: 11964

SEQ ID NO: 12404 - DNA, 66 bp, Homo sapiens
aaaaaaaaaaaaaaaaaaaaaaaaaaaaaaaaaaaaaaaaaaaaaaaaaaaaaaaaaaaaaaaaaa

SEQ ID NO: 12405 - DNA, 311 bp, Homo sapiens
  misc_feature 118..119,287: n=a, g, c or t
gatagattaaaaattttctgggctgggcgcggtggctcatgccggtaatcccagcactttgggaggccgaggcaggcggatcacaaggtcaggagatcgagaccatcctggctaasannktgaaactcatctctactaaagatacaaaatattagtggtgtgtggtggcgggcgcctgtagtcccagctactcaggagcctgaggcaggagagtggcgtgaacccaggaggcagagctttcagtgagccaagatcgcaccactgcactccagcctgggsgacagagngaggttccgtctcaaaaaacaaaa

SEQ ID NO: 12406 - DNA, 156 bp, Homo sapiens; identical to SEQ ID NO: 12157

SEQ ID NO: 12407 - DNA, 158 bp, Homo sapiens; identical to SEQ ID NO: 11688

SEQ ID NO: 12408 - DNA, 293 bp, Homo sapiens
gaattgtgaggctcagggtgggcacggtggctcacacctgtaatcccagcactttgggaggccgaggcgggtggatcacctgaggtcgggagtttgagaccagcctgactaacatggagaaaccccatctctactaaaaataaaaaattagccaggcatggtggcacatgcctgtaatcccagctgctcgggaggctgaggcaagagaattgcttgaacggcagaggttgtggtgagccaagatcatgacactgcaccccagcgtgggcaacaagagtgaaacttcgtctcca

SEQ ID NO: 12409 - DNA, 197 bp, Homo sapiens; identical to SEQ ID NO: 11802

SEQ ID NO: 12410 - DNA, 200 bp, Homo sapiens; identical to SEQ ID NO: 11569

SEQ ID NO: 12411 - DNA, 200 bp, Homo sapiens
ttaatataattagtctcatttgaaatttagtagctgaacatatactgtattaattaacaatactggtcaggcacgttggctcatgcctgtcatcccagcactttgggaggccggggcaggaggatcagtcaagaccgggagtttgagactaacctgggcaacagagcaagaccctgtctctacaaaaaaaaaaaaaaaaa

SEQ ID NO: 12412 - DNA, 486 bp, Homo sapiens
agttttataatggaggtctaagaattaaagttgtgtgggagtttcaggacaaaggaaggctaaaagtttgtcaagacgttgagcgtattttggttacctatgagaagggttgtgacagtgtacagtggcagctgttggccacgctgcagaaatgagctggagctcatgggttttcagctacatttttcataactttgtagtacatccatcttgagtaaattaagccacaatttggtacctagggtctcaaactaaaatttatttttataaatgaattttaaaagaaaaaatatctacttcttttaaagttagaagaaaattaacctgctgacaggcaacatttttggggtgctttctgcactagttttccttgtaaatgatttgagtgagtaggtttggtttctgacgaaagtagactggagggtagcattgtatgcctcaaatgtctcagtgtgtttggctcatacgtgggctatactttattat

SEQ ID NO: 12413 - DNA, 277 bp, Homo sapiens
  misc_feature 153..154: n=a, g, c or t
aaggatgtcaaaatgaaaatggtaccataaatagccaacgttgattaaaattaaacatgattactttaacaaaaagaaacttaaggccaggtatggtgggtcatgcctgtaatcctagcactttgggaggctgaagtggaaggatcacttgannccaggagttcaagaccagcctggagaacacagagagacccccaccatctcttccaaaaataaaaactagccaggcatggtggctcaggcctgtagtcccagctacttgggaggctgaggtggg

SEQ ID NO: 12414 - DNA, 163 bp, Homo sapiens; identical to SEQ ID NO: 11668

SEQ ID NO: 12415 - DNA, 173 bp, Homo sapiens; identical to SEQ ID NO: 11713

SEQ ID NO: 12416 - DNA, 162 bp, Homo sapiens; identical to SEQ ID NO: 11580

SEQ ID NO: 12417 - DNA, 109 bp, Homo sapiens; identical to SEQ ID NO: 11741

SEQ ID NO: 12418 - DNA, 312 bp, Homo sapiens
gatagattaaaaattttctgggctgggcgcggtggctcatgccggtaatcccagcactttgggaggccgaggcaggcggatcacaaggtcaggagatcgagaccatcctggctaacacggtgaaacctcatctctactaaagatacaaaatattagtggtgtgtggtggcgggcgcctgtagtcccagctactcaggagcctgaggcaggagagtggcgtgaacccaggaggcagagctttcagtgagccaagatcgcaccactgcactccagcctgggcgacagagcgaggttccgtctcaaaaaacaaaa

SEQ ID NO: 12419 - DNA, 173 bp, Homo sapiens; identical to SEQ ID NO: 11575

SEQ ID NO: 12420 - DNA, 355 bp, Homo sapiens
gtgagccgagatcttgccactgcactccagccagggtgatggagtgagactctcagaaaaaaattagtgccaggcacagggsctcacacctataatccccgcactttggcaggccaggtgggcaaattgcttgagcccaggagttcgagaccagcctgggcaacatggcgaaaccctgtctaacaaaaaaaatacaaaagttagccaggagtggtggcacaagcctgtagtccctgctgctagggagactgtagtgggaggatcacttcagcctgggaggaccaaggctgcagtgagtcatgagtgtgccattgcaccccagtgtgggccacagagcgagaccttgtctccaaaa

SEQ ID NO: 12421 - DNA, 163 bp, Homo sapiens; identical to SEQ ID NO: 11668

SEQ ID NO: 12422 - DNA, 140 bp, Homo sapiens
gtgtgttaagaaatgagctgtaggctcagtgcagtggctcatgcctgtaatcccagcactttgggaggctgaggtgggcggatcatgaggtaaggagttcgagagcagcctggccaacatggtgaaaccgtgtctctacg

SEQ ID NO: 12423 - DNA, 327 bp, Homo sapiens
gatagattaaaaattttctgggctgggcgcggtggctcatgccggtaatcccagcactttgggaggccgaggcaggcggatcacaaggtcaggagatcgagaccatcctggctaacacggtgaaacctcatctctactaaagatacaaaatattagtggtgtgtggtggcgggcgcctgtagtcccagctactcaggagcctgaggcaggagagtggcgtgaacccaggaggcagagctttcagtgagccaagatcgcaccactgcactccagcctgggcgacagagcgaggttccgtctcaaaaaacaaaaaaaaaaaaaaaaagg

SEQ ID NO: 12424 - DNA, 173 bp, Homo sapiens; identical to SEQ ID NO: 11575

SEQ ID NO: 12425 - DNA, 306 bp, Homo sapiens
cacgagactccatctttaraaaaaaacaagacgggccggcacgtggctcacgcctgtaatcccagcactgagaggccgatcacttgaggtcaggagttcgggaccagcctggccggcatggtggaaccccatctctactgaaaaatacaaaaattagccgggcatggtggcacacacctgtaatcgtagctggggcaggagaatcgcctgaacccgggaggcggasddgcagcgagccgagatcgkgccgctgcactccagcctgggcgacagagtgagactccatctcaaaaaaaaaaaaaaaaa

SEQ ID NO: 12426 - DNA, 225 bp, Homo sapiens; identical to SEQ ID NO: 11617

SEQ ID NO: 12427 - DNA, 129 bp, Homo sapiens
ttaggcccaagaattacctgaacctgggacgtggaggttgcggtgagccaagatcgcaccactgtaccctagcctgggcaacagagtgactcttaaaaaaaaaaaaaaaamsaaaaaaaaaaaaaaaaa

SEQ ID NO: 12428 - DNA, 314 bp, Homo sapiens; identical to SEQ ID NO: 11579

SEQ ID NO: 12429 - DNA, 83 bp, Homo sapiens; identical to SEQ ID NO: 12087

SEQ ID NO: 12430 - DNA, 97 bp, Homo sapiens
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12431 - DNA, 158 bp, Homo sapiens
gtgtgttaagaaatgagctgtaggctcagttgcagtggctcatgcctgtaatcccagcactttgggaggctgaggtgggcggatcatgaggtaaggagttcgagagcagcctggccaacatggtgaaaccgtgtctctacgaaaaaaaaaaaaaaaaa

SEQ ID NO: 12432 - DNA, 125 bp, Homo sapiens; identical to SEQ ID NO: 11934

SEQ ID NO: 12433 - DNA, 367 bp, Homo sapiens
aaggatgtcaaaatgaaaatggtaccataaatagccaacgttgattaaaattaaacatgattactttaacaaaaagaaacttaaggccaggtatggtgggtcatgcctgtaatcctagcactttgggaggctgaagtggaaggatcacttgagcccaggagttcaagaccagcctggagaacacagagagacccccaccatctcttccaaaaataaaaactagccaggcatggtggctcaggcctgtagtcccagctacttgggaggctgaggtgggagaattgcttgagcccaggagtctgaaactgcggtaagccatgatctcactactgcactccagcctgggcaagagtaagaccctgtatca

SEQ ID NO: 12434 - DNA, 82 bp, Homo sapiens
gtcagacaataaagtctttgtaaaaagggaaaaaaaaaaaaaaaaaaaaaaaaaaaaaaaaaaaaaaaaaaaaaaaaaaaaa

SEQ ID NO: 12435 - DNA, 346 bp, Homo sapiens
cttgttctatcacccaggctggtgtgcactggtatgttctcgctcactgcaaccactatctctcaggttcaagcgattctccttcctcagcctcctgaktagctgggattacaggcacatgtcaccacgcctggctaatttttgtatttttaatagagactgggtttcaccatgttggccatgctggtcttgaacttctggcctcaagtgatctgcccacctcagccttccaaagtgctgagattacagtcctgagccactgctttcggccttacagaattgttttgttttggggcattcagaagtctgacataaaaattaacttgaaaaaaaaaaaaaaaaaggs

SEQ ID NO: 12436 - DNA, 70 bp, Homo sapiens
ctatgataatatagwatgttaaagatatataatgaatataaagaacacttaataaaataaaatcatagct

SEQ ID NO: 12437 - DNA, 507 bp, Homo sapiens
tagttattagtaaaaaaagaagataacttgagagttggctgggccttagcatctaagtaagcaatcaaatggggccagcatagctcctagttggtgaagaagaaagaaatgtgcaaactgccattcatatggataggatgctttcaagtcatgtgtaactagaatgaatagcccctgggtggatcaagggtgatatcatggtcagaaccttgtggtttgtctaacttaacctctccagaactgtgattaagtgaaagatatacagaatcagagtctgctctcaaagtcacatttggaaaaatgaatcacagtttatagaaatagctagtgtaaatattaatatataataatagatgcatatttaaatatattaggtgagtatgcgtgtatcagtttcttgaatgtccccaagtccttaggtcactttgactcagaaaatttgagtgaaattggcttgagcttccactagctccaactcaagcatattttctgttatttggggggaaa

SEQ ID NO: 12438 - DNA, 158 bp, Homo sapiens
gtgtgttaagaaatgagctgtaggctcagtgcagtggctcatgcctgtaatcccagcactttgggaggctgaggtgggcggatcatgaggtaaggagttcgagagcagcctggccaacatggtgaaaccgtgtctctacgaaaaaaaaaaaaaaaaaa

SEQ ID NO: 12439 - DNA, 294 bp, Homo sapiens
cacgagactccatctttaaaaaaaaacaagacgggccggcacgtgggctcacgcctgtaatcccagcactgagaggccgatcacttgaggtcaggagttcgggaccagcctggccggcatggtggaaccccatctctactgaaaaatacaaaaattagccgggcatggtggcacacacctgtaatcgtagctggggcaggagaatcgcctgaacccgggaggcggasttgcagcgagccgagatcgtgccgctgcactccagcctgggcgacagagtgagactccatctcaaag

SEQ ID NO: 12440 - DNA, 70 bp, Homo sapiens
gtcagacaataaagtctttgtaaaaagagaaaaaaaaaaaaaaaaaaaaaaaaaaaaaaaaaaaaaaaaa

SEQ ID NO: 12441 - DNA, 94 bp, Homo sapiens
ctttaggtgtattaagatataaggccaggctgggcatggtggctcatgctgtaatcccagcactttgagtggctgaggtgggaggatcacttga

SEQ ID NO: 12442 - DNA, 374 bp, Homo sapiens
tttaaaaaataaataagtaaataaaattgagcctcattttttaacctaattgaaaatgggtgataaaaatgtatacattgcgaccaggtgcggtggctcacacttgtaatcccagcactttgggaggccaaggcaggtggatcacctgaggtcaggagttcaagaccagcctggccaacatggtgaaacttcgtctctattaaaaatacaaaaatcagccaagtgtggtggcacatgcctgtagtcccagctacccgggaggctgaggcaggagaatcgcttgaacttgggatgctgcagttgcagtgagctgagatcgcaccattgcactcctgcctgggtgacagagcaagactctgtctcaaaaaaaaaaa

SEQ ID NO: 12443 - DNA, 280 bp, Homo sapiens
gaattgtgaggctcagggtgggcacggtggctcacacctgtaatcccagcactttgggaggccgaggcgggtggatcacctgaggtcgggagtttgagaccagcctgactaacatggagaaaccccatctctactaaaaataaaaaattagccaggcatggtggcacatgctgtaatcccagctgctcgggaggctgaggcaagagaattgcttgaacggcagaggttgtggtgagccaagatcatgacactgcaccccagcgtgggcaacaagagtgaa

SEQ ID NO: 12444 - DNA, 143 bp, Homo sapiens
  misc_feature 126: n=a, g, c or t
ctttaggtgtattaagatataaggccaggctgggcatggtggctcatgctgtaatcccagcactttgagtggctgaggtgggaggatcacttgagcccaggatttcaaggcgagcctgggacacantggtgaaaccctgtctc

SEQ ID NO: 12445 - DNA, 187 bp, Homo sapiens; identical to SEQ ID NO: 11697

SEQ ID NO: 12446 - DNA, 76 bp, Homo sapiens
ataaaaaaaaaaaaaaaaaaaaaaaaaaaaaaaaaaaaaaaaaaaaaaaaaaaaaaaaaaaaaaaaaaawtttttt

SEQ ID NO: 12447 - DNA, 331 bp, Homo sapiens
ataatacataagatatggtattgtgtgcctgggctcttagacctagcatagtattttcaaggttaatgtgtagcatgagtcactacttcattcctttctgtgtctgagtaacattccattgtatggatatgccacattattcattcatcatttatggacattgggttatcagaattactttagagtaaaactgatgcttgaagaagtgtcagcaatggtcaggcgccaggggcccatgcctgtaatccaagcattttggaggccaacatgggaggatcacttgagcccaggagtcaagaccagcttgggcaacagtgcaagaccctgtatc

SEQ ID NO: 12448 - DNA, 107 bp, Homo sapiens; identical to SEQ ID NO: 11676

SEQ ID NO: 12449 - DNA, 173 bp, Homo sapiens; identical to SEQ ID NO: 11575

SEQ ID NO: 12450 - DNA, 83 bp, Homo sapiens; identical to SEQ ID NO: 12087

SEQ ID NO: 12451 - DNA, 200 bp, Homo sapiens; identical to SEQ ID NO: 11569

SEQ ID NO: 12452 - DNA, 79 bp, Homo sapiens; identical to SEQ ID NO: 12230

SEQ ID NO: 12453 - DNA, 154 bp, Homo sapiens
sataagaatttataaacttgaratagaaatattctattgtaaaggttaagamaagtatacttggttggccaccgaggctcactaccataatcccagtacttcgggaggcagggtggaagrattgctcgakcccagaaggtggaggctgcagtga

SEQ ID NO: 12454 - DNA, 69 bp, Homo sapiens; identical to SEQ ID NO: 11887

SEQ ID NO: 12455 - DNA, 99 bp, Homo sapiens; identical to SEQ ID NO: 12001

SEQ ID NO: 12456 - DNA, 408 bp, Homo sapiens
atatttttttatggctcagaatgtggtctttttgatgattgtttccatgtgagttttagaaaaagtgtgttctgctctttttgtatgcagcattttataaataaatgccaattagatcagttgactgatcatgctgtccattttaagtatgtccttactgattttttgcttgctgtatctgtccatttctgatagaaggctattaaaatttccagctacaatagtggattcatctttttttcctagcagttatatcaatttttgcctcacatagtttgttgctctgtcgttaggcacatgcacattagggattgttatatcttcttggagaattgactcttattatgtaatatgcctcttcatccctaataattttccttgctgtgaggtctcttctgtctcaagtga

SEQ ID NO: 12457 - DNA, 455 bp, Homo sapiens
atgacacagaagtgaagggcctgctcaagctcacaggcccagtgagagagtgagctgggagctttctaccgtactctgttaccttcctgggtacacataagctctaaaacagaagtgtaactctagaggaaggaacaaaatatgaatccaagagttcaggtctatgttttgcattattaatatgcaaattacttcatatatttataacataaattctgtgtgtcccagtgatgacagctaataagatactcattactggtccaaaactggaaagaaaatccgttggcccaggtgaagaagtccagtgaatgcgggtaatgccctgggctgccgaaagagatcaatgacgggtagagaaattcaattcccccgttaaggtgcaagacggtttctcccatgcaggaccgaggccctctggtggaggaacggaggaagtctccgccccgaagaggcca

SEQ ID NO: 12458 - DNA, 58 bp, Homo sapiens
atccaggtgtttgtttctaacttctgtaatacatacaatgcaaaaaaaaaaaaaaaaa

SEQ ID NO: 12459 - DNA, 369 bp, Homo sapiens
acctaaactggaagatcttcttatgttgcctctccaggtttggcttcttgcttcagaaaatgataccaatcataatctctgctccatctattgttcaaatatcaaaatgtcagaagtaggcttcagctgttaatcagctgtattgaatttctgttcttcaggatataagttctctgcactttaattcttatcaaagcabaattgtgaggaatgctattcatcaaagactgcgtggaggactgcaaggccatttactctttagacatgttatttttccctccttggatttttcccttggatcaaatcagactatcagaaatgttcaaacttaaaacatgaagagttccctttccgaaaaaaaaaaaaaat

SEQ ID NO: 12460 - DNA, 432 bp, Homo sapiens
aaaagcaggctgcccgaccctgcagtggcaactggcttgggtccctttctgtattgtgggggttttgttctttcgctctttgcaataaattttgctgctgctcactctttgggtccacgctgctcttatgagctgtaaaactcaccgcgaaggtctacagcttcactcctgagccagcgagagcacgaacccaccagaaggaagaaactccaaacacttctgaatatcagaagaaacaaactccagacgcgccaccttaagagctgtaagactcacctggagggtccgcggcttcattcttgaagtcaatgagaccaagaacccaccaattccggatacattagggtgggccctaatccaataagactggtgtccatataagaagaggaaatttggggatccggcatggtggctcacacctgtaatcccagc

SEQ ID NO: 12461 - DNA, 422 bp, Homo sapiens
agatgaaagatcagcgtcagggaggcagatgagttcaatgtaaggaaaagacttactaacagcagcagggctgcctcgtgcaggagtgggtgccctaccactgagggtatctaagctaagagggaagggtcccctttcaggggtgctggagacaggatcccacactaggtagaactggattggaccaatggtgcctgaacacaggcccaagagtcaggactggccacttcacaaagcacctggagtttactaaaaacagactcctaggaggtcaggcactgtggctcacgcctgtaaccccagcactctgggaggccaaggtgagaagatcatttgaggccaggagtttaagactagcctgtgcaacatggcaagaccctgtttatctgtacaaaatttttttttaaaaaattagccaggta

SEQ ID NO: 12462 - DNA, 325 bp, Homo sapiens
acctggatcaatgggctgccctaatgaaggatatcaaaaatgaaggggcagctaaagaaaaataaaagacacctcagaaagtagcctgcctctttgacaagggacatgccttcagaggaacataacagaaacctcygagaattgtcaacaataaaaagactgagcaacaagggaaactggtaggaagccaaaggttttaagaggtgagagtggagaaatgctgtgcttttattgatcctctccaaaggaacacctttaaaaaagcatgatataaattggcactaatcctcataagagaagaatgtcagcaagccagtgaaggaat

SEQ ID NO: 12463 - DNA, 372 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaraataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcct

SEQ ID NO: 12464 - DNA, 70 bp, Homo sapiens
aaaagatgagttcagcccctttcctttctctctcgcacacatatttgctcgcctttttgtctgccaacat

SEQ ID NO: 12465 - DNA, 287 bp, Homo sapiens
gaggagaagccaaacgtaaagacaccaggagtttctcgggcccagctgtggctgctgccggggagccccaagccttggcgggtccttgcggcgaataggagtctggtcaggcgtcaggctagtccgacgaagagtggagaatttcaagattgtggagttggactgaatgctgcacagttcaaacagctgcttatttcggctgtgaaggacctgtttggggaggctggagtgcaatggcacgatcttggctcaccgcaccctccgcctcccaggttcaagcgattckc

SEQ ID NO: 12466 - DNA, 418 bp, Homo sapiens
aagaaagatgctggctgagatcaaccattcggtttttgacacaggacggcaattgttactgaaacttacctgggcctcctaagacctggcttcttcttctgtggagagagaataataggaacatctgcttcaagattttcataaaggtcaactaagaaatgtgacaagctgtgcatccctacattttaggagttacaaaacaaagaaaaacagttaacaccactccaccaaatgaatagaggaaatttagtaaagatgtcaacctctctgtattggaagaagctccttgttgcttgtcttgaccctgcctcccatcgctgaggagtctagttcacctctaagccaagtaggatgagagtatatttggtgtctgagctcatttttgaatctacttcatttgtgttaccacacatttatt

SEQ ID NO: 12467 - DNA, 440 bp, Homo sapiens
aaccctgccgcggaggcagtgagaggccaccggcctttgttgatctgcaaggtatcaaacttcgaacatgacaagcataaaagcctgcagctcgaggagacagggtgtcacaattaccaggaacttagatgggactccattacaaaggatcatccagatgctgtttaaaattgggccaattcagcattaaaatgaaattacacattcatgggatttgttacgagagtcggtactgttttggagtgattcatatagcatttataaggaccaactctgagagagataaatcattgttatactcagcgtgtggttggaaatggaatcaaagcccagtctggaactcctgaagtcaaagtcaaaggaactgatcctgtgataaatcagattattgataaactgaagcatgttattcagggacatacctgtattgaagtatacgg

SEQ ID NO: 12468 - DNA, 325 bp, Homo sapiens
atagaaaagggacctaactatcgaaagaaaaacaaacagaaagcaacaacaacagcatcaacaaaaaagtccccacaaaaacctcatccaaaggtcagcagcctcaaagatcaaaactggacaaactcatgaagatgagaaagaatcaatgaaaaaatgctgaaaactcaaaaagccagagtgcctcttctccaaatgattgaaacacctccccagcaaaggcacagatctggacaggggttgagatggacaaattgacagaagtaggctttagaaggtgggtggtaacaaactttactgaggtaaaggagcatgttctaagccg

SEQ ID NO: 12469 - DNA, 414 bp, Homo sapiens
agcagttctgaggagaggcccaagtgaagaggaaccagttgccagcaccaccctgtcagctatgttaggcccctgcctatataaacaatttgattaaaaacatatatttaaraattcatcggtacatgtgagatatgatgatttatcattgaagatttaggatgatgggcagagaaaggcaatctgttttgtctattgtccaatcagtgcacgtgaagatttgttacagtatccagaaaagactaaaaaagaccaagcctgttaaacaactccatcaaagaaaaacaaggaagccatccagctttgttctggactcagcagctaagatggcatgagcttcatcgtaaagcatagttctatgtcatgtctactggatgaatccaatgtggctggtcccttaataaaataagttgt

SEQ ID NO: 12470 - DNA, 485 bp, Homo sapiens
tctaacaaggttaataccttagttcttaacattttttttctttatgtgtagtgttttcatgctaccttggtaggaaacttatttacaaaccatattaaaaggctaatttaaatataaataatataaagtgctctgaataaagcagaaatatattacagttcattccacagaaagcatccaaaccacccaaatgaccaaggcatatatagtatttggaggaatcaggggtttggaaggagtagggaggagaatgaaggaaaatgcaaccagcatgattatagtgtgttcatttagataaaagtagaaggcacaggagaggtagcaaaggccaggcttttctttggttttcttcaaacataggtgaaaaaaacactgccattcacaagtcaaggaacccagggccagctggaagtgtggagcacacatgctgtggagcacacatgctgtggagattgcagtgtgtctgaggtttgtgtagtagtgga

SEQ ID NO: 12471 - DNA, 94 bp, Homo sapiens
actattgtacctcccaacacctagctcagggtctggtgaaacttaattgctcagtaaatattttttgaattaaaaaaaaaaaaaaaaaaaaaaa

SEQ ID NO: 12472 - DNA, 485 bp, Homo sapiens
  misc_feature 373,382: n=a, g, c or t
aacaccagggatgtatagaagccgccatgtaaggacacagcaagaggacggccatctgcaagacacagagagaggcctcaggagaaaccaaccctgccaacacctcgatcttggacttccagcctctagaactgtttgacattggctgatgctctgaagcaaaatacttttcacatgctagtgtctgctcaggccctccaagaaccagactctaaggcctgaaggtttagtccatagaggctcgatcaggtttcgagtgtgccagaagcaagaagaaaatgtgctgccaaaggacactctccaggatggccatagggatacaactgcacacgccatgaagtsactgctgctaaatacgatcatactatatgtnctgtttrgnagtttgtwgtcttcacaaatcaatgtatcttgggagttttaaacatctctttgtgtagaccaggggtcatccaccaaaggccatgccaggtgcagcaaagcag

SEQ ID NO: 12473 - DNA, 450 bp, Homo sapiens
cttttctctgtgatgacaccttgagttggaactttatcctacacttgatgggctcctctcctgagtgggaaggcaaggaaataggggcttaccacccaaaagatgggaggcagaagatacccacctgagttgcccagagcccacagtgtttgctttctcaccactccggactccacctttgagctctttgcgagagatgtggatttccagctttgaacaatccaagaaagaagcccaggcactaaggtggctggttgataggaatcaaaacttttcatctcaagagttttggggcctagtattcaaggactgatttcaaaaatgatcagaatgaaacagactagagccttcttgaggtttattttctaggttgccttaatatttgaacataagctattctgttgactatccatcaggataataattagttgctgcagtactcataatgag

SEQ ID NO: 12474 - DNA, 217 bp, Homo sapiens
gaagtaggagttcaagaccagcctggccaacacagtgaaacctcgtctctattaaaaatacaaaaaattagctgggcgtggtggcgggcacctgtaatcccagctactcaggaggctgaggcaggagaatcacttgaacccaggaggtggaggttgcagtgagccgagttggcgccactgcactccaacctggacaagagcaaaactccgtctcaaa

SEQ ID NO: 12475 - DNA, 335 bp, Homo sapiens
aaataaggaagacttgtcgggaacacaggcagggctcaacgtcattaaagaggcagaggcgcastgtggtgggcagccaaggagctgagaagaacgaagaagctttcagactacgtggggaagaatgaaaaaaccaaaattatcgccaagattcagcaaagattggaagaaaatgatgatgatgcctatttaaactcaccatgggcggataacactgctttgaaaagacattttcatggagtgaaagacataaagtggagaccaagatgaagttcaccagctgatgacacttccaaagagattagctcacctttctcctaggcaattataattta

SEQ ID NO: 12476 - DNA, 478 bp, Homo sapiens
agattgctctaaattttatattctaatattgtactattaaaaaccatctgttgtttaatgttcaaaaatcaatccagataatatgaaatccattgagctatttctaaaaagtgattgttaatttcagtaacatgccattttgatttttagtggattatcttgatggatctctgcctaaaagcataagatcaaccgaaccatgtcatctgaatagaagctagtgaatgggattgggtgcagtaaaatggaaatcctttttaatgaaagataagagctgcatccttacctctcaacctttcaatcctttcatttgaggatttaggaggaaccatctggattgtaacagcaagttcttttcaagcacaaaagttccaggagagagagaatatagatttagtattattcctcctggcattcctcattctaacttttgccatcacctgagttccagcattggggaagacaaaagcaccagggt

SEQ ID NO: 12477 - DNA, 473 bp, Homo sapiens
ttttgtctttcacatcggctgtcttgcaaggagcttgacatttccaaattccattgctctgtttggggaagacttaggacagcactccaggaaacagatgacaatttacagacagttgtctcagtggtttccagaatctcaccagcctcccgtatagcttcttgtattgaggctcatgagcgtattcacactctttcctcccccgcgcacgcctctgcttgctctcgatcagcatccagacctccgtggcaccaggttgcctctgttgtgaacttcttttgtaacctaccaggccagttgtatatacagtgttgtcaggtttttccgggtttcagttttgaggcagtttattcaaagtgagacagaagtgccacggaaaagaggcaggagtgtgttaggtggtgggtccattagacctctgctgtgacattgcatattcagctctgcagacactggcttcctttacaaatcta

SEQ ID NO: 12478 - DNA, 460 bp, Homo sapiens; identical to SEQ ID NO: 11164

SEQ ID NO: 12479 - DNA, 437 bp, Homo sapiens
atgtactaggtctttaataaatggtagttcccccttagtcacccatcactcttagaagtcaagacacttccccttctccctttttgccctctctcccagaaagccaggcaaaaggcaggaatgaggagcagcggatagtgacaaaaaggggcttggaggaggggttttgcgmcctgmccttgaatgtccgtctgatgtacaaaacagtcgttttcttaatcttatgcaaaggactatgagcgtgcattttcaagccctactaccaccaatggctgtcgctaacccacccaccgctcactatagaaattttggatcctcgcttcatgtataagaaacaggttgamctttctctagtccagagggaagcaaagggscagtcttggsgsggcttaacctgaacaaagttcaaaagtatttscttgacctccaagaaacat

SEQ ID NO: 12480 - DNA, 60 bp, Homo sapiens
aaaaaaaaaaaaaaaaaaaaaaaaaaaaaaaaaaaaaaaaaaaaaaaaaaaaaaaaaaaa

SEQ ID NO: 12481 - DNA, 459 bp, Homo sapiens
acattagaatgtattccacaacagggagacagcctgacaaagaaacattattcttagatttacaattaattacccttatgtctataccttgcattcaatttgcatatcttaagagcgctgtaaatttcacaggactccctgttatttaagatcactccgcttagtaaaagtttcttcagtgataactttttcttgattatgtagttgtgaggtcagtaaatctggctctactttgctctcccatgttataatttttcctttttgtgtgtgtttttcattatttggcttcttgttccttctgccccctcatttattattccccaaagagccgacagatagagacactggctggaagacgaagcgagtagtcgcagtctgagatgttatcttttccccactacgcattggtactgggtgtctgacatgttctatacatctttctggtgccaactcattaaa

SEQ ID NO: 12482 - DNA, 438 bp, Homo sapiens
agtagattagttgattctcttttcaggtgccgtctttgaattttccacactcttggcgcatgcgctcagctccttggatatcaccctgacattgagcccctggtgctgtgcttgggactgagggtaaatgacacagtcagtgtccccaaccccaccgcatggcaaaacaaatgctgacacttctaattgccttttgtcagccggggaagtgttgaatattaccaggatttcaggcaaaatgactgggtaagagatgacttgatacctgacttaaaagaggacaccctgatgggcagagcccaactctgactttgctctggcttgagacagtcctcagacagttctcttgggtgaggctgccagataaaacacaggatgcctagttaaattttaatttcaaataaacacggatttcttttttagtataaaaaaaaaaaa

SEQ ID NO: 12483 - DNA, 486 bp, Homo sapiens
tgaaagggaaataaaaggatcaagagagaaggtcattagtgataaagatctagagttgttgttagatcgaagtgatcttattgatcaaatgaatgcttcaggaccaattaaagagaagatggggatattcaagatattagaaaattctgaagattccagtcctgaatgtttgttttaaagtggagctcaagaatagcttttaaaagttcttatttacatctagtgatttccctgtattgggtttgaaatactgattgtccacttcaccttttttattatatcagttgacatgtaactagtaccatgcgtacttaaatagatggtaattttctgagccttaccaagaacaaagaagtatccatattaagtttagattttcagttaatttttgagactgagtagtattcttggatacaggctgatgtgtacttaaccacttccagatttatacagtcttcctgtggaagtttagtaaatgtctttttc

SEQ ID NO: 12484 - DNA, 489 bp, Homo sapiens
  misc_feature 265: n=a, g, c or t
cattcggttactgccctttaatacastcctatcatcagcacttccaccatgtattacaagtcttgacccatccctgtcgtaactccagtaaaagttactgttactagaaaatttttatcaattaactgacaaatagtttctttttaaagtagtttcttccatctttattctgactagcttccaaaatgtgttccctttttgaatcgaggtttttttgttttgttttgttttstgaaaaaatcatacaactttgtgcttctattgnttttttgtgttttgttaagcatgtcccttggcccaaatggaagaggaaatgtttaattaatgctttttagtttaaataaattgaatcatttataataatcagtgttaacaatttagtgacccttggtaggttaaaggttgcattatttatacttgagatttttttcccctaastattctgttttttgtactttaaaactatgggggaaatatcacaggtctgtc

SEQ ID NO: 12485 - DNA, 483 bp, Homo sapiens
catgatatatagtacttccttttatatagaaaaaagctcagtgtggaaagaacaacgtatctggaattaagaaacctacattcgattcacagttctgcaggctttttcatcagcttgctgggtgactttgaacaagtgactttacctttaggcatcagtctcttggtgtcccaggggctgcaaagtgggacagagaagatgaagggaaatacttcaatttgctcctgccccttcccaccaccttcaactggaactcctttaactaattaacaatttggagttcatgtaaggatttctttgggaaaaaaagaagatcctgctgttaaaatcaagcttgaaaaactttgcactagaagagagctccagaagtttggcaaaagacatattcagtagccacttaaaaagtccctgtagtcaaccctacatctctttgctaatggaaattttggatagagaaacctgggtctgtgagatccactgatg

SEQ ID NO: 12486 - DNA, 385 bp, Homo sapiens
atcaacaacatactctgaatttaagaatgaccaccacacagtaagagaactggaatttggaggaaaacttcagctctgtgaagtgtagttggctgaaacaaacttctactagtgagagaaactctccctgcagatgctatgctgaagagaaagtacagttgcttcttcctgcctgccttccagtcctctatgccctctgttgacaaaaattaactggaagccagatggcaaaggtgtctggggaatgtagtttgcagagttcagtcacagcaccatagatcacaaaagagtgagtttgaaactaaaggaaaataagtagtagctgatggatgctgtctccataaatgttcaaaaggacaccattaaaaaaaaaaaaaaaaaaaaa

SEQ ID NO: 12487 - DNA, 455 bp, Homo sapiens
ttttaaatttcagttatgttgtctgttttactattgacagacattgttaagtataattcaaaagtaaagaagcttagaatataaacagggatctggatgtcattcagcagaagtgctctctagtcatgaagaaaatgaagcttggctatgaagtagaagaatctttctatcaaaaaataagaacgttggaacttaggatccaatagagtcgcacaatagtcatataggtgattttacacttacttcattggggctgtcatggctcaaatatatttgtgatccttttcttggaaattgctttcagagccagtttgcaggatgcccctaaaaataaatatgcacttacacttcactgtaatccaaaacctatcactctgattcattgtgcacaagacttggtgtcaaaattaaaattcagttaataaaaagggtatttgtcataattccaaatattt

SEQ ID NO: 12488 - DNA, 509 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtgasactgtgcctagcctgagccaccacgccggcctaatttttaaattttttgtagagacaggggtctcattatgttgcccagggtggtgtcaagctccaggtctcaagtgat

SEQ ID NO: 12489 - DNA, 380 bp, Homo sapiens
gggggtggcaatgaagacactctgtctgttgggccctagaatttaatgtggatttcctccttccttccaagttctgagattcttaaatgagagctggctgtcttctagagggagaggagatgcccctggggaagggtcagtcccactgacactggggcctgaagttctgatgaggaagaggacccatggcgggtagtgcagaccggctcatcctaccatcctatcatagagccttgatttcaggtcctaaagtatattcacaacacttcaggtgtggaaatgagaagtctgggtttctggaaattacagaaatcaagtcagaaaaacctggcaaaagtaataatactctgtgttctataatttgccacagtcacctcatt

SEQ ID NO: 12490 - DNA, 299 bp, Homo sapiens
  misc_feature 133: n=a, g, c or t
gtcgcgtgtgagcatgcgcagagagactgtgggcgcgtggtgcagtccctggagggttctcacgctttggctgtctggacttttaagtttttccgctttttcaggaaggcgaccggcagcctcgggcaggggngacaggactgtatgtcagagaagagacggcgcttggacgccagggaatcctctgaagcaggagactgccctatccaggttacccttcccgaggggaaaccagggtctccttcagaaagctgaggcasgccgggcgcggtggctcacgcctgtaatcccagcacttt

SEQ ID NO: 12491 - DNA, 393 bp, Homo sapiens
  misc_feature 114: n=a, g, c or t
agatatgscaragagaagccatgaagtgcatcttttaaattaaaaggtgaaagttctcaactgaattaaggaaagamaaaaatcatatgctgaggttsctaagatctatggcangaatgaatcttctatctgtgaamtgtgaagaaggaaaatgaaatttatgctagttctgctgcatatatagggttcagtattatctgcagtttcagcctacctattctcccagagggcatgcattctatggagacagagctgaatgtgtgccatcagaagaccaaratcaagcgacattttaaaaagamaacagactcttctgggawaaatggtgactccacaaagtaagaagccaccaagacttgtaggacattccttcatcttctcctggatggggca

SEQ ID NO: 12492 - DNA, 469 bp, Homo sapiens
tccgcctcagaccgatccctcgctgttgcgcctacggggagcagcaaccttggcatttggaaataatccccagcttaaacttttctatgggaaagatttgtgtcttgtyatattgggtcctcctgagttgtcacttgcaggctgaagaacctaaaatgaatttgtaatcctacaaaaaggcaggtcccccatggaggttttgaacgcactcattgaagagtagctgtgggctgtgtaataaggtaaacaagattcattgctcatggttctcttcgtttaagacagctccaccagccacaaatagagtccccgagagagagacggagagaagctcttctgagaaatggtggcaaagacatctttctggagtttttgttttgttttgttttactttgctcaaggtgaagaatccaaattccccctcccccagctagagaaatacttctgaaataaacatacattccgccaa

SEQ ID NO: 12493 - DNA, 436 bp, Homo sapiens
agattagttctgtattctagtatttatgcctcttactaaagtbbgaacggcgaagatgtccaagtccatgctaacagaaaggagcagatctcaggaacctgaagaaactggcacacaatagaatctataaaagttcagaaatggaggtcatatatgtctctttcaagggatttcatgagacttaccaaatcaactggacaccaaagtttggccaagataacacataaaattagccatcacaaagactaaatgaagatggcatctactggtgatatttaaaattactaccaaagtaaatgaaattcaaagaagtttctattttatgacaactgaaagtaagtgtggaaacaagaagtcctccaaaaaaatcagagataattatgacataaggagactttggtcagaatgaaactgactaaccgaagagtgtcatcag

SEQ ID NO: 12494 - DNA, 458 bp, Homo sapiens
aaaaagccatttttaaaaatcacatttccttttgttggcttgattaaattgggtaccaataagattaacaaatcttgattaggttaagattagtataaaagacctttcttccagtattcaatcatttagagcttgtcttcggtgctcaactttagttatcccagatcactgaagctgagatggctgatgaagtaatttgcagtgaaattttaagcgactgtgactctgctgcaagttccccagatcttgaggtaaggaattgtgagaaaaagtgggggtgaggggaatagtggggtataatgagtcacttttgattttttggtttgctaatgaggatcttctcttgtccaaatccctcggccaaccatgtttgtttaactttttggttgggctatatgtatctttcgaactgtaggttagtgtgcccacaaaaatttctcttgcaaacgtacactgcc

SEQ ID NO: 12495 - DNA, 230 bp, Homo sapiens
agggattttttaattttaagctatttgtctgttaagtatataataccaaaacgcaggttgtttaaattaggatttccaagtaatttacgtcgtcttcaaaattcctggggtctatcaatcagaaacgccagaaagtttgtgtactagtttcacattgttaagggagtatctataataaaattcaaatgcgttattttaaaaaaaaaaaaaaaaaaaaaaaaaaaaaaaaa

SEQ ID NO: 12496 - DNA, 494 bp, Homo sapiens
acaccttggattatatataaaaatacaggaaatagataaacatgaatgtgattaataatgctgaaaaagtattagcctaccaaagacacactcaggctttagtgaataactttacataacctcagtttttaacacatgcatatcttctccaaccatgaaatcaaagcacggtgcagaacttgtaccaagtacaaaaggtccatgtatgattagcattattttcttttgcttttgtttatggacaatgttcagctgacataagcagaagttggccaaaatactgcctgtactgttaatttcctgtataattcacttaaataaaagcaggttaacctcaatgatagcagttaaaatgttctatcttatgtatttcttttaagtattaccattatggtgctactgagcgttttcttttggtaaaaagaaaaatgccatgggctgcagtcttcttccatcactttttccctaccaggtccattaatatgcttataaca

SEQ ID NO: 12497 - DNA, 468 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagaaaagagtaagggccaatactcaatgttcttaaagaaaagaattttcaacctagaatttcatatccagccaaactaagcttcataagcgaaggagaaataaaagcctctacaaac

SEQ ID NO: 12498 - DNA, 454 bp, Homo sapiens
  misc_feature 447: n=a, g, c or t
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagaaaagagtaagggccaatactcaatgttcttaaagaaaagaattttcaacctagaatttcatatccagccaaactaagcttcataagcgaaggngaaataa

SEQ ID NO: 12499 - DNA, 146 bp, Homo sapiens
aacgattgtaaatatgtatttgcccaatgttggaacacctaaatacataaagaaaatattaatagaactgaaggrtggaacaaatagtdacacagtagtagtaaagggacttcagaccccactctccacaatggrtaaatcatcca

SEQ ID NO: 12500 - DNA, 127 bp, Homo sapiens
gtttgtttgttttagatggrgtctccctctgtcacccaggcggaggttgcagtgagctgagattgggccactgcactccaccctgggcgacagagtgagactcggtctcaagaaaawaaaaaaaaag

SEQ ID NO: 12501 - DNA, 129 bp, Homo sapiens
agatgggactgtctagttgcaagaaaacaagctcagggctctcactgattctacattatggtgagttgtattcattatatattacaatgtaataataacagaaataaagtggcacaacaaatgtaaaaa

SEQ ID NO: 12502 - DNA, 510 bp, Homo sapiens
tcatgttaatttcttacctgttagatgtttaaactgcagtgacctttacttgtatctactctgtggtggaaatgttaaaccatgatagcttttgctaccaactcaaccacttaacttttagagcagttttggggagagtttatgcttcatctgagtttagaaagtaatgtcagaaaatgttaagcatgtctgtattaagaaaaatataaggtttctaattgtcttattaatatggtaattcaagtgaattagaaatatttaactgcaatcttgaattataaagttgagatatatatatatatgtatcaagatctcaacttgatgtaaagtaaatgagcagttacctggcggatttttttttttaaataactgatttaatccataatcccataacaaacatagcttcacctcagtattttctttctttctttgttcaacagtgctccgataagggaatgctagaaaatagatgagaagtactgaaagacctttttttttaattgattagaa

SEQ ID NO: 12503 - DNA, 276 bp, Homo sapiens
attctcctgcctcagcctcccgagtacctgggactacaggtgcccaccaccacgcccggctaatttttttttttttttktwttttwagtagagacagggtttcaccgtgttaaccaggatggtctcgatctactgacctcgtgatctgcccacytcggcstcssagagtgctgggattacaggcgtgavacsgcgcccggccctgactattkggaaaawttctaaattttttkgtcccctcaawtsatgtaacagaacagtaagctgctawktata

SEQ ID NO: 12504 - DNA, 470 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtgasactgtgcctagcctgagccaccacgccggcctaatttttaaattttttgtagagacagggtctcattatg

SEQ ID NO: 12505 - DNA, 462 bp, Homo sapiens
ttaggacttttttcaaaacgaaccttgaaaaacttcttcaattttttttttttaaaagctgttctattaaagggataatatagtgaataaatatttgttgtctgtttaacttaccttatgtagagctattggctctaaggattttgaaaggacaacaataattctctaaaaataattcaggcacctttggccatttgtgtaaccaggtacaaattaccacgtttcccagtttcccccttgagtccaactgtaatgtattgttctgtaaagtatagtccagttgtcagctctgtttgccttggtcaattgaatgatcctcctccttaagcttagcctatagtgcatttggcttaataaatgaaactgtaacatgccagccacacaatagaggattttatagaactgtttctgcttggaatactataattggaatttgagttaactataattaaaaaagctttc

SEQ ID NO: 12506 - DNA, 134 bp, Homo sapiens
attcctgtaatcccaacactctgggaggctgaggtgggagggtcacttaaggtatttgttattttttgcgtacaaatatttaactaacttaaagtaaaataaagattaaccgcacacaccaaaaaaaaaaaaaa

SEQ ID NO: 12507 - DNA, 419 bp, Homo sapiens
ggcctggttctagcccaagcacagtctccagcttaaggaatgaccttaagcaagcacttcttccctcagggcaacatttaaaaaaataagaagattggattgatcaacattttactgcctgtatttcacaggacattctccttttaatatatttgcttgaaccttcttgaaaacaggactccatggacaaataaggtctaacaccagcaatatttacacaccgaagcacgagtatggccatttggggggctgtgatattgttattgaggagttttccagagataactagacaagagctagaaaacaaaggaaggaactttagaagctcacaggtatgtaactgaactaaaacaattaactgtgtactggaaaagaaaagaggaatttattaagtatctacttgtgccaataaacaagac

SEQ ID NO: 12508 - DNA, 455 bp, Homo sapiens
taagttcttggcattgctgcctgatccaatggagcaagattataggttaccccacctgaacatcctcctgggaggaagcagggcatgaatccgaagaattagtgaagtccttccatagccatccttgatggtggagcgggggtgtgtctcagcaaaaagtgattttacaggtcgtttattttggatttatgagcatcaacacgttttaagaagggctgaagtataaggtgctgggaccagttgtcagtaaaggcagtatgattcaatgaatcaattaaatcaggatggagaagggaagcaaaaagtccaagccagataagtggaactacccatgaaactggagggtgtggtgaacaaaagcaaaatattagtcacaaggtcaggagcaagctttttgacaggaaaaaaaaaagaaaaattctgtggaaggcagcttcgagaagacataatccatg

SEQ ID NO: 12509 - DNA, 445 bp, Homo sapiens
aaaggaacgccaaacaaagcgggcgccaggagggggcttcccaggtagatgtcccatctctaaaaatactcttgactattggaaacgtgggcaccagtacacacagctgatgagctgctctaagccagggcttgcttccagcaactcccctcacaccaaatgaagagggttttgttatgttggttgttgttagtgaaaggtttctgttttgttttttgttttgtttttgtttgtttttaaacactcttgttgggtcttctacatcctatattatcttcctaggagaaaggttaattttcatttcaaaaatgcgtgtgctgctgcacaaaactcatagtgcttcatcctaaagatttttttatgtccaaatattaaaatactataatgattctttaatggaataaaatgtttgtccaattaaccaaaaaaaaaaaaaattsccaaa

SEQ ID NO: 12510 - DNA, 458 bp, Homo sapiens
ttcttatttttttttggagataagcccttactctgttgcctagattggagtgcagtggcaccttcatggctcactgcagccccacctcctggagctcaggtgattctcccacctcagctttctgagtaactaggacttgagtgcacaccaccatgcctgactaagctgttctttattcttgtttgtttgtttgagtgagactctccatcacccaggctagattgcagtggcagggtcgtatctcagctcactgcaaccaccggctcctgggttgaggcgattcttgtgcctctgcctcccaagcagctagaattacaggtgcgcaccaccatgsccagcactttgggaggccgaggcgggcggatcacgaggtcaggagatcgagaccatcccggctaaaacggtgaaacccgtctctactaaaaatacaaaaaattagccgggcgtagtggcgggcg

SEQ ID NO: 12511 - DNA, 238 bp, Homo sapiens
agaactcccggctcagagagttctccaccgctcctcccaggctcacgaggctcacgggctacccagcgccascccaggaggctggaccacagactacgaagctgcaccgtgtggggcccactttttatacaagcgggtggcggtggatccaggcgcacagacgggagtgaggcgtggcggagacgcgtgcacgctgggtctgtgcacttttgctgctgctgctttttttttttttttt

SEQ ID NO: 12512 - DNA, 442 bp, Homo sapiens; identical to SEQ ID NO: 10991

SEQ ID NO: 12513 - DNA, 406 bp, Homo sapiens
ataaagaggtgcagggaaaagacaagatggcctaagaccaagctctgaggaactccgacatttagaggtcaggtggagaacaagttgccaaaggagaagccggcgaactaagaagaaaatcaggaggatgcggacttctggaacccaaaagaaaagagtgttccaaaaaaggaatgggaaactgtgctgaaggctgcagagacatgaagcaagcctgccctgagaagtgtgcagtggattgggtagaagccactgtagctctgcctacggcatttgcaatgggcgtgctggcacctgcctgtaatcccagctacttgggaggctgaggaggatcgcttgagctcaggagttcgagaccagcctgggcaacatcacaagacctccgtctctaccataaaaataaaat

SEQ ID NO: 12514 - DNA, 233 bp, Homo sapiens
agctgattgtaaaccaccttctaaagaggaacaaaacgagactacaatttttttatggatgacaaaaagttttagcacagtcaagccaaaattgactaggaaattttgagtacctttgtggcacacaaggattttatgtaacaatcgtacactaagtcctgtcagaattacaggagttttaaaataattttggaacacataccaataacacatttatacaaaaaaaaaaaaaa

SEQ ID NO: 12515 - DNA, 406 bp, Homo sapiens
agcttgacctctggaggcactggagacaaagatcagccacgtggcagtcaaccatgtctatctgaccaagttccaatgaaaactctggacaccaaggcttgggagatatttctcaaaagactcctctgcgggagaggagaatagagaaagaaagaaaacaactgtgtaagcagacatcagtgtaaaccttagcactgtctcttgatgagaataggaggatggcagtgacaggagtgtggtggcgagccagtcacctgcagtcaaccacggctcattgctctcaccatgcctgttacatgaaggtatgtatgtataggaaaaagcactgaaaaactctccagtttcaggcatccactggggatcttggaacgcatcctccaaggataagtggggtctactgtacaac

SEQ ID NO: 12516 - DNA, 75 bp, Homo sapiens
ttttcctaaaaaaaaaaaaaaaaaaaaaaaaaaaaaaaaaaaaaaaaaaaaaaaaaaaaaaaaaaaaaaaaaaaa

SEQ ID NO: 12517 - DNA, 399 bp, Homo sapiens; identical to SEQ ID NO: 11121

SEQ ID NO: 12518 - DNA, 118 bp, Homo sapiens
aagaagaggaaagaggaagaagcgctcagatgctccgcggctgtcgtgaaggttaaaaccgaaaataaaaatgggctagacaaaaaaaaaaaaaaaaaaaaaaaaaaaaaaaaaaaaa

SEQ ID NO: 12519 - DNA, 495 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtgasactgtgcctagcctgagccaccacgccggcctaatttttaaattttttgtagagacagggtctcattatgttgcccagggtggtgtcaagctcca

SEQ ID NO: 12520 - DNA, 240 bp, Homo sapiens
aacaacccgctctgattctcttccaaataatgggaaggttttccccccgtttttacagtaagttttgctgctaatcactttggattttcactgcatttatgagctgtgacattcactgtgaaggtttaaggttttgctgttgaagctggcaaaaccacaaaaccaccaagagaaactaacagttccacaggcactgtcttaagagctgtaacacccaccatgaaggtctgcagtttcact

SEQ ID NO: 12521 - DNA, 527 bp, Homo sapiens
tttctcatttcattttcacttttcttatcaacaggccttttttggccaccttatctaaaatagacaccacttcatcactcagtatcccattacctattttactttttcttcatagtacttacttctatctaatattttattagctattactattgtttgtctattatctccccaaatagaagataagtcccttgaggacagaagtttattcctcatgttcgctgttatctgcccagtacacacaggtgtaacacattcaatatttgctgaatgaatcatttattagcaaggttaaagatgggttggggaaaataatcctctacccctatagaaatgacaggtagagctctctaagaaatcaccgaactgtatcttcaagtcatatatttcagtgactttacaaacacagccattattggctgaacgagtcgatagggtcaggcatttttttcctggttaagtgaaaatagcacttcaagggaccaaaaacctaaagtttcagccctggttctatgtttgtttactga

SEQ ID NO: 12522 - DNA, 531 bp, Homo sapiens
agttgagtgtgaagacctgaggtatcaggggtaggggttgctctgcttgtgtaagtcccatagtgtgaaggccagagaaccaagagatggtcaagaagagagagtaagtgtccaatgtcccagctcaagaagagagaatggtgaattgcactctgaagagcttcctaagcttgtaagaaagtgattctgaaaagctcaacattttggtagaatggagagatttgacattgcttctgctccaaaagcaaaagacttgggaagggcacctgggagttgagaacatccaccacagagaggcctggcgtaaaggagatgggactcacacccaagaggatgcatttccatacacccatttctgaaatatgaagagcccagaagctaaaaaatcacctgccatcttggaaataatccctggaggatcaagtccatgggggagaagtggactggtcaccccagccgaggttatctaagttccatggcttactccagacaggragcccacatcctgcagctcattcataatccataata

SEQ ID NO: 12523 - DNA, 450 bp, Homo sapiens
tttatttatttatttttagagatggggtcacactatgttgcccaggctggtctcaaattcctggactcaagacacccctctgccttagcctccctaatagctgggactataggcataccctagggtgtcttggcctttatctatatttagctattagatacctgttatcttcctgtatcggtaacacgaggtgctctcatttcttttattactgtgtactattttacaatattataatctgttggtggacatttgttgtttttaagcagtgccatcataaacattctgtttatattcacttttttatacttttatgtctctttgtgaactaaatacctaaaactgattgttgagttgagtattgcagaatttgataggctgccaaattgtctcataaaaaggttattcctatttacattcccccaaatgatgtaatgaaattacccttgt

SEQ ID NO: 12524 - DNA, 205 bp, Homo sapiens
attaaaatcaagactttgggccaggtacggtggctcacgcctgtaatcccaaattgctgggattacaggcatgagcacacaccctgcccatgtgttccctcttaatgtatgattacatggatcttaaacatgatccttctctcctcattcttcaactatctttgatggggtctttcaaggggaaaaaaatccaagcttttttaaa

SEQ ID NO: 12525 - DNA, 448 bp, Homo sapiens
cttctctgtggcggagacagccaggttggcagctgacgggacagccggggtctattttgttgcgggttttcagcaaatccagggctggtctggaggcgcgaaaacttaaggcatacagaacgatggagtatatggcagaatccaccgaccgcagccctggacacatcttgtgctgtgagtgtggtgttccgataagtccaaatcctgccaatatttgtgtggcctgtttgcgaagtaaagtggacatcagccaaggtattccgaaacaagtctcgatttcgttctgcaaacaatgtcaaaggtattttcaaccaccaggaacttggatacagtgtgctttagaatccagggaacttcttgctttgtgcttgaaaaaaatcaaagcccctctgagtaaggtacggcttgtagatgcaggctttgtttggactgagcctcattctaagag

SEQ ID NO: 12526 - DNA, 415 bp, Homo sapiens
aagaaataaaactgctatagatattcatgtgcaggatttatgtggacatgttttcatttatccaagataaatgctcaaggggctaattgctgattcttaagagctgkgaggccgaggagtggtgcaagcacctctgcatggagtgtctggggaccaggctcaatgacatcagccttggggagcccgaccttctggccgcagagtgcagcggaacagaatgagagattcaacgtgtatcttatgcctacaccaaacctggatatttatggtgaatgcacaatgcagatcactcatgaaaatatctatctctgggatatccacaatgccaaggtcaaactggtgatgtggcctctcagctcactgaggagatacggtcgggactcaacgtggttcacgtttgagtcaggaagaatgt

SEQ ID NO: 12527 - DNA, 312 bp, Homo sapiens
  misc_feature 309: n=a, g, c or t
atttagctcccacttataaatgtgaacattcggtatttggctttcttttcctttgtaagtttgctaaggataatggcctccagctctatccatgtccctgcaaaggacatgatctagttcttttatgtgactgcagagtagtccatggtgcacatgtaccacatttttttttaaatccagtctgccgtggatggacatttaggttgattccatgtctttgctattgtgaatggtgctgcaatgaacatgtgtgtatgtatttctttatggtagaacaataaatcacaataaatggctgtaaaatctcanaaa

SEQ ID NO: 12528 - DNA, 472 bp, Homo sapiens
acaagttccctaacaccagcatgtggcaagccgtctatcatctatggagactggctgagcttgttatgatgcagacatgacagattgtaacgtatgcccttttggtattttctctgtaatcattcaggaactatgagattgtttcatttcctgttgtaaaaaacagcagacattttctctgccttgcatgtaactatatcggtgggagggcattttctaaagaaatcatattgaactcttttcttaaaaaaaagagatttcactgaagttaaaacaagaataattggtaggcttcctttttgcctgtcttgaagcaaaataaaatactctatcctgttttaaagatctataaacagctcagctaatagaaaggggatgggcaaaaaaaataataaaaagcattaacttctgaattttagcagaggcctatatattggaataaagaaaatgattcataaaagttctttgatag

SEQ ID NO: 12529 - DNA, 483 bp, Homo sapiens
acaggcaccctggtctcacttgagggtcaccaccaatggggatcattccttcagcattcactctcagtattcgtgtacccttgtgacaatgccacagacccatctctttcccaatacatctaagcatattcctcactgtttatctcttgtctgtacaacatcatcaaccagaaacagtttcccaacaggttatattttcttaatggtagtcatgaagtcaccccacctgctctaagttaaaacagagcttaagccttttccacagaacatggcaagataagtttatggtcagggttggttggtgatcctcagtgttgctgcgcagtagaaggttttgtgagcctggaacttgggagactgttcggtagcccaggtctcctaagagtgggtgcagtggctgtgaccctgggctgctcagcattcatgtggaaatgaaggaaggaggactggatcaatcccatttgaaagcatccttctctgcag

SEQ ID NO: 12530 - DNA, 53 bp, Homo sapiens
gtgtcatgagaatgtaagyttttttctactttaawatttagtaggttcactga

SEQ ID NO: 12531 - DNA, 302 bp, Homo sapiens
attctggcggctgggcacagtggctcaagcctgtaatcccagcactttgggaggccgaggcgggcggatcacgaggtcaggagatccagaccatcctggttaacacggtgaaacctgtctctgctaaaactacaaaaaattagtcgggcgtggtggcgggcgcctgtagtaccagctactcgggaggctgaggcaagtgaattgcttgaaccagggaggcggaggttacggtgagccgagatcccgccactgcactccagcctcagcgatagagtgagacttcgtctcaaaaaaaaaaaaaa

SEQ ID NO: 12532 - DNA, 465 bp, Homo sapiens
aaaatagttaatagtaagagatataatttgtagcttaggaaagaagtcagagtcaaagacaatgatttgggtgttacccacacacataataggagttgttgaavttacctccaacattcatgtcagtgattcaccactctccatgaagagctgaactggcacaagtggcaacgtatgttactgatgtaattggcacaaaactgttttcttattatctccttcactgaagccctatagccaaggttgcaacaaggacagtgtcagagcaggctgtaaaaaatgtggctaccctggtcacctgacttttgaatgccgcaattttctccgagtagaccctaaaagggacatagttttggatgtcagcagtacaagtagtgaagatagcgatgaagagaatgaagaactgaataaattgcaggcattacaggaaaaaagaataaatgaagaagaggaaaagaaaaaaag

SEQ ID NO: 12533 - DNA, 445 bp, Homo sapiens
  misc_feature 73,370: n=a, g, c or t
ttcaggggttgtattataaaatatgcactggctgtggtttttcataagatgttttgtggctttttaaagaagngtcttactccctctkctctcatttttttctgccttgaaaaggggtggtatttcttttggggtcaacaaatacacatatcagtttcactcctaaccttgtaagttcaggactcattttcttggcagcaagtggcaggggctctttagtcactggagttaacagtaagtctgagtatattctgaataatgtaattatgcaattaattgataatcatacctaaagcacattgaacttctaagagacaggtgctaygtaagcacactgtctttctggatggggacttgtattttaaataanttatcattccagctatgttggactagggtccaaagcattttataatatttttttttaatctaggaaaaaggccca

SEQ ID NO: 12534 - DNA, 106 bp, Homo sapiens
aatttttataaacttttgttctttcttgtaactttttatcagtcagctattccaatgaagcaaaatctgataatatattgcttttatactaaaaaaaaaaaaaaaa

SEQ ID NO: 12535 - DNA, 440 bp, Homo sapiens
gcaaatcatttgggtcccgtcagtattgtggaagctttgttcttttactttttgcagtaaatgttggtgctggtcactctttgggtctgtgctgcctttatgagctgtaacactcaccacaaaggtctgcagcttcactcctgaagtcagcgagagcatgaagccaccgggaggaaagaacaactctggacgcgccaactttatgaactgtaacactcaacgcaaaggtctgcagcttcactcctgacgtctgtaagamcatgaacccaccagaaggaagcaagtctggagatgtccgaacatcagaaggaacaaactccagataaaccgtctctaagaactgtaacactcactgccagggtccgcggcttcattcttgaagtgagcaagaccaagagctcaccaattctggacacagcaccattattcacaacagccaa

SEQ ID NO: 12536 - DNA, 193 bp, Homo sapiens
attgccatatgttttcttctaagagttttaaaagtttaggtcttacatttaggtatttgatccattttgagttaatttttgtcgatagtgttaggtaagagtccaactttattctcttacatgtggatatccgttttttccagcactatttgtttaaaaaacaaaaatcaaacaaacaaaaacctgtcctttc

SEQ ID NO: 12537 - DNA, 347 bp, Homo sapiens
taaaaaaattcaagtttttctgaggaagcagaaaatccattaagcacaatcagatggaaagtcttgtctctgtaaaaataagcaaagttacatagatgaagcttggtattcctcttacttttgagtgggtggcattcctgttggagaaacatctcaacacaaagttattaccaacactactagcaagcagccattcacccacatgagtgtttggagggttggtgctatgctcacaaaatatgtggatgactaaatgctactgtcagcttccaaagagacatttagaaacattcttgcagcaaatttatttccactcctaattttaaaacaccagcgaaaacaaaaaa

SEQ ID NO: 12538 - DNA, 421 bp, Homo sapiens
ataggaatgcaaatagttaatagtaagagatataatttgtagcttaggaaagaagtcagagtcaaagacaatgatttgggtgttacccacacacataataggagttgttgaaattacctccaacattcatgtcagtgattcaccactctccatgaagagctgaactggcacaagtggcaacgtatgttactgatgtaattggcacaaaactgttttcttattatctccttcactgaagccctatagccaaggttgcaacaaggacagtgtcagagcaggctgtaaaaaatgtggctaccctggtcacctgacttttgaatgccgcaattttctccgagtagaccctaaaagggacatagttttggatgtcagcagtacaagtagtgaagatagcgatgaagagaatgaatgaatctgaata

SEQ ID NO: 12539 - DNA, 103 bp, Homo sapiens
atgtcgggtcgcggggtctcgcggcacatggcggactacctgatcagcggcggcaccggctacgtgcccgaggatgggctcaccgcgcasagctcttcgccag

SEQ ID NO: 12540 - DNA, 477 bp, Homo sapiens
aaaaaaaattatcccctaagaattagtcatcacatgctttccccctcctaggttttggtgaatcccttagcctcaccccaatttctatgtttctgaaatggagtggttgtgaaaattaaatgagttcacaaatgtaaagtgcttgacacatggtaagttctaagtctgagtgagatgttgttgttatttattatgtaagaaattgagagttaatggaactttttaagtgaggactacccagtagtgtgctcatggatgtttaacaaccagctctccaagatgccggagaggaccctggcttgcagtgtttgctgatttccatagtgtaaatactsccaccatggccagtttcaaactaccaacctgctgccacaagcatggagttgagaagaggtgcacacggtcagctttcatgagcgggtggcagctggctttgtcatattgctgatgctacaggactagcttgtagccatgctg

SEQ ID NO: 12541 - DNA, 473 bp, Homo sapiens
  misc_feature 385,393,453: n=a, g, c or t
gaaacagatccaagatgttgtttgagccatgcaactagaagatctcatagaactaaagttatctaatttacagaaaaggttttacgtgacgtctattgtacagattcatatgaaaaccatagttcaaactccaaggtttaagaagtaagaaagatcatgccatttgcaacaaacatgcatgcatatttgaaaagcaactatctgttgtgggaaaactagaagaccaaaaaaagcacgaaagtcaagaaagaagtctcttttcacatgaaagtggcctgaagacaaatactgctatgaatggttacatctaggacttctgaaattagccccagattcaactcatttttttctgcatttgctgagcaatatgacatgtttacaccgnttagctanaaagttatgtgaagaatgggcaacaatatctctaaggcagatatgttcagatccaatatngttcatatagaccttgtcag

SEQ ID NO: 12542 - DNA, 266 bp, Homo sapiens
gtccttttcacscaataaaccctgccctactcaccctttaaagtgtctgsaagcctaatctttcctgatcctgsgasaagaacccggtttttcctacaacatattgtytgagaaacataaggcttgagaaagggcttcccaaaatcaaacttcagtttcaaaattgcctttcctgacgccaggcttttccgatgcttcagaagggcctctggagtatccagaaaagaggtaaacaggattatgtgacatgtttacttacataggat

SEQ ID NO: 12543 - DNA, 315 bp, Homo sapiens
atctcgttcacacgctctgtccgccatgtttgtgagtggtwkkckgstcattaccccttcaagcgactgaaggctgcagggcctctggtggccgcatgggagaccagacccgccagcccgcctttccgcactcagtccgggcttactttattttgtgagacagggtctcgctgtgttgtccacaccagagtgctgtggggcgatcatggctcaccgcagcctccacttcctgggctcaagggatcctcctgcctcagcctctcgagtaacttggactacaggggcgcgccaccatgcctggctaatatatatata

SEQ ID NO: 12544 - DNA, 476 bp, Homo sapiens
agataaatgctctacagaatgtgtagttagcgccttacagatatgagactggaccttacctgaaactctctggttcccttttccaaatctataactataatcgcttaaatcactacagagtcaataataagaaaacctttgtagtcacttataagccaacttataactgagaacaagacagaaatccacaacttacatctgttggaacttgtagctcttctttggtatattcatgaactacctggattaaatcttttggaaaatatccaaaagtgcgtccaacctatacaaaagaatgggcaaaagggacacatatcaatcaaattctgtatgagaaatatgaacgatagagctgcaaacctcaatctacagcacatatcaagcaatcaactttttcttgtaatgtcattacttttctccgctatttgagaccacttccaacatcactagtgacactttgtatgggtcccagagtg

SEQ ID NO: 12545 - DNA, 443 bp, Homo sapiens
aaggacattttcctacctagtcaaaatacaaccatcaaaatcaggaaattaacattgatataaaacctctatataaaccttggaccccattaaagttttgccagttgtcctaggaatgttctttgcagcaaagtgatccagttcagaatcgtgggttgcatttggttatcaagtctctagtctcctttagactttcctcagtaaacgttccttggcattcatgaccttgatacttttgaagattacaggctggttattgtttagattgtctctcaattagggtttgtgtgacattttctcatgattagatttaggttgtgtagcttcaggaatataacagaaatgatgctttgttcttctcgtcgtgtgattttgatttatcccattattgataatgttcactttgatcacttgattaaggtgatgtctgccaggcttctcca

SEQ ID NO: 12546 - DNA, 488 bp, Homo sapiens
  misc_feature 334,353: n=a, g, c or t
attatttgaccaggttctttattctgtggcagcctttttgaacctccttctacagatagctgttattggaacactgtgcttttgtactaactgaagtttgcggaggagtacatctggagctgtgagagaggaaatgtacactctttattaagcctactgtgtgccaggcactggtactgggcattggaaatacagtggtgagcaagttgttgaaattacctccaacattcatgtcagtgattcaccactctccatgaagagctgaactggcacaagtggcaacgtatgttactgatgtaattggcacaaaactgttttcttattactcctdcantgaagccctatagccahrnttgcaacaaggacagtgtcagagcaggctgtaaaaaatgtggctaccctggtcacctgacttttgaatgccgcaattttctccgagtagaccctaaaagggacatagttttggatgtcagcagtacaagtagtga

SEQ ID NO: 12547 - DNA, 146 bp, Homo sapiens
tgaagtactaccagctcttcttagactccctgagagacccaaataaagtattccctgagcatataggggaagatgttcttcgccctgccatgttagctaagtttcgagttgcccgtctctatggsaaaatcattactgcagatccc

SEQ ID NO: 12548 - DNA, 104 bp, Homo sapiens
atttaggggcggttggctttgttgggtgagcttgtttgtgtccctgtggaggacgtggttggtgattggcagttttcgcattttttttttttttcctttttttt

SEQ ID NO: 12549 - DNA, 194 bp, Homo sapiens
agttttgggagctttaaaaccatttgtgactgacacattattgctttccaggaagtggtagggatgacaaaaaagcatattccaacagggctttggagaggataaagtccaagaagtactgaaaccaagagtcactttaaatttttaagaatctttcattttaaagattaagtagtagtccacataggaatgca

SEQ ID NO: 12550 - DNA, 414 bp, Homo sapiens
aaaaatgtttgctcctaattgagtcttctgtgagaaggacatttcttactgcagataattcttggcagctgttgttggcctcctttaaattctacttacctgagttcagtaattcatattacaggcttgcacatcaacaaaggctcctgaatgaacagcagtgtaaggctttaataaattaaactgatgggagggataattaacactacagtatacatgctaccatatctccagttggtgatttaaagtgagcttatgtacagtttgtggtgtatgtgttaatgatgtactttttaaaaagaaagaagagatatttcaattcagtcagatttattagtctggtgtttttgcaccctttttcaagtacaaaatcgtactagaattttatgcaagatggtactgtaacattccata

SEQ ID NO: 12551 - DNA, 195 bp, Homo sapiens
caagtagtcaaagtgtcttaaaaggacacctatttgtccttttgagccccagctgagtgaatactgatagtggactagaaaagcatagtcaagaaaagtgacccaccttgttacttgaccagcagtctagctgagagatctgattttttatgttcgtaaacttttctgtaaagaaagacacaaggacttttcaaa

SEQ ID NO: 12552 - DNA, 450 bp, Homo sapiens
agggaaagacttgtttggtagcccaaggaaaaacaggatgtatttatacagtgaatgttcactctgcagaggaacttccctccagttacatcttcctcatacattagccacctccacacttgacatagatgccaacatgtttcaaaaccaatcttgaaggagcctaaagagttgatggtcctctaggtgaaagacaagaattactgtattgcatttgcttatagggaggtgtgtttttgctaacttgaagggatatactgtatttcaaataagtgtgtgacttaatattttgggatttttttttcctcctttaaaaactggacctgaacacaagctttgagttgatgtttgtaataatctcaggacctgaaagattgtagcatttagtgtgtcttaaaaattatgtactgtaccagccatggatttttgtaaatatacctgtctcccttt

SEQ ID NO: 12553 - DNA, 419 bp, Homo sapiens
aagaacattcggattgtggtgatgaacaatcttttaccaagatcggtaaaaaagcatatcaaatatgasctcaaaggctcaasctacaggcggcgggcttcccggaaagagcgaaagaagcctcttcccacatttaaagacctaaacttcttacaagacatccctgatggtcttttttttggatgctgacgtgcacaacgctctctgtaagaccctgcagcgtgactgtttggtgctgcagagcttcaagataatggattatagcctcttgatgtcaatccataatatagatcatgcacaacgagagcccttaagcagcgaaacacaatactcagttgatactcgaagaccagccccccaaaaggctctgtattccacagccatggaatccatccagggagaggctcgasggggtggca

SEQ ID NO: 12554 - DNA, 307 bp, Homo sapiens
tttttttgagacagagtctcactgtgtcatccaggttggagttcattggcgtgatcttggctcactataacctccaccttccaggttctagcaattctcatgcctcagcctcscaagtagctgggattacagacccgcaccaccacgcctggctaattttttttatttttggtagagatgaggttttgccgtgttggccaggctggtctcaaacttctgaccttatgtgatcctccctccttggcctcctaaagtgctgggattacaagcatgagccattgtgccaggcctggctaaacagcaagaa

SEQ ID NO: 12555 - DNA, 468 bp, Homo sapiens
tatttttaattatttggtaaatattttgtcatatgaccttctgaagcagccacaacttagataatgtcagaactaaggtgatttttttttttttaattttgaaagcccagccaaaatgaggtgtgaatttgtcatactgttacattgaaattggtaacaaaatatatcccctcccatttggacttttagggtaaatgaaaattttattgtattttaaagtagtttctaagttagcaagactgactataattccagtttctgttttctatggacagacctgataaactggagaccctaaagcaggaatacccaaattatagtgtcaggattttagctgtaccagaggcctttatgtgctacatataatttgtataaaattttatatgtgcagattgggtacataaacagttctccatttttctaagggaatgcaataaatgtagcatcgtgaataaatataacttttat

SEQ ID NO: 12556 - DNA, 425 bp, Homo sapiens
  misc_feature 337: n=a, g, c or t
aaaaaaaaasttgtatcaktstgsactcccaccagcattgtacatgatgatgttttsattcttcctagcaaactgttatattttsttttcsaacttgcttattctttaggtggaaatggcattcgcctatsattgactaatgaatcaagtgttccmatgtgccaaggggaactgaggcattggaagaccggtmactacactttaattcatgacsatagcaaggctgaatttgccctagacttaattctgtactgtggctgtgaaggctgggagccagaatatggcgtttwacttctwasattgccaaaggtgaagatgaagagctgctaacagtgantccagaaagcaattctttggsattggtctacagagacagagagactctgaaatttgtcaagcatattaaccaccgaagcctggaacaa

SEQ ID NO: 12557 - DNA, 395 bp, Homo sapiens
agaatcttaataggtgggctttgtgcacatggatttctaatactgcttaccctgtattttaagtcaaagagggtctttgtgtgaaggattctccacctccttttccctttctacgaaggaggtccttcctccactgaagtttcgaaccctcaaagtcatccatggggtttggaatcaacttcattcaagctcctgttactgttgctatcctaacctcctttcatgaatcatgaatgctggttgaagaagaggaagagagacaaggaattgctggcacaaagctgatcattcagtggagtccattctcaccgtgagaagaacattctactgtcagcaggcagagtgaggatggagacatcactgattcacttggctagttcgatgtgggcattcca

SEQ ID NO: 12558 - DNA, 493 bp, Homo sapiens
  misc_feature 414: n=a, g, c or t
agttcaagaaatgtgttccatcgaaatgctggcttgagagatgtttctggccatcttcaaagagataaagtttcagaatctgagggagagaaaattctagaaagtgccacaaggggtgtggctggaaccaaggactcaaaccgtagtttggctaaaaccaatctgtgcccaggaccctcggtctcctgtggcgtcgcgtccacagtcaagggcagccctggccgcccctgagcaatggaaaacggtgttaccagaaggaacggaggaaaattaccatgatcctaagaagctgaggtcatcaagcggagtaggaggtagatttcctatccaggagcagtgagccaaattaaatgcacagaaaattagaccttaacaatatcaaataacctccaacaagcatagactcgcagttgnaaagaacacacctggatttcaaatgtttcacagaaaaacagaggtgaagaaggaggttgaatcaactataatttcttct

SEQ ID NO: 12559 - DNA, 471 bp, Homo sapiens
aagatctaatgttcttgttggacgccatttgggttctagatttaattttcctcgttcttgaggggtttctttgtgttaaccttaaattctcacaattttcaagaaaaacattactctaatgttgtactcctgggccgacctcaagctcttctctgttttttcgattttttgaaaaattgtggacttaattttctgtaaaaatgattttcatttgtggttcttgattataatttcagttttaaagtattactggattcaggtttatatttacggtggtaaagatcagcacctagtggtgttctcacgggaagtgcatttatttgaactgcatatttgcaaatacatttttaaccctatttttacctgttctgttatggatgtgtggatgtttacaaaacagaaacaattttagttttgggaatattgggggaacgggaatagtggaagaaattacagtataatcgaaaatga

SEQ ID NO: 12560 - DNA, 445 bp, Homo sapiens
agtttgggtattctgaagtgttagtatgtagtggagctggtggtgtgaagctgattcattttgtttcaaagccccaaatggcatgctgccgaacacaggcacaagcacagcagcgtctccttagaaataatgactccaaggcaaacagccctcattgcaaaatgtagaagactgccatctgcttgtctccactgtggtttattcgtttcagggttttaaatgacgtaataaaaaggttgatcttctgaaatactttggccatttttcactactgccttatgaggttatcattaatctggcatatatttattgagtgcttgggtgtcactcatatggcacacgtttgctgttagagatgaaagctatgttttgtggagtttattgcagaggcgaccaaggctagaagggaaagaccaactcgtgctgttctaacaattgtttgcca

SEQ ID NO: 12561 - DNA, 479 bp, Homo sapiens
atccttatggaaatagacagtacacggatctggaatggaagcaaataataaccgggtctccagattccatcgtatcacagaatatagaaccaagaaagtaccttagaagtcatctgatccagtcacccctgttttaccaatgaggaatctagacccagaagaagttaaaggacttacccaagagtacccaacaactctctcaccaccccaggctcccatctttgtgtctctcctgtgtgagctgttccctgaagttcttcctgaacttgcacattgcctttccctttgattttaaatccttggctcaaatgacatgcccggactatatcgtgtgatatgagcttgaaaagtaatttacgtacaagtcttgaaagcaaatcaagttttaaaacaaagtagcatctactctgccccagccttgacatcttattacagagcaaatgctggctctttaatttccctaatcaagactggtccta

SEQ ID NO: 12562 - DNA, 428 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagaaaagagtaagggccaatactcaatgttcttaaagaaaagaattttcaacctagaatttcatatccagccaaact

SEQ ID NO: 12563 - DNA, 284 bp, Homo sapiens
agaaaagcttagacattcataggaataagacctccagctatttatgggttgattacaagctcagtatgattcaattgatgattagatagtagacatcacctgttacgattggagccctgtggccaagaggacgcctgtgaactatttcacctgattaggccacgctgggattttttgcttgggtgagaggtcgtgcttccccaggacacgggcagcagcctggagagaggagtctcagagggtaaccctgctcttctcaaatatggaaagctcctatgtggaag

SEQ ID NO: 12564 - DNA, 458 bp, Homo sapiens
atataaaaccagggcacttgagccagcagcagcaacctgctcaggtgcccttccaccttgttcttccgctctttgcaataaattttactgctgctcattctttgggtccgcactgcctttatgagctataacaccgtgaaggttggcagcctcacttctaaagccagcgagaccacaaacccaccaggagagacaaacaactctggacgtgccactttatgaactgtaacagtcagtgcaaaggtctgcagcttcactcctgaggccagcgagaccaggaacccaccggaagggacaaacaactccagacgcctcaccttaaaagctgtaacacttacagtgaagctctgcagcttcactcaaacccagcgagaccacgaacccaccagaaggddwgaaactcggaacacgtccgaacatcacaaggaacaaactccagataccatctttwgaactgt

SEQ ID NO: 12565 - DNA, 335 bp, Homo sapiens
  misc_feature 105: n=a, g, c or t
ataaaaaatgttatattaggttggtgcaaaagtaattgtgttttatttatttatttatttattattttttcctttgagacagagttttgttctggagtgcagcgntgtgatctcagctcactgcaacctccgcctcccaggttcaagtcattctcctggctcagcctcccaagtagctgggattacaggcgcgtgacaccacgcccggccaatttttttttgtatttttagtagagatggggtttcaccttgttggccaggttgcagtgagccgagattgtgccatgcaccccatcctggcgacagagcgagactctgtctcaaaaaaaaaaaaa

SEQ ID NO: 12566 - DNA, 77 bp, Homo sapiens; identical to SEQ ID NO: 10181

SEQ ID NO: 12567 - DNA, 422 bp, Homo sapiens
aagagattagcacttctgaaagaagaagttagatgttaataggttatgttatgcttccttcattaacggtttagaatgagaaaatgagacacatctatggagaggagactacgaccttcattccttccaggggaggctgactgcatcattctgggtggtgagcttggtgttactacaataatttaacatcgaagagaagctctccaagtgattcaagggcattcacacctgttcttccgagatgggtattccaaggatattgggaagcttgaagggtgttagaagactaacctttcagcaggaccaatttgaaatattaatgcttcattcatcattattccttgagaagaatttggccaatatgtttaacacagctgtttttaaatgaagaactcgcttgtttcttaaaaaaaaaaaaaara

SEQ ID NO: 12568 - DNA, 373 bp, Homo sapiens
aattggatagcgacgaaggccggcastaggcgtggacccaactggcgaggctgctggggttgcagcgggacagttggggcggccccgcagcccaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcgccctctactttctggtatgacatcatcctatttgtagtagcaagttgaggctctattttagagatatgcacaaagatatt

SEQ ID NO: 12569 - DNA, 392 bp, Homo sapiens
  misc_feature 374: n=a, g, c or t
aagatctcaaacatgggagaccacatgcaaaggaaactacgttttcacaacacatggttggagaggtcaaagaaaatgtgatgtattactttcaattttatcatcagcgggaccatctggggctagtggtggggctcgaagaaggaagaagaaaataaagaagagaatcaggcaagtggacatctgtaggaagagtgatataggtagagagaacaaccagatcagaggaaggggtgtacctgacaaagttgaaaaacaaactccacttgactttaagatttactataaatggtaatcaagacaatgtgactggtaaaagaatggaaaaatagatcagtaaaacagaactgggagcccataaatagatacacaanaatttagtcatctgatct

SEQ ID NO: 12570 - DNA, 393 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacag

SEQ ID NO: 12571 - DNA, 314 bp, Homo sapiens
aaatttcgacctgtcctttcccgggagttagcgatccctcaacccctgcactgcgctagtcctaaagaggaaatgtctctacgcttgcgggggatgcagcccgcaccctggggccccgggtatttgggagatatttttgcagcccagtcagaccgttaagctccttgccagataaaaaaaaggaactcctacagaatggaccagaccttcaagattttgtatctggtgatcttgcagacaggagcacctgggatgaatataaaggaaacctaaaacgccagaaaggagaaaggtatgtgaggragctcgatgtc

SEQ ID NO: 12572 - DNA, 477 bp, Homo sapiens
ttcttatttttttttggagataagcccttactctgttgcctagattggagtgcagtggcaccttcatggctcactgcagccccacctcctggagctcaggtgattctcccacctcagctttctgagtaactaggacttgagtgcacaccaccatgcctgactaagctgttctttattcttgtttgtttgtttgagtgagactctccatcacccaggctagattgcagtggcagggtcctatctcagctcactgcaaccaccggctcctgggttgaggcgattcttgtgcctctgcctcccaagcagctagaattacaggtgcgcaccaccatgcccagcactttgggaggccgaggcgggcggatcacgaggtcaggagatcgagaccatcccggctaaaacggtgaaacccgtctctactaaaaatacaaaaaattagccgggcgtagtggcgggcgctgtagtcccagctacttg

SEQ ID NO: 12573 - DNA, 134 bp, Homo sapiens
atcatcgtccccagtggtgaccagccctgccatgggaaactatagttcccacaaaaggaccaaagcacccaagcaggcccgcaaggagaggccggctgacatggacaaggcctggtggaaatcgttccgtaacc

SEQ ID NO: 12574 - DNA, 428 bp, Homo sapiens
aaattccaccagatgtacaaagaagagctagtaccaattctactgaaactattccaaaaattgaaatcaaggaggagggactctctatgactcattctatgaagccagcatcaccctgatatgaaaacctggcaaagaaacaacaaaaaagaaaactacaggccaacatccctgataaacatagacacaaaaatcctcaacaaaatacaagcaaaccaaactcaacagcacatcaaaaagttaatttaggctgggtgcaatggctcatgcctgtaatcctagcactttggaagaccgaggcaggaggactccttgaacccaggaatttgagaccagcttgggcaacataggagaccccatctctacaaaataattagcaagtatagtgatgtgtgcctgtagccagctactcagaaggctgaggtggg

SEQ ID NO: 12575 - DNA, 70 bp, Homo sapiens; identical to SEQ ID NO: 12464

SEQ ID NO: 12576 - DNA, 304 bp, Homo sapiens
tgaaatatgagctgagattgtgccactgcactccagcctgggtgacagagatcctgtcatatgaaataatgaaatgaaatgaaataaatgaaatgatgaaatgaaataaaatgtgagctgagattgtgccactgcactccagcctgagtgacagagtgagatcctgagtgagatcctgtcatatgaaatgaaatgraataatgaaatgaaataaatgaaatgragaaatgaaatgtgaactgagattgtgccactacactccaggctgggtgacagagtgagatcctgtcgaaagaaatgaaat

SEQ ID NO: 12577 - DNA, 318 bp, Homo sapiens
  misc_feature 303: n=a, g, c or t
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcagggaatacagagaaggtgacaaagatactccttgagaagagcaaccccaagacaaataatcatcagattccccaaggttgaaatgaaggaaaaaatgttaagggcagccagggagaaagtcaggttacccacmaagggnagcccatcagactaa

SEQ ID NO: 12578 - DNA, 59 bp, Homo sapiens
tttcctttatgccattttttgtttttgttatttgcaaaagatcttgtattccttttttt

SEQ ID NO: 12579 - DNA, 432 bp, Homo sapiens
ctcacgcctgtaattccagcactttgggagcccgaggtgggtggatcacctgaggttgggagttcaagaccagcctgaccaacatggagaaaccccgtctctactaaaaatacagggttggccgggatggtggtgcatgcctgtaatcccagctactcaggaggctgaggcaggaaagtcgcttgaacccgggaggcagaggttgtggtgagccgagattgcgccattgcactccagtctaggcaacaagagtgaaactctgtctcaaaararaaaaaagaaaaacasttctgagggccgggtgtggtggctcacacctgtaatcccagcaytttgggaggccgaggcaggcggattsccttgaggtcaggagttcaggaccagcctggccaatctggtgaaacccgtgtstacgaaaaatataaagawtta

SEQ ID NO: 12580 - DNA, 444 bp, Homo sapiens
tttaaaaaatgtgttaaggctttgtttttggcctaacaggtggtctataaagaagaaagttgtatgaggtaatgagaaggctgtgtatcctgattttgtcgaggagtgttctctataccttcattagaaataattgtttttttactgccttctagtcttctgtttccttactaatattctctcttgttttattacagaaagtggagtattgaaatatcctactataattgtattgctctctttgtgtttattcagttttgttagtatttgctttatatagctgaaaccccaatatgagacacacacacataaatacacacatgtatatacaaatttgtaataggttccagtgaatgaatctaatgtccttctttgtctttttgaagttttgacttaaatacactttataaagtatgacagtttttaactaaaaaaaaaaaaaaa

SEQ ID NO: 12581 - DNA, 409 bp, Homo sapiens
ccacacattgttcctcttgtccaggggagggtggaggagctgcttcccaggactggaggagcagctgggcccctgctgcacgtccggtgggacacacctgtgagccctccagagggagagtgcaggccccttctgagcctggtgttgcagggctccgctctctcccggaagccagggcacccagggcggaggctcctcaggccggggaggcggggagggtgccctgcatggagagagacgccggcgctccccgccttctctgatgctcacccctcccaggccctgttctccctggggtccccccgtttagtagcccccctgcactctttgatatcttagtgtctgaggttgactgtgggtaaatctttaagacactccccagctgtgtttgtttataaatgctgtttat

SEQ ID NO: 12582 - DNA, 444 bp, Homo sapiens
cacttttatagctgaataatatttcattgttcatatcacattttgtttgtccattcgtccactgatgggctttgaattgtttccaccttttccctatttgaatactgctgctgtgaacattttgtttgaacatctgttttcagttctttttggtatatactaaggattggaattactgggtcatatggtattttaggtttaaccttttgaggaaccaaaaaaagtttcaaacattaattggtttgccttttaaattgagaaatttaaacattgtatttatttatcgtgtacaatctgatgttttgaaatacatatatgtatgttgtggccgggcacggtggctcacgcctgtagtcccagcactttgggaggtcgaggcgggtggattacctgaggtcagaagtttgagaccagcctggccaatgtggtgaaacctgtctctac

SEQ ID NO: 12583 - DNA, 467 bp, Homo sapiens
cccaatgattttcttgacatttttttcctcaaaagcacaactcctctattttctttttgcctcagcaacaagaaaaaaaaatctcatgatagctgtacaactttgcaaattaactactttcctactgttctccatcctatctcatcctcatctaatcaatgaattataaagccaacatataggccaggtgccatggctcacatctttaatcacagcactttgggaggctgaggaggacagatcatttgaggtcaggagttcaagaccagcctggccaacacggtgaaaccctgtttctactaaaaatacaaaaaaaatgagccaggtgtggtggtgcgtgcctgtaatcccagctactcaggaggctgaggcactagaatcacttgaacccaggaggtggaaattgcagtgagccaagatggcaccacagcactacagcctgggtgacagagtgagactgtgtatca

SEQ ID NO: 12584 - DNA, 423 bp, Homo sapiens
cacctgtgtattctcttcagtgaatcatctggatgtcttttgcccactttctttttttttcatttttattattttcattaatttttttctttggccactggaataaagactcaccattttctaactgagtgatgttttttaaatatatattttttagagacagggtctcactctgtggcacagagtcattgtagctttgaactcctcagctcaagctgtcctcccgcctcagcctcatgagtagctagtactacaggcacatgccactacacctggctaatttttttatttgtttgtggagacagggtcttactatgttgctgaggctggtgtttaactcctggactgcagtgaccctctcatctcagcctcccaaagtgttgggattacaggcatgcgcccctgtgcccagcctatggcatg

SEQ ID NO: 12585 - DNA, 423 bp, Homo sapiens
gaaaactacaaaacactgctgaaagaaattatagaaaacacaaacaaaatggaaacacatcacatgctcatgggtgggtagaatcagtattgtgaaaatgaccatactgccaaaagcaatctacaaaatgcaatttccatcaaaataccactgtcattcttcacagaactagaaaaaaaactcccaaaattcatatggaaccaaaaaagggcctgcatagctaaagcaagactaagcaaaaagaacaaatctggagacatcacattacctgacttcaaactatactataagggcatactaaccaaaacaacatggtactggtataaaaataggcacataggccgggtgcggtggctcacacctgtaatccctgcactttgggaggccgaggcaggcagatcacctgaggtcaggagtttgaga

SEQ ID NO: 12586 - DNA, 328 bp, Homo sapiens
  misc_feature 169,184,250: n=a, g, c or t
ctggcgggaaagtggaaaactatcggcggtggcccaggctcggtggctcactcctggaatcccagcactttgggaggccaaggtggggggatcacgaggtcaggggatcgagaccatcctggctaacaggtgaaaccctgtctctactaaaaatacaaaaaaattagcnaggcgtggtggaggngcctgtagtcgcagcdactcgggagghtgaggcaggagaatggcgtgaacccaggaggcggastgncagtgagccgagattgctgcactvcactccagcctgggcdacagaggaagactccgtctcaaaaaaaaaaaaaaaaag

SEQ ID NO: 12587 - DNA, 393 bp, Homo sapiens
  misc_feature 372: n=a, g, c or t
attttcgggtcccgcgcccaggtgggaagaggccggcgactggggtgaccgcggggaaactgaggcagagagatgggctccaaggcaaakaagcgcgtgctgctkcccacccgcccagcgcsccccacggtggagcagatcctggaggatgtgcggggtgcgccggcagaggatccagtgttcaccatcctggccccggaagaccccccagttcccttcaggatgatggaggatgcggaggccccgggagagcagctctaccagcaaagccgggcctasgtggctgccaaccagcggctgcagcaggcgggcaacgtgctgaggcagaggtgtgagctcctgcagcgagccggcgaggacctggagcgggangtggcccagatgaagcaggca

SEQ ID NO: 12588 - DNA, 95 bp, Homo sapiens
  misc_feature 63: n=a, g, c or t
agtkccttattcagtcttststctcgctctctycgctgstgtwgccggrccctttgccttygncactgctcagcgtctgcwcatccctacaatgg

SEQ ID NO: 12589 - DNA, 76 bp, Homo sapiens
atttttscccccttgstcgggatggtgccacaggakgstgtgcgggctccgctccgsttcgaatggtggatgctgt

SEQ ID NO: 12590 - DNA, 440 bp, Homo sapiens
gaactgtagattaataaactgaaattgatgttacagatgcccctggctgacttttataacctgttactgcacaggggtagacatactgggagcttccttttaattcccatactgagaaaagaagagtcctggggttcacatggcctttgtgagactcacatgaagctggagccctcaaagggaggcaactcacatgaaagcatagattagaaaaaatgtttcactaccacatgctgatgacaaagaagcttgtttttctgggtttagtctcagggtggggttggaggtgaggctggggtcccccctagctttatacttagaaaccctgcctttattagggtttgagaaatgaatttacattccctgctcaacccaggagtcatgaagtccaaagactgacagaatggtcctgggtgcattaaacctttgagtcacctggc

SEQ ID NO: 12591 - DNA, 222 bp, Homo sapiens
gagaccagcctggccaacgcggtgaaacctgtctctactgaaaatacaaaaattagctgggcgtggtggcaggcgcctgtaatcccagctacctgggaggctgaggcaggagaattgcttgaacccgggaaccagaggttgcagtgagccgagatcatgccattgtacttcagcctgggcgacagagtgagactccatctccaaaaaaaaaaaaaaaaaagc

SEQ ID NO: 12592 - DNA, 156 bp, Homo sapiens
aaccatttctagtcssctttcctcgcaggacctcatgagtaagctgtggcgcgtgggagcacctctggggctatggaggcccctgagccgggagaagccctggagttgagcctggcggtgcccatggccatggagtgcacaagaaaaaacacaaga

SEQ ID NO: 12593 - DNA, 473 bp, Homo sapiens
gaaaactacaaaacactgctgaaagaaattatagaaaacacaaacaaaatggaaacacatcacatgctcatgggtgggtagaatcagtattgtgaaaatgaccatactgccaaaagcaatctacaaaatgcaatttccatcaaaataccactgtcattcttcacagaactagaaaaaaaactcccaaaattcatatggaaccaaaaaagggcctgcatagctaaagcaagactaagcaaaaagaacaaatctggagacatcacattacctgacttcaaactatactataagggcatactaaccaaaacaacatggtactggtataaaaataggcacataggccgggtgcggtggctcacacctgtaatccctgcactttgggaggccgaggcaggcagatcacctgaggtcaggagtttgagaccagcctgaacaacatagtgaaaccctgtctctactaaaaataaaaaaaa

SEQ ID NO: 12594 - DNA, 412 bp, Homo sapiens
tttttaacatttcaaaataagcatggcaggcttctattgaggtttggacttctctcatttctaaagaattagagttgtaacttcatattagttgtaagtttggggtttggtcctcacccaagttggaaagctgtttgcttaagacatagatgtattataataatagaagggagggagtagaaagctgatgaacccttgttacttatagcaaacttcctgctgttttaaatgcacagagattattttatcaactgtggttagcacgcaattggtatttttattgttctgccattttattgaggctatcaagtgggacttcagacctggctctgagcaggaccacacgtgtgtatttatattgagtgccctcactcatgataaggtgacttcatggagacccagaaactcaccc

SEQ ID NO: 12595 - DNA, 398 bp, Homo sapiens
atttttgaaaagttgtgttttcattttcattaaattttctcttgagatttcttctttcacccatgtgttattagaagtgtgctccttaattcccaagtatttggggattttccagctacctttgttttatcaatttctagtgtaattctgttgagatttttgtttttgtcttagtgatatcatcctaatattttgatttatccataatacatgcatgagtctcaaaatatcaatactacaacatataattactatgaacagtttagacattttctccagattgttatgtgtttaaataaaagcacaaggaatagcccctctgtgaggacttatgacatcaagtgggtatgagtttattttactttcaagtcatagcgattactcttttagatttaatt

SEQ ID NO: 12596 - DNA, 102 bp, Homo sapiens
atcgccttcgccgccgcccgcccgcaaaccttcgtgcccggcccgtggcctgcgcggastgtgtccaataaagttcttggatgtgaaaaaaaaaaaaaaaaa

SEQ ID NO: 12597 - DNA, 370 bp, Homo sapiens
caaacattttctttgagctcctgctaaaaataggacatgtctatgattgttcaaaaatatgttaaatttaggctcagcacagtagctcacacctgaaatcttagcacttcgggaggctgaggcaggtggatcacttgaggttaggagttcaagaccagcccagccaacatggtgaaaaccctgtctctactaaaaatacaaaaattagccaggcatgatggtgcatgcctttaaacccagctactgaggaggctgaggcatgagaattgcttgaaccaggagacggaggttgcagtgagctgaaatcctgccactgcacaccagcctgggtgacagagcgagactccatcccaaaaaaaaaaaaaaaaag

SEQ ID NO: 12598 - DNA, 461 bp, Homo sapiens
  misc_feature 438: n=a, g, c or t
aaaaaagcagaagsggaagtaaactcattcacttattaacaaataattactggctagatgaagtggattatacttgtaatcccaacactttgagaggtgaaggcaagaggattgcttgaagttcaagccagaagttcaagactgcattgagasatgattgcaccactatactccagcctgggcaacagagcaagatcccatctcaaaaatttagcagggtgggtgcggtgactcatgcctgtaataccagcattttggaaamctggtgggcggatgacttgagctcaggagttcgagmctaggctaggcaatatggtgaaatcctgtctctatgamcaaaawtttagctggatgtggtggtgtgttcctgtggtcccagctacttgggaggctgaggtgggaggactgcttgggctgataggttgaggctgtggtganccgtgattgtgccactgctctgc

SEQ ID NO: 12599 - DNA, 54 bp, Homo sapiens
ctckctctytccgctgctgtagmsggagcctttgccttcgccactgstcagcgt

SEQ ID NO: 12600 - DNA, 169 bp, Homo sapiens
tatagcagtcttttgataacaatagttaagaggccaggcacggtggctcatgcctgtaattccggcactttgggaggctgaggcgggcggatcacctgaggttgggagttcgagaccggcctgggccaacatggtgaaaccccgtctctaccaaaaaaaaaaaaaaaaa

SEQ ID NO: 12601 - DNA, 243 bp, Homo sapiens
ttccacaatggctgaactaatttacactcccaccaacagtgtaaaagcgttcctatttctccacagccttgccagcatctgttgttttctgactttttaataatcgccattctaactggtgtgagatggtatctcattgtggttttgatttgcatgtctctaatgaccagtgatgatgagcgtttcttcatatgtttgttggctacataaatatcttcttttgaaaaaaaaaaaaaaaaargy

SEQ ID NO: 12602 - DNA, 397 bp, Homo sapiens
tctactgaaattatcagacagaaaactggacgggcgtgatggcttaggtctgtaatcccagcacttttggaggctgatgtaggtggatcacttgaggtcaggagttcaagaccagcctcgccaacatggtgaatccccatctctgttgaaaatacaagaaaaattagccagccttggtggtgggcacctgtatcccaactactcaggaggctgaggcacgagaattgcttggactcaggagtcggaggttgcagtgagccatccctgcactccagcctggacgacagagcaaaactgtctcacaaaaaaagaagaaaacttagtggctgttaacactgaaaatacgtacattgaaatagtgtatcaaattcaagtgaatagcttgtaataaagtgtt

SEQ ID NO: 12603 - DNA, 478 bp, Homo sapiens
aagatcaaaacttgtggatctatagataattcatagtgcagagatgctttacaaatgaaaagagtgtggcaaaacctttaccagagttcaatccctactggacagaagggagtttatactgataggaaatctacacatatgtgccatactttccccaggcatcggaactccagacatcaaaatatacaactttgagaggaaccacacaaacgtaatatgtgtggtaagacttttacctgaacatcaaaatggaaaccagagtattcatactgaagagctaccttacaaatgtaacaaatgtagtaagactttttaaaaaatcaaatgttcggccaggtgcggtgtctcacgcctgtaatcccagcactttgggaggccgaggcaggtggatcatgaggtcaggagatcgagaccatcctggctaacatggtgaaacccgtctctactggaaatacgaagattagctgggcgaggtggt

SEQ ID NO: 12604 - DNA, 436 bp, Homo sapiens
  misc_feature 305: n=a, g, c or t
catgggattgcagtaagtataataaacatgttttcactgtttagtcaggtgaattccttttctgtaggtccctattttttcattcccttaataatttagtagttcatgtttgaacatttttggtgaactttgtcatttgcattgaatttgggggaagattactggtaattgccagcattaggtgtctgtagccacatttcataatccctctagtctgacatggctctgaatcctggctgggtttaagtcaagcttgtccaacctgtgggctgcaggcatgggcacatgcggcctaggacagcttncagtgtggcccatagcaaattcgtaaactttcttaaaacattatgagatttttttgcaattttttttaagctcttcagctatcgtttgtgttagtgtattttatgtgtggcccaagacaattcttcttctt

SEQ ID NO: 12605 - DNA, 377 bp, Homo sapiens
actcttcccatcgcgcgggtcctagccaccggtgtctccttctacatccgcctctgcgccggctgccacccgcgctccctccgccgccgccgccttgctgctgctcaaagctgctgccgccccttgggctaaaaggttttcaaatggaacattttgatgcatcacttagtacctatttcaaggcattgctaggccctcgagatactagagtaaaaggatggtttcttctggacaattatatacccacatttatctgctctgtcatatatttactaattgtatggctgggaccaaaatacatgaggaataaacagccattctcttgccgggggattttagtggtgtataascttggactcacactgctgtctctgtat

SEQ ID NO: 12606 - DNA, 458 bp, Homo sapiens
  misc_feature 393: n=a, g, c or t
tacaaaatgatgtaagccattaaaaccatgtactgtatagaattataagaaattttgccaacatttctctggtgtaatcagtatcatccggtttcgttttaaaaaaaaaaaaawttwttgggctgggcacggtggctcacacctgtaatcccagcactttgggaggccaaggccagtggatcacctgaggtcaggagttcgagattagcctggccaacatggtgaaacccgatctctactagaaatacaaaaattagccaggtgtggtgcctcacgcctgtggtcccagctactcgggagggtgaggcagaagaattgcttgaaccagggaatcggaggttgcagtgacccgaggtcacgccactgcactccagcstgggtgacagagcaagnctccatctcaaaaaaattgtttttattaatttttattttttgagacggggtctggttctgtttcc

SEQ ID NO: 12607 - DNA, 90 bp, Homo sapiens
aattgtgttcgcagccgccgccgcgccgccgtcvmtctccaacgccagcgccgcctctcgctcgccgactccagccgaagagaagggggg

SEQ ID NO: 12608 - DNA, 64 bp, Homo sapiens
cctgggcaacacggtgaaacccgtctctaccaaaaacacaaaaaahtagccaggtgtggtggct

SEQ ID NO: 12609 - DNA, 342 bp, Homo sapiens
caaaatgaaaagatgcaagttagggaacaagtgatcaaaagggagaagggaaaggttttttttaaaaaaccaaaacaacaaagaaaggttaaaaaaaaaaacagactagaggatgagtaatgagtaactctgtaaggaggaccatgtcagactattgtaagctaagcattaggactgatacaaataatatatgctcctggcatagaaaaataaaccacagagaacgagttcaaagaatagcaaagaaagaaagaggacccagtgggcgaaagatgagagtgtacttttaccaaaagttatctaagcctgagcacttgaagtctgcacataaataaataaatg

SEQ ID NO: 12610 - DNA, 521 bp, Homo sapiens
  misc_feature 296: n=a, g, c or t
cttcagaaacttgttcgagtcaggactcctctaccactacctctgctttgcctccttcctggacttcaagcacttctgtgtcccaaaagcagaaaagaaagactggcacaaagccaagtacagaaccacagaatgaagccgtcacaaatgttgaatcccaaaacactaacaggaacaactmaactgccttgcagttagctagccgtcctcccgattctgtsacagaggggcccacgtctaaaagagcacatataaagccaaatgctttgctgactaatgttgacmagattgtccangaaacacagaggctggagttaatctgaagagcaccacttctcctctctctcctgaaaaaatttgccactgatatttttactggataaaattcaaaaatgtttcaattcacaaaggctaattgttgaactggtgtcgtagaagaaattgtctacaggagccaaggtgaaagtctctgatgacggcggaactggctccattagaccattggttcatcctcttttaaa

SEQ ID NO: 12611 - DNA, 347 bp, Homo sapiens
agattaaatctattaatttttctctagcccatgtaagaatccsatttatggctgggcgcggtagctcacgcctgtaatcccagcactttgggaggccgaggtgggcggatcaggaggtcaggggatggagaccatcctggctaacacgatgaaaccccgtctctactaaaaaatacaaaaaattagctggccgtggtggtgggtgcctgtagtcccagctactcgggaggctgaggcaggagaatggcgtgaacctgggaggcggacttgcagtgagccgagatcccgccactgcactccagcctgggcaacagagcgagactctgtcccaaaaaaaaaaaaaaaaa

SEQ ID NO: 12612 - DNA, 200 bp, Homo sapiens
  misc_feature 113: n=a, g, c or t
attttgatgtgactttaaaaatgtacttgataaggccggggcacggtggctcacgcctataatcccagcactttgggaggccgaggtaggagaatcgcttgaagccgggagsngaggttgcggtgagccgagatttgcgcccttgcactccaaccagggcaacaagagtgaaattccatctccaaaaaaaaaaaaaaaaa

SEQ ID NO: 12613 - DNA, 409 bp, Homo sapiens
atcactcatttgtgttaagagcattcaaaatcctctcttccagctatttgaaaatatacaataaattattgttaactaagcatacttcttttatttaccaagcatgtatttgaatgacatacttcctcttcagtaatgcctggtcacatatcagttcctatttttctattttttttcccctcctactggtctttttcttaatgtttaggagcccattgttatatttgttaccgatatttctccctacttgttgtcatttgagtttgtttatggaaccttttgccaatattaaagtgttatacttatttatgatcaaatttacagtgtgctccaccctcccctatttatagtttcactttccttatattgcttagaaaggccttacccactaaatattctcattttcttt

SEQ ID NO: 12614 - DNA, 376 bp, Homo sapiens
cacaagattaaatgaaggagatagatattaattacataatttcataaataattgattgattaaaactatggtaagtgctggctgggcacggtggctcacgcccataatcccagcactttgggaggctgaggcgggcggatcacggggtcaggagtttcagaccagcctgaccaacatggtgaaatcccatctctactaaaaatacaaaaattagctgggtgtggtggcatgcgcctgtaatcccagctactcaggaggctgaggcaggagaatcacttgaacctggggggcagaggttgcagtgagccaagattgtgccactgtcctccagcctgggtgacagtgcgagactccatcccaaaaaaaaaaaaaaaaa

SEQ ID NO: 12615 - DNA, 397 bp, Homo sapiens
cattttgttgagtcttttcatagagtttggcaagaccagatattacctgccagtgtgcattcatatatgtgtgacatgttaactttagtttttaaaattaagaaaatgaatgcggggccgggcgcggtggctcacgcctgtaatcccagcactttgggaggcagaggcgggcggatcacaaggtcaggagatcgagaccatcctggctaacacggtgaaacccgtctctactaaaaatacgaaaaattagccgggcgtggtggcgggcgcctgtggtcccagctactcgggaggctgaggcaggagaatggcgtgaacctgggaggcagagcttgcagtgagccgagaatgcgccactgcactccagcctgagcgacagagcgagacgccgtctcaa

SEQ ID NO: 12616 - DNA, 506 bp, Homo sapiens
agtttggaggtttctcaaagaacacagaactatcattcaatccagcaatcttgttactaggtgtatatccaaaggaaaagaaattgttataacaaaaagacacatgcactcatatattcattgcagtactatttgctatagcaaagagatgaagtcaacctaggtgcgcatcagtggtggatttggtaaagaaaatggtacatdtacaccatggaataatgtacagccataaaagagaacaaaacaggccgggcacagtggctcacatctgtaatttcagcactttgggaggctgaggcaggtggatcacctgaggtcaggagttcaagacaagcctggccaacatggcaaaagccccgtctctactaagaatacaaaaaacattagctgggcatggtggtgcgcacctgtactcccaactactcgggaggcaggcatgagaatcacttgaacccaggaggcagaggttgcagtgagccgaaatcattccactgcactccagcctg

SEQ ID NO: 12617 - DNA, 458 bp, Homo sapiens
tgaagatttctttgatgcagtctttgtaacaaataatttttttttttaaatggagtttctctcttgttgcccaggctggagggcaatggcgtgatcttggctcactgcaacttccacctcctgggttcaagtgattctcctgcctcactcccaagtagctgggattacaggcatgcaccaccatgcctggctaattttgtatttttagtagagacggggtttctccatgttggtaaggctgatctcaaactcccaacctcaggtgatctgcctgcctcggcctcccaaagtgctgggattagaggcgtgagcactgcacctggcctgtagcaaataatttttaagcattctcaagatgtatgatgttgggtttaacatcatatgttcacagtgttttaaataagaaataatctgtctttagtatacaggatggttctttgtttgcctgaaaagtataa

SEQ ID NO: 12618 - DNA, 544 bp, Homo sapiens
aaaaatagaatgttggtgaggaaggtggatgccctcccacctggcgtaggcaccacttgcaactattaaaacgtgaggctggcaactgaccaccacttgggtaagaagtcattccttcagcaaaatactgtatgcaggaatagcatttctgtgaactaagaaaatcaagaagatgcttgcatatgttcttaaaactgtggcttttcaaaagctagagtgatcctgtggttcccagggaaatgagatggcctgttccccagattaaagaaaaaagaaacgattccattcaatgctcacactgataataatatataccttgatttcagaaataactaaatgtgaaaaaaaaaagtacatattagaatcaaagaaatgtaatgkgtttcttgtcaacagacttcaaagtttttggggataagccaatttctggctgatgctggaatgcttttctcaggactggcttcctgccatcttcctccacttcaatctcacaggtttagagcaggcagtgamatcttmtttctgatgcaactgaaatgaactt

SEQ ID NO: 12619 - DNA, 463 bp, Homo sapiens
gtttttggtggagacggggtttcgccatgttgcccaggctggtctcaaactactgagctcaggcgatccacctgcctcggccatctaaagtgctgggattataggtgtatgccactgtgcccagcctgagtaattatttttaacttcactgatttttttaattggaatttaattttttataaattttgaagatctctgagaagtatttcaaattgatattacagtttttttttcttctttggttttatcatagtcatttgtttatgaacagatcttgttgaactgctttgttttcctaaagaaataaaggtcttcgaggctgggcatagtggctcacgtctgtaatcccagcactttgggagcctgaggtgggtggatcacctgagtgcaagaccagcctggtcaacatggcaaagccgtctttactaaaaaacacaaaaattagccgggcatggtggcacat

SEQ ID NO: 12620 - DNA, 325 bp, Homo sapiens
gaaaactacaaaacactgctgaaagaaattatagaaaacacaaacaaaatggaaacacatcacatgctcatgggtgghgtagaatcagtattgtgaaaatgacmwtactgccaaaagcaatctacaaaatgcaatttccatcaaaataccactgtcattcttcacagaactagaaaaaaaactcccaaaattcatatggaaccaaaaaakggcctgcatagctaaagcwagactaagcaaaaagaacaaatctggagacatcacattacctgacttcaaactatactatrrgggcatactacccaaaacaacatggtactggtat

SEQ ID NO: 12621 - DNA, 70 bp, Homo sapiens
  misc_feature 55: n=a, g, c or t
atcatatttttgattttgcstttggssacaccacataaaatattcaatacctggnctttttttttttttt

SEQ ID NO: 12622 - DNA, 97 bp, Homo sapiens
aggagaatgatgggaaccgggaggcggasttgcagtgagccgagatcgcgccactgcactccagcctgggcgacagagcgagactccatctcaaaaa

SEQ ID NO: 12623 - DNA, 274 bp, Homo sapiens
ttggggggccggggcgggcagatcacctgaggtcaggagttggagaccagtcctggccaatatggtgaaacctgtctctgctagagatgcagagattagccgggtgtggtggcacacacctgtaatcccagaggctataattctgtaatcgggaggctgaggcgggagaatcactggaacccgggaggcagaggctgcagtgagccgacatcgggccgctgcactgcasctgggtgacagagcaggaccctctcaaaaaaaaaaaaaaaaaggc

SEQ ID NO: 12624 - DNA, 466 bp, Homo sapiens
ataaaatttttcagtatagtacagtasatatactgtgaggcgcgtgctaaagtgaataagcgagttttcatgctgacccactcaatgctattcagaaatmaattggcttagcactttctcatatccttaggtgcatttagattgccagagttaaccttctgcgtttaaaaaaagaaaaacactaaaaaataaaatacatgtatatacttaaaaaaaaataataaggtttccctcaagggaaaacagcagctacatgcttctttcctatactactgtagcaaaccaaggcattgatgagagggcatgcaaattgtgcttcactttacagtgttttatcagagcacttaataaaatgtaaggctggtatttatttgaagttgtacagtatgacttaattcacatctgttggaatagaaaatatattctgttgagtatttaagaggctgtacatgttttcttttgtgtt

SEQ ID NO: 12625 - DNA, 438 bp, Homo sapiens
cagcagggaaaatggcgctggccatgctggtcttggtggtttcgccgtggtctgcggcccggggagtgcttcgaaactactgggagcgactgctacggaagcttccgcagagccggccgggctttcccagtcctccgtggggaccagcattagcagtacagggcccagccatgtttacagagccagcaaatgataccagtggaagtaaagagaattccagccttttggacagtatcttttggatggcagctcccaaaaatagacgcaccattgaagttaaccggtgtaggagaagaaatccgcagaagcttattaaagttaagaacaacatagacgtttgtcctgaatgtggtcacctgaaacagaaacatgtcctttgtgcctactgctatgaaaaggtgtgcaaggagacttgcagaaatcagacgacagataggg

SEQ ID NO: 12626 - DNA, 147 bp, Homo sapiens
  misc_feature 81..82: n=a, g, c or t
gtgagaacctgtctctacaaaaaaatatgaagattagctgtgcatggtggcacacacttgtggtctcagctacccaggagnntgaggcgggcggttcaaatgagcccatgagattgcggctgcagtgagccatgatcgcgccactgc

SEQ ID NO: 12627 - DNA, 272 bp, Homo sapiens
gggtgcattggctcacgccagtwatcccagcactttgagcggctgaggtgggaggattgcttgggcccgggagttcaagaccagcctggacagcaaggtgaggccccatttctacaaaaaattagccacatgtggtggcatttgcctgtagtcccagctgcatgggagagtgaggtgagagggtcgcttgggcccagagggtagagactgcmgtgagccgtgtttgcacccctgcactccagcctgtgtgacagagtgagactgtgtctcca

SEQ ID NO: 12628 - DNA, 412 bp, Homo sapiens
ttgagtccatacgttatataaataagaatgtaagacatttatcaactgttacgtgtctcagagagtttctacagaaagtcaacccttgaaaataaatcttttccttttattttggatgtttaaaattttacaggtgaaaaaaattctttgaaatataatttcaggccgggcacgtagctcacgccagtaatcccagcactttgggaggccgaggcgggtggatcacttgaggtcacgtgtttgagaccacccttaccaatgttgcgaaactccatctccactaaaaaaaaaatagaaaattagctgggcgtggtggtatgcacctgtaatcctagctactctggaggttgaggcggaagaatcgcttgaacctgggaggcagaggttgcagtgagccgagatcacgccactg

SEQ ID NO: 12629 - DNA, 409 bp, Homo sapiens
cagtggctcatgtgtgtaatcccagcactctgggaggctgagacaggtagatcatttgaggtcaggagttcaaaaccaacctggtctacatggtgaaacccatctcaactaaaaatacaaaaaatacaaaaaattagccgggcgcggtggctcacacctgtaatcccagcactttgggaggtggaggcgggtggatcacaaggtcaagagatcgagaccatcctggccaacatggtgaaaccctgtctctattaaaaatacaaaaattagctgggcgtggtggcgcatgctgtagtcccaactactagggaggctgaggcaggagaatcacttgaacccaggaggtggaggttgcagtgagccgagatcacgccactgcactccagcctggcgacagagcgagactccc

SEQ ID NO: 12630 - DNA, 456 bp, Homo sapiens
atggatgcgggagtatactgattctgtttatataaaattctagaacgtgcaagactggagatggaaatcagatcagtgggtgtctggggtgggatggaggttagagatagactgaaaagcatgaaggaactttttggggtggatagaaatgttttataccttcactagggtagtggttacatgggtatatacattggttaaaagtcattcacctatgtatacccttacagtgtgtgaattttattgtatgtaaattgtacctcagtagattttattaaaaaaaaaaatcaaaggctgggcacagtggctcattcctgtaatcccagcactttgggagggccgagacgggcagatcacgaggtcaggagatcgagaccatcctggctagcatagtgaaaccccatctctactaaaaatgcgaaaaattagcagggcgtggtggcgggcactgtagtc

SEQ ID NO: 12631 - DNA, 297 bp, Homo sapiens
ttaaaagatgccgtttaaaagcatgattgggaaaatgtatgttttttaagagtagattgattcaccctacccacaggacattcaccaagccactgataccattttatatttcatcaattgcatgagtatttgctaatgttgattgaacctccctttccccataatgtgggcagatttggctcagctccttcatgagatcaggtcagtggtattgtttctgtcaagagtgttttttctgtcatttctactttttgtataaaggaaataaaacaatgttaacagccaccaaaaaaaaaa

SEQ ID NO: 12632 - DNA, 263 bp, Homo sapiens
ctttgggaggcagaggcaggcagatcacctgaggtcaggggttcgagatcagcctggccaacatggcaaaatcacatctctactaaaaatacaaaaattagccaggcgtggtggtgcatgcctgtagtcccagctactcaggaggctgaggcaggagaatcgcttgaacccaggaggcggaggttgcagtgagccgagatcatgccattgcgctccagcctgggagacagagcaagactctatctcaaaaaaaaaaaaaaaaa

SEQ ID NO: 12633 - DNA, 421 bp, Homo sapiens
aaccttaaatagatgtaatttctatttgtcaatgatgcctcagcaaagctagggagaaaataaaaaggatccttctgtgcaacagcccgcatgtccattaccgatgactggataaagaaaacgtgctccacccatgcagtggaatactacgcagccataaaacggaatgaagctcggatccaagctagaacgtaggtgagccttggaaacgtggcgctgagtgagagaagctggacacaaaataaggccaggaatggtggctcacagccgtaatcccagcactttacgaggccaagatgggcagatcacttgagtccaggagtttgaggccagcctgggcaacatgacgaaatcctgcctctacaaaaaatacaaagttagccaggagttcatttagaggagtcatgtgactatagtccca

SEQ ID NO: 12634 - DNA, 322 bp, Homo sapiens
aaatctgaaagtgtctgtgtgatggagagagacatggaaaaggcgacgtcscagcggctggaactggggcggaggaacgggaacagggaaggcctgwkttaggcaccacaaaggttttcaggagaaaagtggggcgagccgagaggtcgtccagcatgctctgcccaccccacgccgaggtgcactgaccatgagcctcaactcctccctcagctgcaggaaggagctgagtaatctcactgaggaggagggtggcgaagggggcgtcatcatcacccagttcatcgccatcattgtcatcaccatttttgtctgcctggga

SEQ ID NO: 12635 - DNA, 553 bp, Homo sapiens
taagagttcctttatatcatattcttcagagccaacatttgtcctcaaagcaacgtttcccacctccttttactgagtactgaaaaagttttagcaaagtcacagattaggttgaatttcaaaatatatgtactttaaaaagttctgatttccaaatataataaagttaaaattaagtatatactttaggaagttaccaataacttccatcaaagcagagtaggatatatggtaacattaattttcggtcatttcaaatgaggtatatttcttattagggaaattaaagtccctatatttattatatattttttccttattaacagagtattaatctagtaaaaaataacccagcagtaaataataaagaaattactgaatgagaggataatgaatctgaatcatagcaggaatttgcaatattaattatggttagctatttttctctcattgatttttgtgccacttgaatggaacagaagcaagccttatgttttggraggtctgcggtaaaatgctgtgactgtttactttcaattgcattgtgtgttgc

SEQ ID NO: 12636 - DNA, 426 bp, Homo sapiens
accccttctgtcagtacagtgcactgcacagtggataagaatgtagactccagagccagagagagttgtgtttgacttgtatctacggagcttgtgatttttgacttggcaatttatgwgtttaatgtgagaatttccacttcaccacttgaatcaacttgctgcattgtgaaaatatctagcaaacgacaggagaaaactaacttttactgacacctgctgtgcctgcaaacatatgttatctcaatttatcctcaaaattgtgctgggacatgaagtattgttcccattttacagatgaggaaactgataccatgccgtgctaccaggctaaccaaaactgcagcccaggtttatttaacttcaggtctagtggattcgaagtctacgatctccctcctacaccatgaaatcaaagtaagtctt

SEQ ID NO: 12637 - DNA, 50 bp, Homo sapiens
aggaagaagcggaggaggcggctcccgcgctcgcagggccgtaaccacca

SEQ ID NO: 12638 - DNA, 449 bp, Homo sapiens
tagaatgtcaactgccatcgttattttaaccaatactcccattctccartattcctagaactcttttaggcattgatctgatggcaatattcattcatttattcaacaaatatttatagagcaatcacagtgccatatagtgggaatgcactaattaagatatgacacctggctgggcgcggtggctcacacttgtaatcccagcaccttggaaggctgaggcaggtggattacttgactccaggagtttaagaacagcctggacgacaacctgtctctactaaaagtacgaaaaattagctgggcgtggtggcatgtgcctgtggtcttagctacgtgggaggstgaggtgggagaatcacctgagcccagggaggttgaggctgcagtgagctgagatcgcaccattccactcccgcctgggcaattggagtgagaccctatctgcc

SEQ ID NO: 12639 - DNA, 432 bp, Homo sapiens
cacttttatagctgaataatatttcattgttcatatcacattttgtttgtccattcgtccactgatgggctttgaattgtttccaccttttccctatttgaatactgctgctgtgaacattttgtttgaacatctgttttcagttctttttggtatatactaaggattggaattactgggtcatatggtattttaggyttaaccttttgaggaaccaaaaaaagtttcaaacattaattggtttgccttttaaattgagaaatttaaacattgtatttatttatcgtgtacaatctgatgttttgaaatrcatatatgtatgttgtggccgggcacggtggctcacgcctgtagtcccagcactttgggaggtcgaggcgggtggattacctgaggtcagaagtttgagaccagcctggccaatgtggtgaa

SEQ ID NO: 12640 - DNA, 67 bp, Homo sapiens
cagttagcccagatcatgccagcctgggtgacagaacaagactgcttcttaaaaaaaaaaaaaaaaa

SEQ ID NO: 12641 - DNA, 402 bp, Homo sapiens
aatattaatgaaaaaggtttaatgtgacatataaagtataaagacataattaaaacttagattggagggacaaattcttagaaaaatataacaagaactaactctagctgggcacagtggctcatgcttataatcccagcactttggaaagccaaggcagttggattgcttaagcccatgagttcaagaccaacctgggcaacagcaagaccctgtctctacaaaaaaatttttttaattagccatgtgtagtcccacctgtagtacacatgtgtggtgcgcacctgtagtcccagctactcgggaggctgaggcaggagggttacttgagcccaggaagtcgaggctgcagtgagccgtgactactactgcatgccagcctgggtgacagagcagacccta

SEQ ID NO: 12642 - DNA, 291 bp, Homo sapiens
cttttttaagactttctggctgggtgctgtggctcatgactgtaatcccagcactttgagaggccaaggagggcagatcaaggtcaggagtttgagaccggcctggccaacatggtgaaaccccgtctctactgaaaatgcaaaggttggccgggcatggtggcaggtgcctgtagtcacagctgctcgaggctgaggcaggagaattgcttgaacctggggggcggaggttgcagtgagctgagatcgcgggcaacagagcgagactttgtcacaaaaaaaaaaaaaaaa

SEQ ID NO: 12643 - DNA, 488 bp, Homo sapiens
tctctttggatgatctgttcagtgctgaaagtagggtgttgaagtctcctattattgaaatgcagtctgtctctccctttagatctaatatttgctctggtgttgggatttctaatgtgaagtctattttatctgataaaactacaactactcctgctttcttttgctttccatttgcatggaatatcttcatgtgtccttacgggtgaggtctaccagcaacaaattgcctcaatttttgttttctacaaaagtctctgccaggcacggtagctcacagctgtaatcccagcactttgggaggccaaggcaggtggatcacttggtcagcagttcaagaccggcctggccaacatggtgaaaacccacctctactaaaaatacaaaaattagctgggcgtggtggtgtgtgcctgtaatcccagctactcgggaggctgaggcagaagaatcacttgaacctgggaggcggaggttgcagtgagcca

SEQ ID NO: 12644 - DNA, 344 bp, Homo sapiens
tggctagagtgtacctagagagggaaaatttcaatagacagtaggccagttcaagactggatagaggccgggcgcggggcctgtggtcctagcactttgggaggtcgaggcgggtggatcacctgagctcaggagttcgagagcaacctgaccaacatggtgaaacaccgtctctgctaagaatacagaaattagctaggtgtggtggtgggctcctgtagtcccaggtactcgggaggctgaggcaggaggatcgcttgaacccggaaggcgaaggttgcaatgagccgagatcgtgccattgcactccagcctgggcgacttagcgaaactccgtctcaaaa

SEQ ID NO: 12645 - DNA, 316 bp, Homo sapiens
aaaattgtggcagtttctggccgggcgcagtggctcacgcctgtaatcccagagctttgggaggccgaggcgggcggattacctgaggtgaggagttcgagatcagcctgggcaacacggtgaagccccgtctctactaaaaatacaaaattagccgggcgtggtcgcacatgcctgtaatcccggctgctcgggagcctgaggcaggagaatcgcttggacctgggaggcggaggatgcggtgagccgggatcgcgccattgcactccagcctgggcaacgagtaaatctccgtctcaccaaaaaaaaaaaaaaa

SEQ ID NO: 12646 - DNA, 139 bp, Homo sapiens
gaacattctttaagaagaccaccacatagaataccccttcctatcagctcgctctgatttagccttaattttgttaaattttttagagatgaatgaagtgctgctgtggaaagaaatgtacatatactatttctgtatc

SEQ ID NO: 12647 - DNA, 122 bp, Homo sapiens
attagctaggcatggtggcgtggcacgtgcctgtagtcccagctactcgggaagctgaggcaagagaatcacttgaaccagggaggcggaggttgcagtgagccgaggtcgcaccgttgtac

SEQ ID NO: 12648 - DNA, 331 bp, Homo sapiens
ttgtcaaagatggttgtaggctgggcacagtggcttacgcctgtaatcccagcactttgggaggccgaggcaggcggatcacctgaggttgagagtttgagaccagcctgacgaacatggagaaacccctgttgggagaaatctctactaaaaatgcaaaaaaattagccgggcgtggtggcacatgcctgtaatcccagctactagggaggctgaggcaggagaatcacttgaatctgggaggcggaggttgtggtgagccaagatcacaccattgcactccagcctgggcaacaaaagtgaaactccgtcccaaaaaaaaaaaaaaaaa

SEQ ID NO: 12649 - DNA, 424 bp, Homo sapiens
ttttggggggataaatacctagatagatagggactgctaggtcatgtggtcagtgcacgctcaaccttttacaaaactgcccagttgctttccacatggctgcaccattttgcattcccatcaacaatggataagaactccggctgggtgcagtggctcacgcctataatcccagcactttgggaggccgaggcagttggatcaactgaggtcaggagtttgagacaaggcggactaacatggtgaaacctgtctctactaaaaatacaaaaattagctgggcatggtagcatgggcctgtagtcccacctgcttgggatgctgaggcaggaggcaggagaatcacttgaacccaggaggcaaaggttgcagtgagccaagatcacaccactgcactccagcctgggagacagagcaagactct

SEQ ID NO: 12650 - DNA, 395 bp, Homo sapiens
tagtgaagatttaaaagtgggtagtgttataaagagtaaagtatatttgtagttattgacctgcgaggatacgcgattttgattgagtaaaggaagcaaattggccgggcatggcggctcatgcctgtagtcccagcactttgggaggctgaggcgggcagatcagttgaggttagtttgaggccagcctgaccaacatggcgaaaccccgtctctacaaacaaatgcaaaaattagccgggcaaggtggtgcctgcctgtaataccagctacgcgtgaggctgaggcaggagaatcgcttgaacccgggaggtggggctgaagtgagctgcaattgcaccactacactccagcctgggcgacagagcaagattcggtctcaaaaaaacaaaaca

SEQ ID NO: 12651 - DNA, 344 bp, Homo sapiens; identical to SEQ ID NO: 12644

SEQ ID NO: 12652 - DNA, 60 bp, Homo sapiens
  misc_feature 18..19: n=a, g, c or t
cttttcctttcagcggannggcgcaagatggcagtgcaaatatccaaaaaaaaaaaaaaa

SEQ ID NO: 12653 - DNA, 347 bp, Homo sapiens
caatagttcttaatgtgttcagagttgcaaccatctagttcagttttagaatatttcatcgcttaagaaaaaaccctagtaactattagcacttacactgcattctgccctcccgccatcccctgataacaacaaatatacattctgtttgtatagatttacttagtctggacgtttcatagaaatggaatcccacatccttttgtgactggattctttcacttagcaaaatgttttcaaggttcatctaggcatttaaaatttttaactgtcttaaaacctcatgagttcttatttttaaatctaagagaatggttgcttgaaatattcttacaagggacagaact

SEQ ID NO: 12654 - DNA, 324 bp, Homo sapiens
tttatttttgagacagcttgttgcctaggctggagtgcaatggcgtgatctcggctcactgcagcctctgcctcctgggttcaagcgattctcctgcctcagtctccagaatacctgggattacaggtgcccacaatgatgcccagctaatttttgtatttttagtagagatggggtttaacccttgttggccaggctggtctcgaactcctgagctccagtgatccacccccctcggcctcccaaagtactgggattacagcggtgagccaccgcgcctggccagctttttagttctatttgatatttttaaagaaactgtaa

SEQ ID NO: 12655 - DNA, 422 bp, Homo sapiens
aaatgaaggagaaatacataggtaaaaaattaaaactgggaaaaaaaagtttggcagaaaagatctaatatagatatataataggatcttcccaccccgcccccagaaagaaaaccaaaataaaggaatagcttaaatactgacaagtggccgggtacgtggctcacacctgtaatcccagcagtttgggaggccgaggggggcagatcacgaggtcaggagatcgagaccatcctgactaacatgttgaaaccctgtctctactaaaaatacaaaaaattagccaggcatggtggcgggcgctgtagtcctagctactcgggaggctgtgaggcaggagaatggcgtgaacccgggaggtggagcttgcagtgagctgagatcgcgccactgcactccagcctggggacagagtgagactc

SEQ ID NO: 12656 - DNA, 152 bp, Homo sapiens
tcatggcasaatttatttattaactcaacacatasttattaaaaatcctccataagaaagacasgtagcsgggtasgtggctcasacctgtaatccsagcacttttagaggctsaggtgggtggatcacctgaggtcaggagtttgasacca

SEQ ID NO: 12657 - DNA, 54 bp, Homo sapiens
  misc_feature 23: n=a, g, c or t
gtaggtcatatcgccgcgghganwtttgctctgtgttgtattaagtctgcgcta

SEQ ID NO: 12658 - DNA, 145 bp, Homo sapiens
atatccgtgcgccgagctgataaaggcgccattttggaggggccgcgggatacgtggtgccgctgcgggctcgctctgccgtgcgctaggcttkgtgggaaggcctgttctcgagtccgcgcttttcgtcaccgccatgtcggga

SEQ ID NO: 12659 - DNA, 321 bp, Homo sapiens
tattctggattttctctaacaaataatacttgatagggccaggcatggtggctcacgcctacaatcccagcacttttggaggctgacaggggtggatcactttagctcaggagtttgagaccaacctgggcaacatggtgaaacccatgtctaccaaaaatacaaaaaattaaccgggcctggtggtgtgtggtcccagctactaaggaggctgagatggaaggatgacttgaacccgggaggcggaagttgcagcaagccaagatcacgctactgcactccagcctgggtgacccagtgagaccacatctcaaaaaaaaa

SEQ ID NO: 12660 - DNA, 240 bp, Homo sapiens
gactcacgccttgggaggccgaggcgggtggattacctgaggtcaggagttcaggaccagcctggccaacatggtgaaactccgtctttacaaaaaatacaaaaattagccgggcgtggtggcatacgcctgtaatcccagctacttgggaggctgagacaggagaattgcttgaacctgggaggtggaggttgcagtgagccaagatcgcgccactgcactctagcctgggggacatag

SEQ ID NO: 12661 - DNA, 292 bp, Homo sapiens
tatatgtttggctgggtgtggtggttcacgcctgtaatcccagcactttgggaggccgaggcaggcggatcacaaggtcaggagatcgagaccatcctggctaacacggtgaaacccatctctactaaaaatacaaaaaattagccgggcatggtggtgggcgcctgtagtcccagctactcgggaggctgaggcagaagaatggtgtgaactgggaggcggasttgcagtgagccgagatcgagccagtgcactccagcctgggagacagagcgagactctgtctcaaaaa

SEQ ID NO: 12662 - DNA, 177 bp, Homo sapiens
ggccgggcgcggtggctcacgcctgtaatcccagctctcagggaggctaagaggcgggaggatagcttgagcccaggagttcgagacctgcctgggcaatatagcgagaccccgttctccagaaaaaggaaaaaaaaaaaaacaaaaggacaaaaaaaaaaaaaaaaaggttttttg

SEQ ID NO: 12663 - DNA, 293 bp, Homo sapiens
  misc_feature 61..62: n=a, g, c or t
tactagatggcagccagtgatggaactataaagatgtctgtggtcatatgttgaatgtggnnkcttgaagatgtactgccacgggtgatctagggcaggctgtcttccagtccatgtgttctcggtcgccgtagacagcgctctggctaccaccgtgagctacttgaactgtcaggggcatctgcctaaaccagaatcttttgtcagaaaccttaacccaacaaaacaaatcttgagtagctcatgcccggctcttaggaattttgtctgtttaaaaaaaaaaaaaaaaargs

SEQ ID NO: 12664 - DNA, 424 bp, Homo sapiens
atgggatatgcctagaaacgtgtctttttaaaaaagcctctatgataattttgacatccattgttgagaaccactgctgtaatgaaacttaaattttggttttcatttcattattcgtcaaaggtttgaaatgatcttttagtcaagtcttatggtaattttggttcttgaaggctccccagtatgagccactttggctaattagaattaatctagttttaaaatacatatcacataataactttttgctgaataatcctttgtgaattttaactcacttgctatgtattttagtcatttacaggtggaggatacagattgggtagttctttttgtaagcggtctgaatatatctatggagaaaatcagctgcaagattgtaggtacaataatcaaaatgaaaaagtataaatatttgcttcta

SEQ ID NO: 12665 - DNA, 396 bp, Homo sapiens
  misc_feature 106: n=a, g, c or t
atcagtttcagttttggaggctggaascaagatgaaagcaccagtagatgcaacctcttttgtgagggtgatggtcccatgatgaggctgtgccctgycctgtgwncggatgacctcccaaatgccccacctaataccatccccttgcaggtgaggacttaagcaggtgggttttggggggacgtgctcaggccacagcagggtgcatgaagagccagtgagcctcattgagcccctctggtcagccagatctgacattgagcccagcattgaagatcaaagcaggtggggctttgggatgtgaagtgggttctgacgcggggccccacagacctgtctccgcgtgastgcctgcaggcccctgcgtcattcctcagctgcgtgcgaggcctctgg

SEQ ID NO: 12666 - DNA, 214 bp, Homo sapiens
tacgaaggaaatgcatgcggccaggaggagaatccgcaccaggagcagggagctctacccaggaaaaagaagaaaaggacagattcatttggggttcagcctcatgccccccacacccaagactttgtggctaagagaatcaggccaccttgaggttcatcaagttcatcccattaaaacctcccaaaactctgcaaaaaaaaaaaaaaaaagg

SEQ ID NO: 12667 - DNA, 380 bp, Homo sapiens
cagaaagcattagtatgtcgaggagcactcataactcttgagttccaacgaaaggtgatatctagaagattaataaatgtttaatttaagagaacattggttgggcacggtgtcttatacctgtaatcccagcactttgggaggccgaggtaggcggatcatttgaggtcaggagttcgagaccagcttgaccaatatggtgaaactctgtctctactaaaatacaaaaaattagccaggtgtggtggtgggtgtctgtaatcccagctaattgggaggctgaggcaggagaatcgcctgaacccaggagacggatgttgcagtgagccgagatcacaccactgcactccagcctgggcaacagagcaagactccctctc

SEQ ID NO: 12668 - DNA, 182 bp, Homo sapiens
  misc_feature 90: n=a, g, c or t
cattggatgcatgatggggcagggccggtgatggtgcctcccccttgctggtgtcaggagaggggaaggcagccgctttcaccgctcatnatgtagtctggctacagccctcaaaaacagcttatactctwaagactaattttgaaataaaaccttcatttaatcaaaaaaaaaagaaaaaa

SEQ ID NO: 12669 - DNA, 490 bp, Homo sapiens
tttttcctccacctcttccccctccctgcatcatgttatataagagacttgagcatctgtggattttgttatctgcagggagtcctgaaaccatggatactgagggaaaactatatgatttcccccaagaaggcagtgacatgcacctgtaactctttttcccctagacatatctgtgacatgcttaactacttttatttttccgatgtcaccttaatcagagaaaacttcccagaccaccctatgtaaaataaagcacctctgctgctgctttattctccttaacactactttttttctatagcacctgtcaccagttgacaggttaagtttaacaacttctctcctgtagaatatgaggtgctttaaaatacatgtatgactgaacctcacccacacctactgaagctcttcatttcgggttctgaatgcctattttggggaaacatttctgggattatgacagacatttcaatgacaacctgctcta

SEQ ID NO: 12670 - DNA, 526 bp, Homo sapiens
cccgcttagacaatgccccggagccgccagaccgtcgcgcccctgccccatcgtagtatatgagctcgcctacacaaggacccccgctaaaagccagagccccagtccccgaggcttgaagacggggactcccttctccaccaactctgtcctcggggggtggggccccagccgagatcacagcgcgacaggagtgggggtggccgctggagacaggtgaagaaacaagaaaactaagaaatccgagcggttggagggggagtctgtgtggatgggatggggacgccggggtgctgggaggtaaactgaggcaacgactggggctacagctgctagaactgccacctgaggagtcattgccgctgggaccgctgcttggcgacacggccgtgatccaaggggacacggccctaatcacgcggccctggagccccgctcgtaggccagaggtcgatggagtccgcaaagccctgcaagacctggggctccgaattgtggaaataggagacgagaacgcgacgctgga

SEQ ID NO: 12671 - DNA, 120 bp, Homo sapiens
ggccgggcgcggtggctcacgcctgtaatcccagctctcagggaggctaagaggcgggaggatagcttgagcccaggagttcgagacctgcctgggcaatatagcgagaccccgttctcc

SEQ ID NO: 12672 - DNA, 459 bp, Homo sapiens
ataattgtattttaattaaatgtttttataaacatttagtcaaaatgtacctagagtcaaaatagcagtttttgaaaagtatcttgttctgtgagtatggtgatgaacaaatcaaaacatactctcaggactttataagttactggggaaggctgacattaaataatttgttacataactaattattgagataatgttgaggtaatagggtaactagatctaatttggcaatcggaaatttaagttgtacagagagtagaagthmatttagataagggcattagaagaagacaggtaaaagtctatagctggaaatagcatacttccttsaagattactaggactcatggattttaagcaagagggatactttatcagattcacatttaaaaatagatahctataataaatgtggaaacggttttagagaatagaggtggcaaaagacgctgtcagtag

SEQ ID NO: 12673 - DNA, 505 bp, Homo sapiens
cactgtcttccttccattctcctttcccccatcccatttagtgctgccacagggcagaagcacacaaaccaaccacacagtctctgacttctcctaagcactttgagttgttgaatggggctcaggggcaagagtttttgctgccctccccagcgtggtcacagggttattgaactgcctgcacttgtttctcatgcaactccagcattttccccagaagttgaactatggatagcagcttggtatggatttcctaaatcttaacatttgaagcagcttcttgaggctggcaactatcctggtttctgtcttggagggggtggtttgtttgctggggcccaacgtctgtcccaagtggtggggtgagagtaagttaactttggtgccaggtgagaggtgggggctctttgcttagactccctatcatggaaagattggagttttctatgcagggcactgtggaaaaggattgctgattctgactgacccctgatcagagacatta

SEQ ID NO: 12674 - DNA, 292 bp, Homo sapiens
accaaggccgagtgtggtagctaatgcctgtaatcccagcactttgggaggctgaggtgggcggaacacttgagctcatgagttgaagatcagcctgggtaacatggcaaaaccttgtctctacaaaaaatatagaaattggcgtggtgtggtggtgtgtgcctgwagtcccagctgcttggggggccgvggcaggaggatcgcaccagcctaggaagtcaaggctgaggtaagatgtgttacatgccactgtgctccagcctgggcaacacagtgagactctgccaaaaaa

SEQ ID NO: 12675 - DNA, 444 bp, Homo sapiens
tttagttgtgaatcagaagttttagagctagaaaagaaaaaatgattatgtagttccatgctcactttttttttgttgtttttgaaacaagagttttgctctgttgcccaggctagagtgcaatggcgcagtctcaggtcactgcaacctctgtctcctgggttcaagcgattctcctacctcagcctcctgagtagctgggattgcaggcacctgccaccacacctggctaatttttatatttttagtagagacggggtttcaccatgttggccaggctggtctcaaactcctgacctcaagtgatccacccaccttggcctcccaaagtgttgggattacaggtgtgagccaccgcgcctggccaccatgctcactttttacagcattggaaaggctaagtgatttacccaaaaccatgtattagtggtactgctaggactg

SEQ ID NO: 12676 - DNA, 298 bp, Homo sapiens
tgaaggatctctctctctcatttgttttggattatttggatcaaagcattgtctgctttcttttttaatttcattctatgtagaaaagtactcttcatagaagagcaaggagaaaagttgtttggggccagacttggcaagtagatgtgaacattcttgatgttttaaaagtagcatataggctgggagtggtggctcatgcttgtaatcccaggacttcgagaggctgaggccgtatcacttgaggtcaggtgtttgagattagcctggccaacaagctgaaactccatctctacta

SEQ ID NO: 12677 - DNA, 429 bp, Homo sapiens
agcgctgcacgccggcggcagcatggcggatgtgtcagagaggacactgcagttgtccgtgctagtagccttcgcttctggagtactcctgggctggcaggcgaaccgactgcggaggcgctacttggactggaggaaaaggaggctgcaggacaagctggcggcgacgcagaagaagctggacctggcctgagactctgcgccttccgccccattctgtccccctcatggccaccttgccatgtccgcgccggagccccggtccgccggcgcccagaaccaggcttgccacacagtccccgcctgccatggccggctcttcctggagtgttgcttgttgaagatgcatatagactaccggaaagaaatgacttcttcttgcactttatgaatcaattttatttttaaaataaaaaaattaaacatcta

SEQ ID NO: 12678 - DNA, 397 bp, Homo sapiens
cattaattttattgatttttaaaaaattaaatgttctgagttgtagattcacatgcagttgtgaaataatgtagagtgagcctagatatcttttacctgttttgccccagtgttaacatcttgcataactattaatacaatatcacaactaggatattggcattaacacagtcactctatagaacattcctgtcactgccaggagtcatgctaccctttatagtcatacccaccttctacccctgaacttggccaactgttattctgtaatcgatttctataattttgtcatttcaagaatgttccataaatgaagtcatacatttatgacttcatttgacccagtatgtgaccttttggcattgactttttttatccagcgtgattccctagagag

SEQ ID NO: 12679 - DNA, 328 bp, Homo sapiens
  misc_feature 319: n=a, g, c or t
acagcctgggcaacacagtgagaccctatctcttcaaagaaaaaaaaaaattggccgggcgtggtggcaggtgcctgtggcccttgctactgacagggctgaggcgggaggatgtcttgagcccaggagttgggctgcagtgagctgtgattgtaccactgcactscagcccaggcgacagagggtgaccctgtgtacaaacaaacaaaagaatagtattttgtgacccatgaaaatgatatgacattcaaatttcagtgtcaaaaagtaaagttttggccgggcccagtggctcaacgcctgtaatcccagcagtttnggaggccga

SEQ ID NO: 12680 - DNA, 318 bp, Homo sapiens
tattctggattttctctaacaaataatacttgatagggccaggcatggtggctcacgcctacaatcccagcacttttggaggctgacaggggtggatcactttagctcaggagtttgagaccaacctgggcaacatggtgaaacccatgtctaccaaaaatacaaaaaattaaccgggcctggtggtgtgtggtcccagctactaaggaggctgagatggaaggatgacttgaacccgggaggcggaagttgcagcaagccaagatcacgctactgcactccagcctgggtgacccagtgagaccacatctcaaaaaa

SEQ ID NO: 12681 - DNA, 88 bp, Homo sapiens
ttttccactatggcttcsagcactgtcscggtgagcgstgsttgctcggmtaatgaaactcccgaaatascggacaacgtgggagatt

SEQ ID NO: 12682 - DNA, 83 bp, Homo sapiens
tgacaagtgtgtcttcgtttcgtagctggaactcagctcaaggacactgttgctgaggcctcaaaggagtgcagacttcctga

SEQ ID NO: 12683 - DNA, 460 bp, Homo sapiens
aaaaaagcagaagcggaagtaaactcattcacttattaacaaataattactggctagatgaagtggattatacttgtaatcccaacactttgagaggtgaaggcaagaggattgcttgaagttcaagccagaagttcaagactgcattgagacatgattgcaccactatactccagcctgggcaacagagcaagatcccatctcaaaaatttagcagggtgggtgcggtgactcatgcctgtaataccagcattttggaaaactggtgggcggatgacttgagctcaggagttcgagactaggctaggcaatatggtgaaatcctgtctctatgaacaaaaattagctggatgtggtggtgtgttcctgtggtcccagctacttgggaggctgaggtgggaggactgcttgggctgataggttgaggctgtggtgaaccgtgattgtgccactgctctgc

SEQ ID NO: 12684 - DNA, 177 bp, Homo sapiens
cccaagccccactccatggkgccaggtttcctsacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttg

SEQ ID NO: 12685 - DNA, 361 bp, Homo sapiens
caagtagatgtttttctgttatgtaagcaataatttttccgtgtcttattgagtatggctagcgattatttattacatgctagatgggttctttgcatgtgggttccatataggtgcagaaatttcctcagccactggagggatttcgaccatatttgtcatttggatgagctgttattagattgaaatctacacatcatttcattaaaaattgtgccttagaaaacgcaaagctgttgcacatggcgataaattatggatgcagtacattgaagagagatgaagtcacttccaagtttccaagacttctcatggaggtgtttgctgttttacaggaaaaaataaaaataaaaaaagaaaa

SEQ ID NO: 12686 - DNA, 138 bp, Homo sapiens
cagtactgtgacccagcttgcagcctttactaagagcatgtcttccctccaggatgatcgtgacagggtgatagatgaagctaagaaatgggagaggaagtttagtgatgcgattcaaagcaaaaaaaaaaaaaaaaa

SEQ ID NO: 12687 - DNA, 395 bp, Homo sapiens
cctttctccctctcagaaccttcctgccgtcgcgtttgcacctcgctgctccagcctctggggcgcattccaaccttccagcctgcgacctgcggagaaaaaaaattacttattttcttgccccatacataccttgaggcgagcaaaaaattaaattttaaccatgagggaaatcgtgcacatccaggctggtcagtgtggcaaccagatcggtgccaagttctgggaggtgatcagtgatgaacatggcatcgaccccaccggcacctaccacggggacagcgacctgcagctggaccgcatctctgtgtactacaatgaagccacaggtggcaaatatgttcctcgtgccatcctggtggatctagaacctggccaaaaaaaaaaaaaaaagg

SEQ ID NO: 12688 - DNA, 468 bp, Homo sapiens
  misc_feature 284,370: n=a, g, c or t
aggagggcgttctgggtttcgggctggggagctggcagaggcgcgtcttacccctgtggtgggtgtcccgaggccggcgcgtctgtggacaggcaacgcaggccggagggctaggactccggcctctgagaggcgggcggttgtccaggggagtccttcgtgccggcgggaagcgcaagggtgccggaagcctgaggtccgccgcccggccaccccttctcgcatcttgactctgagatttgctccgggtccggcggggagactcgaggtcgatcgggagtttnggttgagaaaacgcccactgagcggtagctcttgtctccttgacatctgagccctgggaattaaactcacgctacataaaacggtnggcacagacccccttgagaatctggggcggtgacggatgcccgaagctgtccactttgagggcgaaaattgtaagcagtgttgcaacgatttttaaaa

SEQ ID NO: 12689 - DNA, 281 bp, Homo sapiens
cattttagaaggatctatttggaaggatccatttggaaggattgcttgagcccaggagttcgagactagcctgggcgatgtgatgagacactgtatttacaaaaatacaaaaaaattaaccaggtgtggtgacatgtgcctgtagtcccagctattcgagagcctgaggtaggaggatcacttaagcctagggaggccaaggctgcagtgagccgagattgcaccattgctctgcagccagcctgggtgacagagtgagaccgtgtaacaaaaaacaacaa

SEQ ID NO: 12690 - DNA, 453 bp, Homo sapiens
  misc_feature 437: n=a, g, c or t
tttttgagacggagtctctctctgtcacccaggctggagtgcagtggtgcgatctctgctcactgcaagctccgcctcccgggttcacgccattttcctgcctcagcctcccgagtagacaggactacaggcatgtgccaccacgcctggctaattttttgtatttttagtagagatggggtttcactgtgttagccaggatggtctcgatctgctgacctcgtgatcttcccgccttggcctcccaaagtgctgggattacaggcgtgagcaccgcgcccggcctgattcttctctgttcataaaactctttgtcmcgtctcaggaaaatctatcttgccagatctctaccagttaatgctaattactaatagatttatccacctttttgtctgcaaagtcaagacaagtacacatttagatgtggcagaaatganatgttacttcatagca

SEQ ID NO: 12691 - DNA, 460 bp, Homo sapiens
tcttgagaaatcaccatgattaggccaattgtcaatcagtattcagaaactagaaaggaacaatgagatacttgtttatggttctttagggcatatgtttgaaaaccctctcatctcagatctgtatagctggtgtgtgtttgtgtccataaatacacgtgcattgctgtcgtgcccattaagaaagggggagtaagtaaaagaggaatcgctcagatctttccttggatgaacagcagtggcgtggttggtgtgttgactgtgaacaggctgacttagctgttgatgtatactcagaacctccatctcctcccagaccctgcacttttccttctctgcagtctgattctctaatgactgtcactggacaaaccccagttttatgctcgcttagtaaaaataagtttaaacatttcatggtggttgacagaactttgtccccaaacatgcggattcaatt

SEQ ID NO: 12692 - DNA, 61 bp, Homo sapiens
cttttcctttcagcggascgggcgcaagatggcagtgcaaatatccaaaaaaaaaaaaaaa

SEQ ID NO: 12693 - DNA, 193 bp, Homo sapiens
caagggatcgagactatcttggccaacatggtgaaacccatctctacaaaaaatacaaaaattagctggtcgtggtggcacatgcctgtagtcccagctactcgggaggctgaggcaggagaatcgcttgagcccgggagacagaggttgcagtaagccgagaccacaccactgcactccagcatggcgacag

SEQ ID NO: 12694 - DNA, 447 bp, Homo sapiens
cttggcatctctcaaccctcagtcctctcttccttcccttctttatcatctcccctttcctctccacgtcccgcccccttcctcttcctgcctcctcatctcccttaagcatcctcttctccaacctcccgtcaccgtttactctgcaaaattgacagcacttagacgaggcttgggggcagggagcagtgttgggagagggctccccaaccccaggctcggactgttctctgctgggaccacccagggtcggacacccaagggtgcctggcaggtcgcagagttggcaagccgggcctcgtatggggactcgggtgagggtggcgagtactggttccgaacgcacgcaggggagaagggagacgcggcgctgacccttccaggtcagctggagttgacccgcccacctgggcttttcaaccccagtccgcgagtttctttcttgaa

SEQ ID NO: 12695 - DNA, 315 bp, Homo sapiens
tatcgtcgggcacggtgactcacgcctgtggtcccggcatcttgggaggctgaggcgggtggatcatgaggtcggatcgggaccatcctggccagcatggtgaaacctgtctctgataaaggtgcaagggttatccgggtgtggtggtgtgtgcctgtggtcccggctgctcggggggctgaggcgggagagtcgcttgggcccggaaatcggaggttgcagtgagtgagctgggatcgcgccactgcactccagcctggcgacggagtgagactctgtctcaataaaaaaaacaaaaaacaaaaacaacaacaa

SEQ ID NO: 12696 - DNA, 108 bp, Homo sapiens
atttttcatagagacatggtttcaccatgttagccatgatggtctcgatctcctgacctcgtgatccacatgccttggcctcccaaagtgctgggattacatgcgtga

SEQ ID NO: 12697 - DNA, 398 bp, Homo sapiens
attcccagcgtgcagctcagcaaggggtccgtccttctctgtcactgtctcttttgcctgttgtaattctgtctgcctctctgggactctgcctgtctcactctttctgtctgtgcctctcctcactcttgttctttctgcctgaatcacagccctcagtktttctgtcctcatgcatttgtctttgtggctctttccgtctttctgcccttgacaccatcccctctcccagtgcttcccctctgcttccagatcgcttcatgacttaggcagggaaacagaggtcagggcctccttccaggcttccctctgcatcttactgagtatgcgtcggaagagcctcgggtcctgcctccgcgggtggcctagagccaaaggaaggcggascgttcggggcg

SEQ ID NO: 12698 - DNA, 267 bp, Homo sapiens
cattctcttgtatataaaggaagcaatgtgtgtcaggcctctgtgcagtcaacccagcctcctcccgccagtgctaaccccgtgttgagcctgcatgctgacactgtggccgatctggactctagaagtgctagtttgaaatatatccattaccgtcatttccttttgagcttgtggacaagctgaatgtcaggactgacttctccagctcccagccctgcggggtgtccttggcatcccatcagcagaggagatgcgtcccttgtt

SEQ ID NO: 12699 - DNA, 318 bp, Homo sapiens
cagaaaatcttaaaatatgtatcatcgagggctgggcgcggtggctcacgcctataatcccagcactttgggaggccgagacgggcagatcaggaggtcaggagatcgagaccatcctggctaacacggtgaaacccagtctctactaaaaatacaaaaaaaaattagccaggcgtggtggtgggtgcctgtagtcccagctactcaggaggctgaagcaggagaatggcgtgaacccgggaggcggacttgcagtgagccaggatcacaccactgcactacagcctgggcgacagagcgagactctgtctcaaaaaa

SEQ ID NO: 12700 - DNA, 385 bp, Homo sapiens
tagtgaagatttaaaagtgggtagtgttataaagagtaaagtatatttgtagttattgacctgcgaggatacgcgattttgattgagtaaaggaagcaaattggccgggcatggcggctcatgcctgtagtcccagcactttgggaggctgaggcgggcagatcagttgaggttagtttgaggccagcctgaccaacatggcgaaaccccgtctctacaaacaaatgcaaaaattagccgggcaaggtggtgcctgcctgtaataccagctacgcgggaggctgaggcaggagaatcgcttgaacccgggaggtggggctgaagtgagctgcaattgcaccactacactccagcctgggcgacagagcaagattcggtctcaaaa

SEQ ID NO: 12701 - DNA, 50 bp, Homo sapiens
atagcctttgtaggggttttttggttcctttttttttttwcagtttttgt

SEQ ID NO: 12702 - DNA, 286 bp, Homo sapiens
  misc_feature 218: n=a, g, c or t
gggtgcattggctcacgccagtaatcccagcactttgagcggctgaggtgggaggattgcttgggcccgggagttcaagaccagcctggacagcaaggtgaggccccatttctacaaaaaattagccacatgtggtggcatttgcctgtagtcccagctgcatgggagagtgaggtgagagggtcgcttgggcccagaggtagagactgcagtgagcngtgtttgcacccctgcactccagcctgtgtgacagagtgagactgtgtctccaaaaaaaaaaaaaaaa

SEQ ID NO: 12703 - DNA, 315 bp, Homo sapiens
  misc_feature 178..179: n=a, g, c or t
actcccgggagcatgaaggaccgaacccaggagctccgcacggccaaggacagcgatgatgatgatgatgtcgctgtcaccgtggaccgagaccgcttcatggatgagttctttgagcaggtggaggagattcgaggcttcattgacaagatcgcagagaacgtggaggaggtgaagnnaaacacagtrccatcctggcatcccccaaccccgatgagaagaggdwggaggagctggaagaactcatgtccgacataaagaagacagcaaacaaagttcgttccaagttaaagakcatcgagcagtccatcgagc

SEQ ID NO: 12704 - DNA, 219 bp, Homo sapiens
gagaccagcctggccaacgcggtgaaacctgtctctactgaaaatacaaaaattagctgggcgtggtggcaggcgcctgtaatcccagctacctgggaggctgaggcaggagaattgcttgaacccgggaaccagaggttgcagtgagccgagatcatgccattgtacttcagcctgggcgacagagtgagactccatctccaaaaaaaaaaaaaaaaa

SEQ ID NO: 12705 - DNA, 63 bp, Homo sapiens
  misc_feature 20,25: n=a, g, c or t
cttttcctttcagcggacgnggcgncaagatggcagtgcaaatatccaaaaaaaaaaaaaaaa

SEQ ID NO: 12706 - DNA, 184 bp, Homo sapiens
tatagcagtcttttgataacaatagttaagaggccaggcacggtggctcatgcctgtaattccggcactttgggaggctgaggcgggcggatcacctgaggttgggagttcgagaccggcctgggccaacatggtgaaacccgtctctaccaaaaaaaaaaaaaaaaaggcttatcgawaccgt

SEQ ID NO: 12707 - DNA, 199 bp, Homo sapiens
aaatacaaaaaattagctgggcgtggtggcgggtgcctgtagtcccagctactcgacgctcagtagctattcagtagctactgaggcaggagaatggcctggacccgggaggtggagtttgcagtgagccgagatcctgccactgcactccggcctgggtgacagagcaagactctatctctaaaaaaaaaaaaaaaaa

SEQ ID NO: 12708 - DNA, 299 bp, Homo sapiens
tacaaataaaatatcaaaaacatggccaggcgcggtggctcacgcctgtaatcccagcactttgggaggccgaagccgcggatcacgaggtcaggagatcgaaaccgtcctggctaacacagtgaaaccccgtctctactaaaaatacaaaaaattagcctggcttggtgctactcgggaggctgcggcaggagaatggcgtgaacccgggaggcggacttgcagtgagccgagatctcgccactgcactccagcctgggtgacagggcaagactccatctcaaaaaacaaaaacaaaa

SEQ ID NO: 12709 - DNA, 134 bp, Homo sapiens
caaatccggagtagttcgtgccacagtcgtcctcggaaccctgtggccccttcctcacccgtttcagggccacttggttcccacctccaccttcttagtctgcctgccctgctttccatcttcttggaattcgc

SEQ ID NO: 12710 - DNA, 81 bp, Homo sapiens
acaaaataatatattaaattcatgtttgggcactggcaataactgatgttaaaaaaaaaaaagcgccaaagtatagtcaga

SEQ ID NO: 12711 - DNA, 293 bp, Homo sapiens
ttctggatgagtgtagtggctcacgcttgtaattccagcagtttgggaggccaaggtgggagaattgcttgagcctaggagtttgagatcagcctgggcaacataactagatgctgtgtctacaaataataaaaaaattagctgagtgtcgtggcctgtgtatctggtcccacctactcgggaggctgggatgggaggattgcttgagcctaggaggtcaaggcagtagtgtgttgtgataatactaccgtactccagcctgggcaacagagtgagaccccatccctccacaa

SEQ ID NO: 12712 - DNA, 372 bp, Homo sapiens
ggattacaaaaattggctgggcatggtggcgtgtggctgtggtcccagctacttgggaggctgaggcaggagagtcacttgaactcgggagccagagactgcagtgagctgagatcgcgccactgcattccagcctgggcgacagagtgagactctgtctcaatcagtcaatcaatcaatcaatcaaattggaatatgagcactaaccttggtaagttaaaattttgggaaaattgtacctgcagaatatgatggatgaaaacaacagccaggtgcggtggctcgcgcgtgtaatcccagcactttgggaggccgagacaggcacatcatctgaggtcaggacttccagaccagcctgtccaacatggtgaa

SEQ ID NO: 12713 - DNA, 208 bp, Homo sapiens
  misc_feature 125: n=a, g, c or t
ttactttttgataataggctgttgtttttcttaaataagcttaaaacaattctatctgaaattggtagcatgggttcacttggctacaactgagcaaaatagatgcaactttcttttaatggggnctgcctctttaggactgactgtactatccactgacactggtttggcagttggtactgctgaacatttttatacatgctaccat

SEQ ID NO: 12714 - DNA, 264 bp, Homo sapiens
tttcctgaagctatgcttctatttctggactcatcgccaagtcacctgaaggcaatacaaatgaagtatctgggccacatgcagtggctcacgcctgtaatcccagcactttgggaagctgaggtgggaggataccttgagcccagaaaaaaaaaaaattagcctggcatggtggcacgtgcctgtagtcccagttacttgggaggctgaggtgggaggatcacttgagcctgggagttggaggctacattgatccttggtcgt

SEQ ID NO: 12715 - DNA, 120 bp, Homo sapiens
ttttattttctgtttgtccccacctccccagccttccacctcctgttcttcctamcttcttcctttttgactaaataatccccacctcccttgatcatacagtgaggctacagtgactga

SEQ ID NO: 12716 - DNA, 479 bp, Homo sapiens
  misc_feature 40: n=a, g, c or t
aatgtcccattggatcctattactgagccatctccttcanccccctttccgccccctcctctaggtttccgagagggagcagcaggggattggcgcccgtktccccgcccgacagccgcccgacagccccccgacccgtggccccattacagcgcgtgggcggcgatccagcaggaggaggcgcagatccacaggccgaagagatgcagacgcggttgcgggcgaaagcggtccaggagtcgctggtgttgatgctgaaaagttacaggatctcttccaggaggaggatggcagtacagcagcttaccctacaaagacaacatgaatgacaacagtgcagcctaagtgccatctgtggcctcagaggagacagctccacccagtcacactctgatggagctttctgccttctggttaagttagctgagttgagtttttggtctactgcagctgaagagtcctttttctaatacatcaat

SEQ ID NO: 12717 - DNA, 169 bp, Homo sapiens; identical to SEQ ID NO: 12600

SEQ ID NO: 12718 - DNA, 328 bp, Homo sapiens
atgggacatagtcttaaaaatgtctgaaacakgctgggcatggtggctcacacctgtattcccagcagtttgggaggctgaggtgggtggatcacgaggtcaggagaccgagaccatcctgaccaacacggtgaaacctcgtctctactaaaaatgcaaaaattggctgggcatggtggtgtgcacctgtagtctcagctacttgggaggctgaggcaggagagtcatttgaacccgggaggcggaggttgcagtgagccgagataggccactgcactccagcctggcagcagagtggagactccatctcaaaaaaaaaaaaaaaaag

SEQ ID NO: 12719 - DNA, 333 bp, Homo sapiens
  misc_feature 7: n=a, g, c or t
tgtttantcccgggacgtgggcagaccttgtaccaggcgagctctcgctttgctagcaaaagagctcctctcttcccaaaccctgctactacgctgtccaccccgtatggtctttgaggtctttgaggtttttttggaattcacttgctggagactacagctcacagaacgccctgggctggattgtgccagctgtagttcgcgaaccaaggacatttcctggaaatgcatgcggccacgttatctgtgacagaaatggcagttgctsacgtgcgttacgccccctrgaagacttrgraatacggaacttgagtgagcactgwgaggatacag

SEQ ID NO: 12720 - DNA, 291 bp, Homo sapiens
accaaggccgagtgtggtagctaatgcctgtaatcccagcactttgggaggctgaggtgggcggaacacttgagctcatgagttgaagatcagcctgggtaacatggcaaaaccttgtctctacaaaaaatatagaaattggcgtggtgtggtggtgtgtgcctgtagtcccagctgcttggggggccgaggcaggaggatcgcaccagcctaggaagtcaaggctgaggtaagatgtgttcatgccactgtgctccagcctgggcaacacagtgagactctgccaaaaaa

SEQ ID NO: 12721 - DNA, 203 bp, Homo sapiens
tgaactatcaaacttaggagccatctagcttacacgtgttccttaaaaagtttgctgtaggccgggcacagtggctcgtacctgtagtcccagcacttttgggagcccagggtgggggatcacttgagctcaggagttcaagaccagcctgggcaacatggcaaaacgccatctctacaaaaatacaaaaaaaaaaaaaaaaa

SEQ ID NO: 12722 - DNA, 329 bp, Homo sapiens
cagaaaatcttaaaatatgtatcatcgagggctgggcgcggtggctcacgcctataatcccagcactttgggaggccgagacgggcagatcaggaggtcaggagatcgagaccatcctggctaacacggtgaaaccagtctctactaaaaatacaaaaaaaaattagccaggcgtggtggtgggtgcctgtagtcccagctactcaggaggctgaagcaggagaatggcgtgaacccgggaggcggasttgcagtgagccaggatcacaccactgcactacagcctgggcgacagagcgagactctgtctcaaaaaaaaaaaaaaaaag

SEQ ID NO: 12723 - DNA, 400 bp, Homo sapiens
cacctgtgtattctcttcagtgaatcatctggatgtcttttgcccactttctttttttttcatttttattattttcattaatttttttctttggccactggaataaagactcaccattttctaactgagtgatgttttttaaatatatattttttagagacagggtctcactctgtggcacagagtgcattgtagctttgaactcctcagctcaagctgtcctcccgcctcagcctcatgagtagctagtactacaggcacatgccactacacctggctaatttttttatttgtttgtggagacagggtcttactatgttgctgaggctggtgtttaactcctggactgcagtgaccctctcatctcagcctcccaaagtgttgggattacaggcatgcg

SEQ ID NO: 12724 - DNA, 499 bp, Homo sapiens
cacttttatagctgaataatatttcattgttcatatcacattttgtttgtccattcgtccactgatgggctttgaattgtttccaccttttccctatttgaatactgctgctgtgaacattttgtttgaacatctgttttcagttctttttggtatatactaaggattggaattactgggtcatatggtattttaggtttaaccttttgaggaaccaaaaaaagtttcaaacattaattggtttgccttttaaattgagaaatttaaacattgtatttatttatcgtgtacaatctgatgttttgaaatacatatatgtatgttgtggccgggcacggtggctcacgcctgtagtcccagcactttgggaggtcgaggcgggtggattacctgaggtcagaagtttgagaccagcctggccaatgtggtgaaacctgtctctactaarratacaaaaaattagccgggcttggtggtagcgcctgtagtcccagctact

SEQ ID NO: 12725 - DNA, 263 bp, Homo sapiens
ctttgggaggccaaagctggcggatcatgaggtcaggagtttgagaccagcctgaccaacatgctgaaaccctgttgctactaaaaatacaaaaattgaccgggcatggtggcgcgtgcctgtggtcccagctactcaggaggctgaggcgggagagctgcttgagcctgggaggcagaggttgcagtgagccaagatcgcgccactgcactccagcctgggtgacagagcgagactcttgtcccacaaaaaaaaaaaaaaaa

SEQ ID NO: 12726 - DNA, 322 bp, Homo sapiens
gaaggaatttgggagacaaaaaatggagactcagaaaattagagaagagaaaaatgggaggggggagcctggacaataaaacgggggtcctcaggaggcaggaaattagcgattaaatgggagcagaggtggaggaggccgacactggtgccagagataaaagtggagtcccaaaaaaaggggtgcgctgggccgtttttaaaattgggaaacataaaaaatacccagtggaaaatgaagagagagaacggggcatgctaaagttaacatgggcggcgagaaagggacaggtagccagcggaaaakggggagactgagaaac

SEQ ID NO: 12727 - DNA, 261 bp, Homo sapiens
  misc_feature 56: n=a, g, c or t
gactcacgccttgggaggccgaggcgggtggattacctgaggtcaggagttcaggncagcctggccaacatggtgaaactccgtctttacaaaaaatacaaaaattagccgggcgtggtggcatacgcctgtaatcccagctacttgggaggctgagacaggagaattgcttgaacctgggaggtggaggttgcagtgagccaagatcgcgccactgcactctagcctgggggacatagcaagactttgtctcaaaaaaaa

SEQ ID NO: 12728 - DNA, 138 bp, Homo sapiens
aattagaactttatgttcatcaaaagataccattaagataccccataggccaggatacaataatcacaacacatatatctgaacttatatgcagaatgtatcttaatactcttacaactcaaaaatacagatacttta

SEQ ID NO: 12729 - DNA, 243 bp, Homo sapiens
  misc_feature 48..49: n=a, g, c or t
aatttgtgtgatttctggctgtttctttatgtttcatgkcgtgctksnnsattttggagaaaagacaaaaataggctaacwttgttttacaactagggaaaatgtgcatagaattgttcatatttgcaaaatgaattaatagaactacttaaaattagattttcctgctttaaactcccgttctttatcctctgtttccataactcagctatgtatttttgtttgtttataatcgtttgtttg

SEQ ID NO: 12730 - DNA, 413 bp, Homo sapiens
cagtggctcatgtgtgtaatcccagcactctgggaggctgagacaggtagatcatttgaggtcaggagttcaaaaccaacctggtctacatggtgaaacccatctcaactaaaaatacaaaaaatacaaaaaattagccgggcgcggtggctcacacctgtaatcccagcactttgggaggtggaggcgggtggatcacaaggtcaagagatcgagaccatcctggccaacatggtgaaacctgtctctattaaaaatacaaaaattagctgggcgtggtggcgcatgctgtagtcccaactactagggaggctgaggcaggagaatcacttgaacccaggaggtggaggttgcagtgagccgagatcacgccactgcactccagcctggcgacagagcgagactccctccca

SEQ ID NO: 12731 - DNA, 393 bp, Homo sapiens
aaaaaaaaawtttccaacttcttttgsattsgaastacttactagggacccaagaaagcaatcaagtggaagacgttggagtgggattcctgatatcttgagttcctcctcagagccaagtgagcctcccttgcagctagggtgcaggcatgtgaccttggttcctccaatcatccttgcccacctgagasgccaactgagtgatgagctatgcatgggaahagctgtgtgcagggcatcctttttctgccagcctggtggcatttaaagcagtgtggcctggagtcagtgacagtgggtggcaggtcctccatgagtctgattctgcaatatgcttcttggagaggctcttgaaagctgcatccagatcctgtttctctaacatccctaaat

SEQ ID NO: 12732 - DNA, 119 bp, Homo sapiens
tttaggatcagatctgtgagcacgttggcgaggaaaaacaaaacaaacaaaaaaaagaaccttgtgtctgtctggtgaaaaaaagaaaaacaaattggaagagaggaccatgagaattt

SEQ ID NO: 12733 - DNA, 387 bp, Homo sapiens
taacaaaacggtttttttcttccctttttccttccctgatgctttgacctatgtcatttccttgggctaaagagtgtattgaaagaaagaaaggccaggcgtgatggctcatgcctgtaatcccagcacttggggaggctgagtcaggtggatcacgaggtcaggagatcgagaccatcctggctaacatggtgaaaccccgtctctactaaaaatgcgaaagaattagccgggcttggtggcacgtgcctgtggtcccggctactcgggaggctgaggcgggagaatcgcttgaacccgggaggcggaggttgcagagagccgagatcgtgccactgcactccagcctgggtgacagagggagactccgtttcaaaaaccaagcaa

SEQ ID NO: 12734 - DNA, 173 bp, Homo sapiens
tacaaaattagccgggcgtggtggcatgcgcctataatctcagctacttgggaggctgaggcaggagaattgcttgaacccaggaggcggaggttgcggtgagttgagatcgtgccattgcactccggcctgggcaacaacagcaaaactccgtcgcaaaaaaaaaaaaaaaa

SEQ ID NO: 12735 - DNA, 416 bp, Homo sapiens
cacaaaggatcttaaaaagctgtggactcatgggtcaggacttaataaagttgatttttactgctttttctgatgcaacactggtgtgtgtgtgtgtgtgtgtactgtgtgtgtggtggtgaagactcaattacaacaagaccagcacagtgtggtgccagtcttgagtcagtgcaggccccacagcttgtttccgcactgctcctacaccatcaatgtgaaagccatcacaaacaaaggggcatggtaacaaatcatggccgtgttattattaaaacagttctgatcctagccccccgagtggtctcaggaagcccccaggagactgcagatcacatttcaagaactgctgtgctagaggaacccccactagaagttaaggggtgcgtatcagccaagtgcagggctgggacagg

SEQ ID NO: 12736 - DNA, 400 bp, Homo sapiens
  misc_feature 240,254..255,326: n=a, g, c or t
attgtgggattggatgagtctcaagatggacaaccgggatgttgcaggaaaggctaaccggtggtttggggttgctccccctaaatctggaaaaatgaacatgaacatccttcaccaggaagagctcatcgctcagaagaaacgggaaattgaagccaaaatggaacagaaagccaagcagaatcaggtggccagccctcagcccccacatcctggcgaaatcacaaatgcacacaactnttcctgcatttccnncaagtttgccaacgatggtagcttcttgcagcagtttctgaagttgcagaaggcacagaccagcacagabnccccgaccagtgcgcccagcgccctcccagcacacccacccccagcgctgggaagaggtccctgctcatcagca

SEQ ID NO: 12737 - DNA, 494 bp, Homo sapiens
caaaaagaaatctttttaggctggagtgcagtgatgcagtcttggctcattgcaacctctgccccctgggttcgggcgattctcctgcctcagcctcccaagtagctgagcacccgccagcacgcctggctaatttttgtatttttagtggaggcggggtttcaccatgttggccaggctggtctcgagctcctggcctcaagtgatctgcccacctcggcctcccaaagtgctgggattacaggcgtgasactgtgccaagcctgaaaaaagttcattttaacagagcttatttactgtctgaaggttatcagataggcagatcagatctggcagtgttctccaaactggactgtgttttcaaaaatggatattgaacatgacatgttcttaagagagattctgttccctttcccccaaattctgcactctcagtatcctaacagggttcaaatctcaatgggaataattagacacagggaaacaacatagac

SEQ ID NO: 12738 - DNA, 56 bp, Homo sapiens
caaggtcagaacaggtttttttgtttttgttttttgttctttgtttttttttttga

SEQ ID NO: 12739 - DNA, 54 bp, Homo sapiens
aattgtgttcgcagccgccgccgcgccgccgtcgctctccaacgccagcgccgc

SEQ ID NO: 12740 - DNA, 257 bp, Homo sapiens
aatttactttcgagcatgttttgaagaggtagttagtcaatctttatgtcccttttgaagatatgatgaaatagttacatctctattatggaataamattaagtggtttaaaaaatgagtgatgtatggtctggcatggtggctcacgcctgtaatcccagcactttgggaggccgaggcaggtggattatctgatgtcaggagttcaagaccagcctggccgatgtggtgaamcccatctgtgctaaaaatacaaa

SEQ ID NO: 12741 - DNA, 310 bp, Homo sapiens
tttttctagggttgttacgaagctgcaggaggaaaatgaaatggaggaggaggaggaggaaaaagaaatggaggaggaaaaagaaacaggaggaggaaaaagaaacggaggaggaagaggaggaggaggacaaagaaacagccaggccggacgtggtggctcacccctgtagtcccagctgctcgggaggctgaggcagaagaatcgcttcaacccgggaggcagagtttgcgtgascgagatcgtgccactgcattccagcctggagacagagtgagactccatctcatctcaaaaaaaaaaaaaaaaa

SEQ ID NO: 12742 - DNA, 63 bp, Homo sapiens
acacggcgcgacaagatggcggataaggagaagaagaaaaaggagagcatcttggacttgtca

SEQ ID NO: 12743 - DNA, 155 bp, Homo sapiens
ttcccacacacctgtaatcccagctacttggggggctgaggcaggagaatcacttgaacctgggaggcggagattgcgagcagagatcacaccactgcactccagcctgggtgacagagcaagaccccatcttaaaaaaaaaaaaaaaaaagytt

SEQ ID NO: 12744 - DNA, 290 bp, Homo sapiens
  misc_feature 3: n=a, g, c or t
ccnagctttattgatcgcgtgggtgcgggtagggatctaaatttgtctcccagattttctctgaaatcgagtctcttgggagtgaaggtccatatgattacaccacgtccttagcagtcgcgttgtgttcaaaatgggcatgggtgctcgcggcgsgatactgagttccccagagacgcggagtcttttgccccaggggcttattcttgttttctcaatggaacaggtcttcgaatctccccaggaacatctcagtaagtaggggtgtgcgtgttttgtgtgtgtgtcag

SEQ ID NO: 12745 - DNA, 50 bp, Homo sapiens
caggatgggccaccagccacctcctccaactcaacaacattctataactg

SEQ ID NO: 12746 - DNA, 443 bp, Homo sapiens
tgaattaataatagtaacttattttaataatagtaacttattttataatttctgaattactttatttttcaaaaataaaagtgtgcatattactatttaatcataaacaagttccatcactatgatgtcaaggaggaaaccatttcatagaaaaatagaccaaagttaccctatgcatgagctactactaatctaaagccaacttcactctcagttatttcaataggacataagtttattgattgactctgtggttagttccagaaacccaacccctttgaaagttactgtacacatttgtaaataaatggtatatttagcacctatactatgacaattataaactcatttgtgtcatgtaaattttctttggataatataaccagacttcagatgaaaagacatagatctgcattaatctgtaaggtagcctagccacatgt

SEQ ID NO: 12747 - DNA, 53 bp, Homo sapiens
ctttgcatctgcacgtgttcgcagtcgtttccgcgatgctgcctctgctgcgc

SEQ ID NO: 12748 - DNA, 74 bp, Homo sapiens
aattgtgttcgcagccgccgccgcgccgccgtcgctctccaacgccagcgccgcctctcgctcgccgagctcca

SEQ ID NO: 12749 - DNA, 434 bp, Homo sapiens
atttctatgtcaatacaaaaatacatcacagccttctcaaacagctcaagcaatatattgtatattgccatatcgtctggtgaaagggttaaattacttcacctcttgcacttttagatgcaaatcagtttttcatttctgtaatagaaaattattcacgtatttttacatcatttgtttttcctgaccagtatttaaaaccaaaaggatattctgaaaaatggccaacaatttttttagaagtagcatcccaagcagcgtgcctaaacattacattgcatatggaaataaaagaatcaaacgtctaatgccttattatttctgatttcctttttcattttaagtggtgtggagattccagcactcccaggacagtggagtcagcagtaagccctgggacaggtggcaagggtgggtcccttgacctttgcacg

SEQ ID NO: 12750 - DNA, 274 bp, Homo sapiens
aaattagtcgggcatggtgatgtgcacctgtagtcccagctgctcgggaggctgaggcaggagaatcgcttgaacccgggagacagaggttgcaacgagccaagatcgagccactgcgctccggcctgggtgacaggagactccatctcaaaaaataaaattaaaaaaaaactactacaataaattatcaccttggactgtataaaacaacttttaaactagtctttttaaaaagtacacttaaataaaaatctaaacataagagaatgcaaaa

SEQ ID NO: 12751 - DNA, 397 bp, Homo sapiens
  misc_feature 250: n=a, g, c or t
cttctcaaatgatttgggatgaaagactagttttttggctggtttatttctaattggttgtaaacagatacttaaaaaaaatgcaatcaacatgaatcgttagaaaagtgttggcagggcgcggtggctcacgcctgtaatcccagcactttgggaggccgaggtgggcggatcacgaggtcaggagatcgagaccatcctggctaacacagtgaaaccctgtctctactaaaaatacaaaaaattagcnggaagtggtggcgggtgcctgtagtcccagckactcgggaggccgaggcaggagaatggcgtgaacccgggaggcggatcttgcagtgagccgagattgcgccactgcsttccagcctgggcdacaaagcgagactccgtctcaaaa

SEQ ID NO: 12752 - DNA, 432 bp, Homo sapiens
cctttttagccggggattccagtgaatgaaaacggtagcaggggctcttttgagcttggtcatggggcagccctccgaggtcagcaatgtgcagaaggggtttggagagaaggcttgagcatgtgagggtggcacggccagcctcatcagcagcggactcctttcccagggcagagtggagggcagcaaacaggagaatgagcaacctacctaggtccttgggatgcccctcaggaggacgagctctagggggaatgctgggcggcctgagctgacacccacagcgatcatggccgggaggctcctggtgcagcggctcttcggcgggtcctcagatctgatggactacgacaatgttcccacgaccgtcttcaccccgctggagtatggctgtgtggggctgtccgaggaggaggcagtggctcgccacgg

SEQ ID NO: 12753 - DNA, 187 bp, Homo sapiens
acttactcgattcctgaggcctgggcggcggcgagctccgggctccggcaccgcggggaaaccgggactggggctccgggtgctgctgcggcggccggggccscagtagtgggcgcctctgatggccttccgaaatgagaggtgcccagagagaaaacagtaccaaacaatctcgaaataaatcagg

SEQ ID NO: 12754 - DNA, 224 bp, Homo sapiens
tacagaaatacaatgtttgataaaatttcttgatcacaatatcttttttttattgttaaacttaaaggaactttattagtataaatttatggaggccgggcgtggtggctcacgctgtaatcccagctactcgggaggctgagccaggagaattgcttgaatatgggaggcagagtttgtggtgagctgacatcatgccactgcactccagcctgggtgacaag

SEQ ID NO: 12755 - DNA, 412 bp, Homo sapiens
ctagtcctggctccgctcggagcgcgcagacccggcggcggcgtggcgccgcggagaaatggcttccctgaggcaagtgtaacctacattcccagcccaccagcctgacgcccagccagggagagagtaccatggatggcatcattgaacagaagagcatgctggtgcacagtaaaatcagtgatgctggcaagaggaatggtttaattaacaccagaaacttgatggccgagagcagagatggtctggtgtctgtttacccagcgccccagtaccagagccaccgggtgggggccagctcagtgccggccagcctggacagcagcaggagtgagccgatgcagcagctgctggaccccaacaccctgcagcagtcagtggagtcccgctaccggcccaacatcatcctcta

SEQ ID NO: 12756 - DNA, 343 bp, Homo sapiens
gtttgaatcttggaattaaaaagagggcaggggctgggcgcggtggctcactcctgtaatcccagcactttgggaggccgaggcgggcggatcacaaggtcgggagttcaagaccagcctggccagtgtggcgaaaacccgtatctactgaaaatacaaaaaacaaaattagccaggcgtggtggcacgcgcctgtagtcccagctacttgggagactgaggcagaagaatcgcttgaacctgggaggcggaggttgcagtgagccgggatcgcgccactgcactccagcctgggagacagagcgagactccgtctcaaaaagtaaaaaaaaaaaaaaaaaag

SEQ ID NO: 12757 - DNA, 480 bp, Homo sapiens
actggtctcgaactcttgacctcaggkgatcctcccgcctcggcctcccaaagtactaggattacaggcaccatgcccagtggcatatatatttcttctaataaactcagcttgatgatgaggacgtgtcttagacatctttctgtccatggtgcctagtgcgtggctttcaataaatgtcaaatgaatgagttgatattctgagcagcatttaaaaataagagctagtggctgggcacggtggctcatgcctgtaatcccagcactttgggaggccagggcgggcggatcacgaggtcaggagatgagaccattctgggccagcgtggtgaagccctgtctctactaaaggtgcagaggttggccgggagtggtggtgggtgcctttggtcccagctgctcgggaggctgaggcaggagaatggtatgaacccgggaggcggacttgcagtgggctgagattgcgccactgcactccag

SEQ ID NO: 12758 - DNA, 409 bp, Homo sapiens
attgtattttttagtggagatggggtttcaccgtgttggccgggatgatcttgatctcctgacctcgtggtccgcccgcctcagcctcccaaagtactgggattacaggcgtgasaccgtgcccaaccatttgtcattttttattgtgggtacactagtgggtgttaagtcatatctgcttgtggttttgattttgcattttcttgatggcttgtgatgttaggcttttcttcaagcacttattggatgctcttatatcttcttcacaaaaatgtctatttaaatattttgcctatttttatgtattttttctttttgttgttgagttgtaaaagttatttgtgcattttggatacagatttctaatcaaatatataagttgcaaacattttcaaaaaaaaaaaaaaaa

SEQ ID NO: 12759 - DNA, 365 bp, Homo sapiens
tcaagatggcagtcaccttcattggcaatagcacagccatccaggagctcttcaagcgcatctcggagsagttcactgcsatgttccgccggaagscttcctccactggtasacaggcgagggcatggacgagatggagttcaccgaggctgagagcaacatgarcgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagatttgtgtttgctgcctctatcttgttttttgttttt

SEQ ID NO: 12760 - DNA, 376 bp, Homo sapiens
cacaagattaaatgaaggagatagatattaattacataatttcataaataattgattgattaaaactatggtaagtgctggctgggcacggtggctcacgcccataatcccagcactttgggaggctgaggcgggcggatcacggggtcaggagtttcagaccagcctgaccaacatggtgaaatcccatctctactaaaaatacaaaaattagctgggtgtggtggcatgcgcctgtaatcccagctactcaggaggctgaggcaggagaatcacttgaacctggcggggcagaggttgcagtgagccaagattgtgccactgtcctccagcctgggtgacagtgcgagactccatcccaaaaaaaaaaaaaaaa

SEQ ID NO: 12761 - DNA, 308 bp, Homo sapiens
ttctggatgagtgtagtggctcacgcttgtaattccagcagtttgggaggccaaggtgggagaattgcttgagcctaggagtttgagatcagcctgggcaacataactagatgctgtgtctacaaataataaaaaaattagctgagtgtcgtggcctgtgtatctggtcccacctactcgggaggctgggatgggaggattgcttgagcctaggaggtcaaggcagtagtgtgttgtgataatactaccgtactccagcctgggcaacagagtgagaccccatccctccacaaaaaaaaaaaaaaaaa

SEQ ID NO: 12762 - DNA, 199 bp, Homo sapiens; identical to SEQ ID NO: 12707

SEQ ID NO: 12763 - DNA, 411 bp, Homo sapiens
cataaagaggcaggtggaatgagaaggactctgtctagattggcttttttaacattctcattttcccaggagttatcactgtaaaagtatgcatggatatttatgtatttataaatcatgcactctaagatgagttcatcaacattgtaaaagccctcttttctgttttcaggttttttttttycttatcgacaaggtctsactctgtcgcccaggcagaagcacaaaggtgcagtattggctcattgcagcctcgaactcctgggctcatattttcagggtttttggtttttkgtttkgtttttttgagacagagtcttgcyctgttgcccaggcagtagtgcagtggcgcgatatatttycagtttttaaacgtcagaatttttgtttaaaatgccttttkgggctggg

SEQ ID NO: 12764 - DNA, 192 bp, Homo sapiens
ccccatctctcctaaaaatacaaaaaattagccgggcatggtggtgggcgcctgtagtcccagctactcgggaggctgaggaaggagaatggtgtgaacctgggaggtggagattgcagtgagcagagatcgcgccactgcactccagcctgggcgacagagcaagattctatctcaaaaaaaaaaaaaaaa

SEQ ID NO: 12765 - DNA, 141 bp, Homo sapiens
gyttttctacgtggttcggtastgctggctacgcrgcaggsggccctgmagaggaggctcagatggagtctcattctgtcacccaggstggagtgcagtggtrcgatcccggctcactacaacctscgcctccctggttca

SEQ ID NO: 12766 - DNA, 480 bp, Homo sapiens
taacaaaatcaactgttcaaactttgtggccaatactctccagtcaccaggcaagcctattattctgaggccttcacagcccaattctgctggccagccccgactgggactcatcaccccctgcaccgagagaataggagccaggacgccaagagcaagcagctccacggcctccactatttgaccacacactggacacgggaagaagctagtgatgtggttatgtcaaaacagccagctgagccagctgtgatggcagcccacacctgtaaccccagcactgtgggaggccgtggtgggaggatcagctgagaccaggagtttgagaacagcctaggcaacatagggagatgctcatctatacaaacaatttttgaaaattagctggggccaggcgcggtggctcacacctgtggtcccagcactttgggaggccgaggtgactggatcacctgaggtcaggagttcaagaccgcctgg

SEQ ID NO: 12767 - DNA, 85 bp, Homo sapiens
atttttcatagagacatggtttcaccatgttagccatgatggtctcgatctcctgacctcgtgatccacatgccttggcctccyw

SEQ ID NO: 12768 - DNA, 130 bp, Homo sapiens
tctgattaatattggtgtctgggccgggcgtggtggctcacggctgtaatctgagcactttgggaggctgagacgggcagatcacgaggtcaggagatcgagaccatcctggcaaaaaaaaaaaaaaaaa

SEQ ID NO: 12769 - DNA, 393 bp, Homo sapiens
  misc_feature 155: n=a, g, c or t
tatagattccttattttgtttattgtgaggcagagtctgactctgtcacccaggatggagtacagtgcatagctcactgcagtcttgacctcccaggctaaaccaatcattccacttcaccctcccaagtagctgagaccacaggcacacaacancacaaccagctgaktgttgtactgtttgtatagactggatctcactatgttgcccagactggtcttgaattcctgagctcaagcagtcctcccacctcagcctcccaaagtactgggattacaggcgtgaggtacctcgcccagccccagttacagatttctttgttccttctctctcccactgcttaacttgattagcctttaaaaaagaaataaataaaaatttttaaaaataaaa

SEQ ID NO: 12770 - DNA, 393 bp, Homo sapiens
tatagattccttattttgtttattgtgaggcagagtctgactctgtcacccaggatggagtacagtgcatagctcactgcagtcttgacctcccaggctaaaccaatcattccacttcaccctcccaagtagctgagaccacaggcacacaacaycacaaccagctgattgttgtactgtttgtatagactggatctcactatgttgcccagactggtcttgaattcctgagctcaagcagtcctcccacctcagcctcccaaagtactgggattacaggcgtgaggtacctcgcccagccccagttacagatttctttgttccttctctctcccactgcttaacttgattagcctttaaaaaagaaataaataaaaatttttaaaaataaaa

SEQ ID NO: 12771 - DNA, 389 bp, Homo sapiens
  misc_feature 277: n=a, g, c or t
tagtgaagatttaaaagtgggtagtgttataaagagtaaagtatatttgtagttattgacctgcgaggatacgcgattttgattgagtaaaggaagcaaattggccgggcatggcggctcatgcctgtagtcccagcactttgggaggctgaggcgggcagatcagttgaggttagtttgaggccagcctgaccaacatggcgaaaccccgtctctacaaacaaatgcaaaaattagccgggcaaggtggtgcctgcctgtaataccagctacgcgngaggctgaggcaggagaatcgcttgaacccgggaggtggggctgaagtgagctgcaattgcaccactacactccagcctgggcgacagagcaagattcggtctcaaaaaaac

SEQ ID NO: 12772 - DNA, 227 bp, Homo sapiens
gaaaactacaaaacactgctgaaagaaattatagaaaacacaaacaaaatggaaacacatcacatgctcatgggtgggtagaatcagtattgtgaaaatgaccatactgccaaaagcaatctacaaaatgcaatttccatcaaaataccactgtcattcttcacagaactagaaaaaaaactcccaaaattcatatggaaccaaaaaagggcctgcatagctaaagc

SEQ ID NO: 12773 - DNA, 362 bp, Homo sapiens
gaggccctggaaaacagcattccttctgcgtggaacatgccaaccctcgtctgctttgactttgcaaaactgcatgagaccgccgggcgcggtggctcacgcctgtaatcccagcacttcaagaggccgaggcagacagatcacctgaggtcaggagtttgaggccagcctggccagcatggtgaaaccccgtctctactaaaaatacaaaaaatcagccagtaatcctagctactcgggaggctgaggcaggagaatcgcttgaacccaggaagcagaggttgcagtgagccgaggtcatgccattgcactccagcctgggctacaagagtgaaactccgtctcaaaaaagaaataaaaaa

SEQ ID NO: 12774 - DNA, 100 bp, Homo sapiens
taaataaatttgtatgcttttctcctgttaaaaaaaaaaaaaaaaaaaaaaaaaaaaaaaaaaaaaaaaaaaaaaaaaaaaaaaaaaaaaaaaaaaaaaa

SEQ ID NO: 12775 - DNA, 242 bp, Homo sapiens
ttccttctagatattaattcctttcagtttcatttataattagaagccagtttttttttctactgaatgattattataagatactgttatctaagacatggcagccagatttgaaacttctatgtttggaaagtgtgtgtttgtgggtatttgcccctcacctattctttgctctcccacctctgtacttttcctcacttaaagaaaaagggaaaaacctgacaaacccttttttttttttt

SEQ ID NO: 12776 - DNA, 424 bp, Homo sapiens
  misc_feature 71: n=a, g, c or t
accgtcagcatttcgagtcttcagagcagtaggccgcatcccaccctgtcaggttagctgttccgacatgnschtgaatgtgttgggttgcctgtgtgggaatgggagtcaggtgaagtggggagatgggccaacagctttctttgaaacaaccaagtttcaggccatctctgaaagagtaggaaaatattttagacgttctgtttgatttaatatatatttaarattttatggcattactttatatgtatcctgttatctttataacacaattctgtcatagaacttctgccattgggtatcattaggaaattaccagtcattcaggacagaaatttagcattctggacagtagaactttctacctcatggacttggagtttccgacaggtctaaagagatttagtcctttctttaaaaaaaa

SEQ ID NO: 12777 - DNA, 458 bp, Homo sapiens
  misc_feature 439: n=a, g, c or t
taaataaattagccagggacgctgatgcacatccatactcccagctacttgggaaactgaggcaggaggattgcttgagcccaggaatctgaggctgccatgagctgtaatcactgtgctgcactctagcctgggcaagagggcaagacctcatctcaaaaacaacaacaacaaaagaaagtttaaagctcttgataaagcaattagatttgaggtaaagggactaatataatacatatgaaagaatgaacaattaggctgggcatggtggctcacgcttgtaatcccaacactttggaggctgaggcgggcggattacctgaggtcaagagtttgagaccagcctggccaatgtggtgaaacccatctctactaaaaatacaaawattagccaggcatggtggcacgtgcctgtaatcccagctacttgggaggctgnggcaggagaattgcttgaa

SEQ ID NO: 12778 - DNA, 110 bp, Homo sapiens
aaccggtgtatcatgggagcggcccgggctacacgttaaaaacactaaggggagcgcgcgamgtgaacttggcgctcgatgggggccgttagccgccctagagcgcgcgg

SEQ ID NO: 12779 - DNA, 458 bp, Homo sapiens
tttaccttctgatactagtcaaggtccagaaccagccaccagccaaatttctatctgggtgcgggccactgaaaatccttgttaaaaaccagatcacaaatctggggctcttggtcccattggagaaggaaggaagagcctcaaaataagtgtgcacccatgcacatattcaggaacagcttgtttagtctttacactttgcctgaaagttgcttctcctcgtccctttgtgtgcctgggtggcctcggccctgtgcgttggcaacgcaggatcaaatgtgctgcagcttttgcagaaaacaactcagaaacacaaaaccccccaacagctcaattattattttttcaatgttttcctacaagagccaagtagcaccatgtacagaagacgcctttttttttggaatattgaaatcgttctgcatgtaaaatatgggataatgacctgtttatattaa

SEQ ID NO: 12780 - DNA, 55 bp, Homo sapiens
cttttyygaccgctcccccctccccccgagcgccgctccggctgcaccgcgctcg

SEQ ID NO: 12781 - DNA, 174 bp, Homo sapiens
tacaaaattagccgggcgtggtggcatgcgcctataatctcagctacttgggaggctgaggcaggagaattgcttgaacccaggaggcggaggttgcggtgagttgagatcgtgccattgcactccggcctgggcaacaacagcaaaactccgtcgcaaaaaaaaaaaaaaaaa

SEQ ID NO: 12782 - DNA, 340 bp, Homo sapiens
agttttctatgtagatgttttacttacatttcattaaatttattgttaggccgggcatggtggctcacgcctgtaatcccagcactttgggaagccgaggcaggtggatcatgaggtcgagatcgagaccatcctggctaacaaggtgaaacccgtctctactaaaaatacaaaaaattagccgggcgcggtggcgggcgctgtagtcccagctactcgggaggctgaggcaggagaatggcgtgaacccgggaagcggasttgcagtgagccgagattgcgccactgcagtccgcagtccggcctgggcgacagagcgagactccgtctcaaaaaaaaa

SEQ ID NO: 12783 - DNA, 320 bp, Homo sapiens
  misc_feature 224: n=a, g, c or t
ctatttaatcacaaatgtcagcatctctttagttttggcacatggttttcaccttttatcctctctctctctccatgcttcattatattagttccctaggctatcacaacaaattgacacaaactaaatgacttcaacaacagcaatgcattctaaaacagttctagaggctagaagtcctaaatacagtggggccacactcgctctgaggtccctagagagantccattctgtggatcttccagcttctgggggctgccagcattcctttactcatgcgagcattcctttaccccagcttctgggggctgcaccactcc

SEQ ID NO: 12784 - DNA, 351 bp, Homo sapiens
aggatgctcagttaaatttgaatttcaggtaaacaaatactttttaagtatgttggccgggagcaatggctcacgcctgtaatcccagcacttgggaggccaaggcaggcagatcacttgaagccagggattcaagatcagcctggccaacatggtaaaaccccgtctctacccaaaatacaaaaggtagccagttgtggtggcaaacgcctgtagcctcagctattcggaggccgaggcacaagaatcacttgaacccaggaggtagaggttgcagtgagtcaagatggtgccactgaactctagcctgggcaacagagtgagcctttgtcgcaaaaaaaaaaaaaaaaa

SEQ ID NO: 12785 - DNA, 74 bp, Homo sapiens
ggccgggcgcggtggctcacgcctgtaatcccagctctcagggaggctaagaggcgggaggatagcttgagccc

SEQ ID NO: 12786 - DNA, 458 bp, Homo sapiens
tattctatattcgtttaggtggtccgtaacaatggggaagaaaagatgagcaagttatggcccttgtccttaaggagctcaggatctccccagtgggctgcaggaatggcaaatacccacaaaatagccgccacacaaggcagagagtgatacgtgttctactaagaatagcagtaaaatgctgaggaatcagagatatcaaggttaatgccaggtggaagactggggaaaagtacacagctgaattgactctgagttgcatgtgggaaaatggatgagatttcaaaaggcagagattaaagagttactgctacatggaggcattttcctagaatgtccctcagtataggaggcaggggctttcaaaactctgtattcatcattttctatagacatttttccttgtagtatgtcttgtcactgtatccatagctaaagttttggagatttgtatgctt

SEQ ID NO: 12787 - DNA, 274 bp, Homo sapiens
aatcccagcactttgggagttcgaggtgggtggattgcctaaggtcaggagttcgagaccagcctgaccaacatggtgaaatcccgtctctactaaaaataaaaaaactagccgggcgtggtggtgggtgcctctaatcgcagctactcaggaggctgaggcaggagaatcacttgaacccgggaggcggaggctgcagtgagcagagatcacgccattgcactccagcctgggcaataagagtgaaactccagcccaaaaaaaaaaaaaaaaa

SEQ ID NO: 12788 - DNA, 405 bp, Homo sapiens
ttcttgagacagagtctcactgtgtcctccaggctagagtgcaggctcaacctccaggctcaagagagctgccacctcagcctcctgtgtagctgggacaacaggcatgcgccaccacgcttggctaatttttgtgttttttgtagagatcggtttttgccatgttgctggttttgaactggcctcaagaaatccacccacctcggcctcccagagtgctgagattacaggcacgagccaccctgcttagcctaatatgaaaagtatttttgttattttaattttatcaaattgattttctttttatagttatttttattacacaaatatgttaagtacaaagtccttttgaaagattcaaacaggccagacatggtggctcgcgcctgtaatcccagcactctg

SEQ ID NO: 12789 - DNA, 118 bp, Homo sapiens
attccgtcccgccccgccgccggtgcagtgttggaagctccggttctcccggaagtggcccaggtctctctgtcggggtcccctccatctcgctgctgctgaaggccgcgagggcggc

SEQ ID NO: 12790 - DNA, 473 bp, Homo sapiens
aaaggtagaaacagctgatcacaatggttcactcctgtaatcccaacactttgggaggtcgaagtgggaggattgcttgagcacaggagttcaagaccagcctggacaacatagtgagacatggtctctgcaaaaaaatagaaaaatcagcagggtgtggtggcatgcacgtatactcccagctactcaggaagttgagtgagaggattgcctgagcccaggagtacaagactgctgtgagctatgatcatgccactatactccagcctgcgcaacagagagaccctgtctggaggggtggggggagaaaaaaacaccatagaaacaacccaaatgtccaataacaaattgtagtccatccatacaatggactactactcagccatgaaaaggaatacagcactcacatatgctgcatgtgaatgaaccctggaagcattatgctcagtgtaagaacccagacataaaaggtc

SEQ ID NO: 12791 - DNA, 185 bp, Homo sapiens
aasaattagagatactttatttatttatttatttatttgagatggagtcttgctatgtcacccaggctggagtgcagtggsacagtctcagctcactgcagcctmtgactccggggttcaggcgattctcctgcctcagsctcccgagtarctgggattacaggsgcccgtcascacgcccggct

SEQ ID NO: 12792 - DNA, 369 bp, Homo sapiens
cattaaacattctccaggatagaccaaatgttaagccacaaaataagtctcaagtttcaaaagactgaaatcatacaatgtatgttttacaacaatagaatgaaactagaataaacagagaagagaatttaggaaatacatatatgtggaaattaatgcgctccgaaataaccaatggatcaaagaagaaatcacaagggaaattagaaaatattttgagatgatgaaaacaaaaacaaatcatatcaaaatttataggatatgcctaaagcagtgctttattaaaaaagatctcaaatcaatagcttaaacttcaccttaaaaaagtagaaaaagagcaaacaaaaaccaaagccaatagagggaaaa

SEQ ID NO: 12793 - DNA, 152 bp, Homo sapiens
ttcccacacacctgtaatcccagctacttggggggctgaggcaggagaatcacttgaacctgggaggcggagattgcgagcagagatcacaccactgcactccagcctgggtgacagagcaagaccccatcttaaaaaaaaaaaaaaaaaag

SEQ ID NO: 12794 - DNA, 335 bp, Homo sapiens
aatttgcattttaaaaattactagtgtttttttggccaggcatggtggctcatgcctgtaaccccagcactttgggaggccgaggcgggtggatcacttgaggccatgatttcgagaccagcttgggcaacatggtaaaaccctgtctctactaaagtaaattacaagaattagccggatgtagtggtgcatgcctgtgatcccagctgctcgggaggctgaggcacaagaatcacttgacccagggaggcggaggctgcagtaagccaagatcacaccactgcatgccagcttaggcaacagagtaagactctgtctcaaaaaaaaaaaaaaaa

SEQ ID NO: 12795 - DNA, 236 bp, Homo sapiens
agcactctgcgcgcccgctcttctgctgctgtttgtctacttcctcctgcttccccgccgccgccgccgccatcatgagggaaatcgtgcacttgcaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgwgccc

SEQ ID NO: 12796 - DNA, 479 bp, Homo sapiens
caattagcaatactatttcaaaaaataaactgatgttaatttataaaagagatttaaattaagaggtaagaaggtagcaggtcagtaaagcaagtcagtcagtaaagtatttattagaaaagttatttatttatttttaacttgatgcggatggtattaagaatggaaatatgaaagagaaattcaaaaatgaaatctgggccaggcacggtggctcacgcctgtaatcccaacactttgggtggccaagacgggcggatcacctgaggtcaggagtttgagacaagcctggccaacatggtgaaaccccatctctactaaaaatataaaaatttgacagccatagtggcgcgtatctatgatcccagctacttgggaggctgaggcaggagaatagcttgaacccgggaggcagagtttgcagtgagctgagatcacaccattgcactccagccttgacaacagagtgcgacgccatc

SEQ ID NO: 12797 - DNA, 288 bp, Homo sapiens
taatgaaatagagactgggaaaaccagtgaaaccaaaagctggttctttggaaagatcaacaaaattgacaaacctttagctaaacatatcagggtaaaaagagaaaacattcaaattactggaattacaaatgtgctgggtgtggtggcacacacctgtaatcccaacacctgggtgtggtggctcacacctgtaatcccaaggtgggaggatcacttgaggctgggagtctgagaccagactgggcaatatgacaagacctcatctatacaaaaaaaaaaaaaaaa

SEQ ID NO: 12798 - DNA, 392 bp, Homo sapiens
tcattgatagtatatgttcataaatgttatatagttgtaaaatagtctgttgggtttgtgatctgtagtttgtgaagtgaaggttcttaactccttgtgggagggaggcacaggcctctggaaatagaatcaaagctgtgaatgctcttcccacaatgtgatcctccccattttgcattcagtttaaggatccctggaccctgaaacccatttttgccccaatgggccttggttttgttttaattttgtaaaagccatttgctaaaagctgactttatccaggggtgattttacaggacgaaatgggctgttttcagtgcctcattcagtgcattctggcagacctgtgttagcactgtgccagatgtcatgttgaaatgagtatagatgca

SEQ ID NO: 12799 - DNA, 253 bp, Homo sapiens
gttaccatttattaaaggtaaactacacctgttgaaggccaagttcagggcagctgttgtgatctgtgtagttaatgtatttattaatgcttgacttttaaaatcctgggcataaatattgcagagcctcgtatgtttgtcagttcatgccgagatgaaataaatcacgcagaaagtgccagtccaaaaaaaaaaaaaaaaaaaaaaaaaaaaaaaaaaaaaaaaaaaaaaaaaaaaaaaaaaaaaaaaaaaa

SEQ ID NO: 12800 - DNA, 445 bp, Homo sapiens
actttatcatctgcctctcttacttccttttctccttcttgctttcattccaacagacattccttaaatactttctttgtgctaagaactctgtcctttcatatttctttttttttttaataggaaatacttctgaaactgtcctttctagtcttcctcgtgtctatctgggagcagggagttgccggggggaggcccccacagactgaaggacgcagtcagggacaggcagagtgaacattaggagccattaggacgggcccagccctggggcatggatgcccagctgcagcatcagtgggagcctgacctggggcttgagatgactggccccgtgcgaacttcagggcttctatgaggaggtggccaacccactgctgacgggtgtggaratggagtaccccgagaacgctatcctggacctcacccagaacacttaccagca

SEQ ID NO: 12801 - DNA, 339 bp, Homo sapiens
aaatcaggctaggcttatgcaatgaaatacccagcagagcgtccagcttcttcgtttagttgcatgcaatttattaaacaaaggagctccactgcctaaggctattggattacactggcagtttattgccatcaggcatgaagcacatttattatcaagatcagccgtcacagacacagttgcaaaagggagaggcaaatgaggacagctctttgggggagaaaccgctcttgggtttgctgcttacctgagttttgagccgccactcgggatttcctggggctcacagagtcattctgctccgcctcatgggttgcagaagcactgatcaccagcacc

SEQ ID NO: 12802 - DNA, 438 bp, Homo sapiens
tatctcaatcctgtccactcttccccacttcctccatctctcttccagtcggggccactgccacctcgccccaggcctatgcagtatagctccttgagactcccctccccacacagcagagatcagtcatggcaccctctgccccaagtacccagaatgcagtttcccaccacagtcctctgtgatgctcagctcttcccattccttgactatgtaatgctcactcctacctgaggcctttatgccacctgctccccacacctggaatatcctcccccggtttctgcatggctgacttcatcttgtcattcaggtctcggctacttgaagaggcggatgtcctaaccacccaatctgacatagatacccagtcaccttcaagcatgtcatctgcttttaattctgtgtagcatttattaattgagggttttttactga

SEQ ID NO: 12803 - DNA, 451 bp, Homo sapiens
tttctttagaaggcaggccctttgaaggtttgcatgaaactccctttctcaaaggaggcggaagagcaataccacataaacgctcaccgctgacctgghgaattggccacttccctttttcttccctgccgctgccccaggctggctgacacgggttagaagatgaagcaagatcaagggctggctgtcaccgacagtctgtgctcttgctggataatgatacaaaggaaaccctgtggcttgggagggttctagcacagacggcaacagcgccggacattcggggaacaacatcctcggttccgaagtggccttatttgcagggattgcttcaggatgcatcatcttcatcgtcatcatcatcacgctggtggtmctcttgctgaagtaccggagagacacaggaagcactcgccgcagcacacgaccacgctgtcgctcagcacactgg

SEQ ID NO: 12804 - DNA, 263 bp, Homo sapiens; identical to SEQ ID NO: 12632

SEQ ID NO: 12805 - DNA, 140 bp, Homo sapiens
cattgtattgttttgtaataatatttttaaaattctggstgcstgttacgtatggtagtctttatgacttctgtgtcataaagctttcgtaaaatttagsatctgtgraaatgtgatgaggcagcattattttagatggt

SEQ ID NO: 12806 - DNA, 185 bp, Homo sapiens
agcctgaccaacatgttgaaaccccgtctctactaaaaatacaaaaattagccgggcatggtgtcacgtgcctgtaatcccagttactcaggaggctgaggcaggagaatcgcttgaatccaggaggcagaggttgcagtgagctgagattgcgccactgcactccggcctggggtgacagagcg

SEQ ID NO: 12807 - DNA, 442 bp, Homo sapiens
gggttacctgcggaccagaaattgagatgcagagatatttgctctttcttctccaggagtccttaggagtagttgaaaagaggaacagaagaaagtccacttctctgctcaaacctttactggaactattaaaatcgctggccgattttgtcttttgaagatcctgaagggtttagaaattctaaattgagtagacatagattaaaaatgctggtgtgaagaaactgataatagttacctcccaggagaggaatgtgtttctggaaaacacgtcgtggtaggaagaccatttaccgtacgcctttgtgtacttttttgtttttgtcctttgaggcagggtcttgctctgtcgcctaggctggagtgtgcagttgcgcgatcttggctcactgcaagcctccacctctcgggctcaggcgatcctcccgtcacagcctcccaa

SEQ ID NO: 12808 - DNA, 338 bp, Homo sapiens
  misc_feature 241: n=a, g, c or t
aaaaaacctaaacgtctcttctggatctccagaaaaaaagtgctgctctaggccgggcgcagtggctcacgcctgtaatcctagcactttggcaggccgaggcgggcggatcatctgaggtgaggacttcgagaccagcctagccaaaatggtcaaagcccgcctctactaaaaatacaaaaattagccgagcgtggtggcacgtgcctgtagtcccagctgcatgggaggctgaggccgnagaatcacttgaaccctggaggcagaggttgcagcgagccaagaccgtgccactgcacttcagcccaggtgacagagggagacgccctctcacaaaa

SEQ ID NO: 12809 - DNA, 236 bp, Homo sapiens
aacactctgcgcgcccgctcttctgctgctgtttgtctacttcctcctgcttccccgccgccgccgscgscatcatgaaggraaatcgtgcacttccaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgaggs

SEQ ID NO: 12810 - DNA, 455 bp, Homo sapiens
  misc_feature 388: n=a, g, c or t
aaaggcaaaacatgtatatacaaaccatgaatttggataaatatagtatatgcatasaagaaaacagtattcagtcttaaaaattaaaattctgatacacagwtctatgtaaaattctgatacawagsstacaaaacatggatgaactctgaagacattatgctaagtgaaattagccagtcatgaaaagacaaaatactctatggttccacatwtatggggtactagaatagtcaaattcatagagacagtggttcccagggactgtggagagaaggaaatagtagctattgtttaatggatagagtttcggtatgaawgatggagaagttctggagagggatagtggtgatgacggcammtgtgtgaatctacttaatgccactanactgtaccacttaaaaatgttttaaatggtacacttgatgttatgcatattttaccttttttttttt

SEQ ID NO: 12811 - DNA, 97 bp, Homo sapiens
  misc_feature 13: n=a, g, c or t
tttggggggcgangtgggcggatsacggggtcaggagattgaccatcccggctggcacggtgagaccccatctctactaaaaatacaaaaaagttgg

SEQ ID NO: 12812 - DNA, 180 bp, Homo sapiens
atgcccatctagcttgcagtctcttcgcgctttcgctgtctctcttattatgactgtgtttatctgaaacttgaagacaagtctgttaaaatggttcctgagccgtctgtaccactgccccggsccctcgtccgccgggttctaaataaagaggccgaaaaatgctaaaaaaaaaaaaaa

SEQ ID NO: 12813 - DNA, 308 bp, Homo sapiens
  misc_feature 254: n=a, g, c or t
tgtcttaaaaatagggaaatgtggctgggcgcagtgcctctgcccgtaatttgggaggccaaggcgggcggatcgctgaggtcgggagcttgagaccagcctgaccagcatggggaaaccccgtctctactaaaaatacaaaattaactgggcgtggtggtgcgtgcctgtggtcccagctacttgggaggctgaggcaggagaatcacttgaacccaggaggcagaggttgcggtgagccaatatcacgccanttgcactccagcctgggcagcaaaagtgaaacactcaaaaaaaaaaaaaaaaag

SEQ ID NO: 12814 - DNA, 226 bp, Homo sapiens
caagggatcgagactatcttggccaacatggtgaaacccatctctacaaaaaatacaaaaattagctggtcgtggtggcacatgcctgtagtcccagctactcgggaggctgaggcaggagaatcgcttgagcccgggagacagaggttgcagtaagccgagaccacaccactgcactccagcatggcgacagagcaagactccatctcaaaaaaaaaaaaaaaaa

SEQ ID NO: 12815 - DNA, 345 bp, Homo sapiens
tcatttattaatagatggttcataagcacagagatggaatttttaaattgccggggactgtggtgagcttttatttccttctgatgttggagtgcctatgtactacagcacaatacaagttgtcataatgcctacaactacatagacacagaaacatggactgggcaaaagaagtggtaataggcattgaaaatttatgttttaaacacctatgggaactattttaactaaaacactagtataagcaactcaaaggaattgctgcacagatgtgcatcagatggctcaaattaaagaaccatcaaccttttcattgtatctctcccacaaaaaaaaaaaaaaaaa

SEQ ID NO: 12816 - DNA, 500 bp, Homo sapiens
cataagatgaagattttttggatggaaactaattagttgtttctttgggsatcagattatttcccmaatttttatttatttgaaaactgttacaacaaaaacgcaatctgttttagggttaaaaaaatcctctttaactctatcacccttsaattattassttttatbtttttgttcctttggagtctgttgatataaaattcatatttstacastgttataataaataatggcaaaactcagtttttatcactgtttgttctaaaaataaaatagcaaccctgtacccagcatactttacaggttytttaaagttctcacagtttatgaagaagatgccgccatcccaatttcacagatgagaaaactgaggcatgcagacattatgcaactcttttcaaatcacacagttgttaccttgtggggccagcatgagcctgggaggattgcaaggctcgggcstcccctctgctctgtgtctctcacggtggctgaggtag

SEQ ID NO: 12817 - DNA, 115 bp, Homo sapiens
ccgtttttgctgggtaggcgacccggacggagggccggcgaggtgcggggtctggtgatgcgagctgcgcctctcggcaagatttcgcgctgcccatcscgggccctttcatcat

SEQ ID NO: 12818 - DNA, 122 bp, Homo sapiens
tcttaatctccacgttataaggtggaaactgaggcttgaagaggctcacttggccaggcatggtggctcatgcatgtaatcctcttgctttgggaggctgaggtgggcggatcacttgagcc

SEQ ID NO: 12819 - DNA, 67 bp, Homo sapiens
cttttgacaggtctctctcccggcgagggccgtggtcttcaggaaaggcccgagcccctttcccagc

SEQ ID NO: 12820 - DNA, 435 bp, Homo sapiens
acgtatatgtagtttaaaaaataaaaatgagatatcacccagatctctagccccagctcaagaaatgaaacattaatagtgctgtagagatcctttgtgtaccttctttctaccctacctcacagtccccttattacccataggtaaacactagggtgaactttgtgttaatctttctcatctttcattatagtgttaccactatgaatgtgttctttaattatgtaaatgaatccattattcaggcttctgtgatttaattatttcagttaagattgtttgagatttatccacattaacatgtagttttatagtttctgggaaaatatttaarattttcaaacatacagaattttgctagttatattttcgttatttgatttctaactttattgtgttgtagtcagggaatgtggtgtttgaaatttatgtagg

SEQ ID NO: 12821 - DNA, 472 bp, Homo sapiens
cattacagagcaaattgaccatgcctgcaggaagatttaatacagcagagcagcaagacttttatgcctaaaaattctaaagttattattaaaaagatgtgtatttaatttagctcatgtctttaagacaaagccatctagtggatatttaataaatacttgaaggaaggaaataaaataccaataccaatattacagatgtctgtaaatcccaaataattgaaatcttgcaggtcaaaggaatagtgattgcttctaagaaagaggcaagttcaaagaagttctcttgctaattaagagaactaacttactccaggcaaaccaaggaagacgatggaaaggaggaaaactatacaaatattttcagggtgtggatatgggtgtttcagaaatcaaatggggaaagaaaacaaaaggagaacagaaagagttacgatatcagcaatgggaaatggaagagacaaattcctga

SEQ ID NO: 12822 - DNA, 169 bp, Homo sapiens
agtgaggcctagtggaaagccatggagagcgctctccccgccgccggcttcctgtactgggtcggcgcgggcacgtggcctacctagccctgcgtatttcgtactcgctcttcacggccctccgggtctggggagtggggaatgaggcgggggtcggcccggggctcgg

SEQ ID NO: 12823 - DNA, 530 bp, Homo sapiens
  misc_feature 170: n=a, g, c or t
atttatttatttattttgaggcggggttttgttcttgttgcccaggctggagtgcaatggcgcgatctcagctcactgcaacctcctcctcccgagttcaagcgattctcctgcctcatcctcccaagtagctgggattacaggtgcgcaccaccacacccggctaattnttgsatttttagtagagacggggtttcactatgttggccagaggtcttgaactcctgacctcagatgatctgcccgcctcagcctcacaaagtgttgggattacaggcatgagccaccgcgcccagckaggawcctcccaatttaaaagatkagagagaagggtgataactatcagtctctcattccaagagtccctgggggtaaagatcagtggcttttattaactcaggggtaatctttgccatttatagtcacctggagcaattgtattttccacattcttttatagtaacattttgtgcttgtttttttttaatttggagccttttgaatacattgaattttacttctacattcat

SEQ ID NO: 12824 - DNA, 101 bp, Homo sapiens
aaaaatacaaaaaattagccgggcatggtggcgggtgcctgtagtcccagctacttgggaggctgaggcaggagaatggcgtgaacctaggaggcggastt

SEQ ID NO: 12825 - DNA, 154 bp, Homo sapiens
agttgggagtttccctagcgactcagttcgggtgggcgttgggcgctgagtcagccaaacagcctactcggggttcttgggtagcctttggggtgaggggacttgggcggccttggtctgtaagctctgcgttcccgggcgtggaagagactgg

SEQ ID NO: 12826 - DNA, 373 bp, Homo sapiens
aaaccattattagaaacatgccaggttggttgtcttggtatcgtttagtaagaaacaaagattgaaaatgagtcctggtgggccgggcacgtggctcacgcctgtaatcccagcactttgggaggccgaagcgggtggatcacaaggtcaggagattaagaccatcctggctaacatggtgaaacccgtctctactaaaatacaaaaaaactagctgggcgtggtggtgcacactgtagtcccagctacttgagaggctgaggcaggggaatcgcttgaacccgggagttggaggttgcagtgagccaagatcatcccgctgcactccagcctggtgacagcgagactctcttaaaaaaaaaaraaaaaaags

SEQ ID NO: 12827 - DNA, 147 bp, Homo sapiens
tactaaggacgccgtcgargtccggggcgcctcaactctatagctctaactggctagaagtgcccaacgtggaatgtttcttttttaaaggcggctcttgaagcgacccggaagcggaagtggaagaaagttctagtggcttgagat

SEQ ID NO: 12828 - DNA, 505 bp, Homo sapiens
tttccagaaagtgaaaggatcttctctctctaaactcacccacattctcagtttagtttaggaaccaatactacagagtatattggtttacaaagtaaattagaaagtatagccatatatttctgccattgtttaggcagatatgtttttgctactctgacttggcttctgtcctttcccttgtttcactgccactggaagggttgttgctggctaaggaaatattgagccttgagacaaaaaattttgcaacaaaagaaatttacctaaactagcttgcttcaagaaaaactgattcatggtgtttaatgtgtaatctgtatacccaggcatgaagtttcactcattctagccctgattatgtcttaaagagtttaaagccagccaggcacggtggctcctgcctgtaatcccagcactttgggaggccgaggcaggcagatcacaaggtcaggagttcgagacctgcctggccaatatggtgaacccgtctctactagaggtg

SEQ ID NO: 12829 - DNA, 116 bp, Homo sapiens
atttttattgatgtttaataccttctgaaacaggagggtaagatcagatgggaagcccctctgttgaaggatcttgggaaccttggtggttttttttttttttggttttttttttt

SEQ ID NO: 12830 - DNA, 111 bp, Homo sapiens
tacaaaattagccgggcgtggtggcatgcgcctataatctcagctacttgggaggctgaggcaggagaattgcttgaacccaggaggcggaggttgcggtgagttgagatc

SEQ ID NO: 12831 - DNA, 398 bp, Homo sapiens
tagtgaagatttaaaagtgggtagtgttataaagagtaaagtatatttgtagttattgacctgcgaggatacgcgattttgattgagtaaaggaagcaaattggccgggcatggcggctcatgcctgtagtcccagcactttgggaggctgaggcgggcagatcagttgaggttagtttgaggccagcctgaccaacatggcgaaaccccgtctctacaaacaaatgcaaaaattagccgggcaaggtggtgcctgcctgtaataccagctacgcgggaggctgaggcaggagaatcgcttgaacccgggaggtggggctgaagtgagctgcaattgcaccactacactccagcctgggcgacagagcaagattcggtctcaaaaaaacaaaacaaaa

SEQ ID NO: 12832 - DNA, 475 bp, Homo sapiens
caaatatggcaaacaaaataatctgttggtttttttctatattaaatatatattcaaaagtaagacactttaaattcttttaagaaatgaaagccaggcacagttgctcacacctgtaatcccgcactttgggaggctgagacgggcggattgcttgagctcaggagtttaagaccagcctgcacaacatagcaaaaccccatctctataaaaaaaaaatacggaaaaattagccaggtgtggtgacacatacctgtggtctcagctactcgggagactgggttaggaatgagcctgggaagttgagattgcaccactgtacttcagcstggtacttctgaactgtacttttgacctgtctgaaagaacatatcttaaaattgatcatagaaaatagaaacttataaggtgagtagatcattatgtattttaatgacttaatatattctcatctaatgtttattttgaaacaggc

SEQ ID NO: 12833 - DNA, 227 bp, Homo sapiens
cattttagggttattctgttacttagggtttttgttttctgttttttttttctctttttttgkattaccgtgctagttctcttctacacctactctgtctctcaagccattttgccactcgcttccctgccatctggcccttccctttgtctcagtgggatagatggattgtgaaatggaatctcccagaacccctgccctggcagcctggaagaccgtgcctgccc

SEQ ID NO: 12834 - DNA, 429 bp, Homo sapiens
aaatgaaggagaaatacataggtaaaaaattaaaactgggaaaaaaaagtttggcagaaaagatctaatatagatatataataggatcttcccaccccgcccccagaaagaaaaccaaaataaaggaatagcttaaatactgacaagtggccgggtacgtggctcacacctgtaatcccagcagtttgggaggccgaggggggcagatcacgaggtcaggagatcgagaccatcctgactaacatgttgaaaccctgtctctactaaaaatacaaaaaattagccaggcatggtggcgggcgcctgtagtcctagctactcgggaggctgtgaggcaggagaatggcgtgaacccgggaggtggagcttgcagtgagctgagatcgcgccactgcactccagcctggggacagagtgagactccgtccc

SEQ ID NO: 12835 - DNA, 552 bp, Homo sapiens
tacacaactactaactagctcggcctggtaccacggatttgtgctacggcaccaggagagcaaaatcaacacagaaaaaagcaagaaaactcagagaaaaaataaaacaaatctacaatgaacacatcagtatgtatatttctacaaacttgtgtgagaagttctgtaagatcaagtcctaaaagcagaattgctggctcaaaggatatgagtaacatcagctgactcgaagttaagaagaytggcctccacaatcagggtgggcctcatccaatcagtaaaaggccctaagtgcaaaactaaggcttccctgaagaagaaatgtccacctaacagacagcctccctgtggatttcagacttgcctagccagccccagcaattatgtaaaccagttccttgcaaaaaaaatctctttatatgtatataaacctgttgaaaattttatatagcatatatatatgtataatacatacatgtgtatacatgcatacatatgtgtctgtatatttatacacatacataatctccatttggttctctttctcgggta

SEQ ID NO: 12836 - DNA, 358 bp, Homo sapiens
agaacagcctaggtaactttgcaagactccatctctgctaactttttttttttttaaactgggctgggtgtggtggctcamactgtaatcccagcactttgggaggstgaggcaggcggatsatgaggtaaggagattgagacsatcctggctaacacaatgaaaccccatcgctactaaaaatacaaaaaaatagccaggcgtagtggsaggcgcstgtagtccsagstastcagtaggstgaggcaggagaatagcatgaacccaggaggcggasttgsagtgagctgagattacgccastgcactcmagcstggatgacagagtgagactccgtctaaaaaaaaaaaaaaaaagg

SEQ ID NO: 12837 - DNA, 363 bp, Homo sapiens
tatacgtgtagatagaaatacagatacagcatacaaacatactatatgtatttagaaaacacatatgtttacatatgtaattaagaaaaaataggccgggtgcggtggctcatgcctgtaatcccagcactttgggaggccaaggtgggcggatcacctgagatcgggagttcaaaacccgcctggccaacatggtgaaacctgtctctactaaaaaatacagtaattagctgggcgtggtggtgcatgtctgtaatcccagctactccggagctgaggcaggagaatcacttgaacctgggaggtggaggttgcagtaagccaagattgcgccattgcactccagcctgggcaacaagagcg

SEQ ID NO: 12838 - DNA, 421 bp, Homo sapiens
tagactctgtttctttgcatatgcctatttattaacaaaggaatgtaaatgtacttattgctgtccttttgataaaatttgctgtggatgtatggctaatcccacagaatcaaggatccttatctggccagatgcaccaattttgacctctgtcctagtttttaacttaagctgatataccaacagggcagcaaatatataagcagttgcaagaactgcactgcaatggtttattgaatctcaataaatgatactttcttttaagaaaaccctctttattcgcttcatcacttgaagtgctttttaaaaatacttggatttggcaggctttttctgatactgaggtgctcacagtaaactgaatgtggttaaacagcttggaacactggagttgaatagtttctgggcacatgtgccaaaa

SEQ ID NO: 12839 - DNA, 267 bp, Homo sapiens
  misc_feature 19,258: n=a, g, c or t
caccgcgcctggcccccknactgtatttaaagttgagggatgtgatcttgccctggctccttcaggatacttatttgcggtcccacctggtttttccccgcaagaatctgctctgaaaggtcacttctctacctctgtgctcctaggactttacctatgaacttgttgaaagttcattttaagtataatatttaccaattgtttttgtaaaaaagttatttaaattttaaggaaatttgaacgtcctttttctcaaanaaaaaaaar

SEQ ID NO: 12840 - DNA, 454 bp, Homo sapiens
ttccctagggcattgctctcctattcccacgccttaacacagctctatacctagaagcagccagcccaggcatgcagtcacatttaatcacatcccccttswagagtgcttcaaaatgatgtagtccctcaacttggctaaagaatctcaatctcttgaaatttatttttttaatgtcatattcatctggtaaatatctactgtttgccaggcatttaagaatatggcaaagaacataaaagatggtgtcaccagattttggtcaccaatgagtacccgacccgttgccatgattaagagagaatgctttctattggagtttcaggaaatataatttgagaatactttaaagggaagtggaagtataagtgaatgatatttttcttttacatgtaaacaatgaagttatttcaaagttaagttttaaacaaaatacatgaagtagtgtctgcca

SEQ ID NO: 12841 - DNA, 316 bp, Homo sapiens
ctttaaaaagagctttcatggccaggcgcggtggctcacgcttgtaatcccagcactttgggaggccgaggcgggcggatcacaaggtcaggagatcaagaccatcctggctaacacggtgaaaccccgtctctactaaaaatacaaaaaaattggctgggcgtggtggcgggcgcctgtagtcctagctactcaggaggaggcaggagaatggcgtgaacctgggaggtggagcttgcagtgagcsgagatcgtgcsactccccttcagctagggckracagagggagactctgtctcaaaaaaaaaaaaaaaaa

SEQ ID NO: 12842 - DNA, 434 bp, Homo sapiens
ttcttgagacagagtctcactgtgtcctccaggctagagtgcaggctcaacctccaggctcaagagagcctgccacctcagcctcctgtgtagctgggacaacaggcatgcgccaccacgcttggctaatttttgtgttttttgtagagatcggtttttgccatgttgctggttttgaactggcctcaagaaatccacccacctcggcctcccagagtgctgagattacaggcacgagccaccctgcttagcctaatatgaaaagtatttttgttattttaattttatcaaattgattttctttttatagttatttttattacacaaatatgttaagtacaaagtccttttgaaagattcaaacaggccagacatggtggctcgcgcctgtaatcccagcactctgggaggcccgcggcgagcagatcgcttga

SEQ ID NO: 12843 - DNA, 515 bp, Homo sapiens
tttaagtgttgggtggaattcaccagtgaggacatcaggaccagggcttttctttgttgggatattttctttttttttagacgaagtttcgctcttgttacccaggctggagtgcaatggcgtgatcttggctcaccgcaacctccgcctctcaggtttaagtgattctcctgcctcagcctcccgagtagctgggattacaggcatgcaccaccatgccagctaattttttatttttggtagacacagggtttctccatgtctctactaaaggtcagggtggtcttgaactcccgacctcagctgatccacctgcctcggctgccaaagtgctgggattacaggcatgagccaccgcgcccagcctggtattcgttaatttaagtgttgggtggaattcaccagtgtggccatcaggaccagggcttttctttgttggggatattttttttttagacagagtctcgctctgtcacctcggctggagtgcagtggcatgatctcggctcacggca

SEQ ID NO: 12844 - DNA, 500 bp, Homo sapiens
caatgcaggaaagccatactgaatcagaaagtggtcttgctgaattagacagctctaatgaagatgcagggacaaagatgagtggtgaaaaaatatgactttcctttttggtaatatttttgtgatctttgatggtttttaacctaggaagtgtaatgtatgcatttatataactgttttgttatttgaatcttggaaaactagttttattatattcagatagccttgttttttaaaaaggcctttgcatacacctttatgagatagtgtaaaattgactatttatagtactatggatttaatgaaattatatgtcatttcacattgtatgccagaaattaggctaccaattatgaattaaagtcagtagttaaattaatactagatagaattagaaattttgattagagagattatgctatattatggaaaaacttgttaatgtagaattatactgcttcatattattttacctattagtacactcatagttagctttg

SEQ ID NO: 12845 - DNA, 327 bp, Homo sapiens
csttaaagtgcctctgaggccaaagcctttgtggcaattgtsaaatgagtcsatatgcagtgagtamcgtgttgagggaggacaaggtcaccaagagctgagaatgtttctccgactgatgagacctagatattgggtasatggaggtccccggtccctttgtgattcctgcagcctgttgcctccttgcctggaccccgcctcagctcagaaagccaattccctagattccaaaggcsttcccagaccaattagcatgtsstgsagstgtsagstccctgtgcctagcstggacctcagctcatgtctagcacccagtctcccaac

SEQ ID NO: 12846 - DNA, 442 bp, Homo sapiens
cattagtggcaggtttattttctgtaattttgccgaagttttctgaaacagttgtttaaagccaataataatcctcttttagaaggcaaaaatgaataagtacagtagtgtaaataccataaatgaatgttctacgtttacaatgttctgatactgtgaaaaggttgtttatagcaaatctgtttccagctaggtgggcttaaaaacagactaaaccattatattatgaagatatttggtacttcttcacagtgaagtatgtataccttgttgaataaaatcatacattaaaattttggacaaataggctgggcacggtggctcatgcctgtaatcctagcactttgggaggtcgaagcggatagatcactgttggccaggctggctggaactcctgacctcaggtgatcacaccattgcactccagcctgggtgacagagc

SEQ ID NO: 12847 - DNA, 285 bp, Homo sapiens
aaaaaatctagaggcagttgagcatgggagccgtctgtatgttgaattagggctcgcactcttgcgcaacacgtcaccagtcggaaactgggggtttgcttctgtgatttatttcattattgtgctggtaaaagctgatgaagagactagcagctcgctgctttgctggcttgttaattttatccccactaactgtgatttctgatagccggcctgctgatagtggtaaggccatcgaagacggcaatttggaggaaatggaagaggaagtacggcttaagaagc

SEQ ID NO: 12848 - DNA, 451 bp, Homo sapiens
aaaggtagaaacagctgatcacaatggttcactcctgtaatcccaacactttgggaggtcgaagtgggaggattgcttgagcacaggagttcaagaccagcctggacaacatagtgagacatggtctctgcaaaaaaatagaaaaatcagcagggtgtggtggcatgcacgtatactcccagctactcaggaagttgagtgagaggattgcctgagcccaggagtacaagactgctgtgagctatgatcatgccactatactccagcctgcgcaacagagagaccctgtctggaggggtggggggagaaaaaaacaccatagaaacaacccaaatgtccaataacaaattgtagtccatccatacaatggactactactcagccatgaaaaggaatacagcactcacatatgctgcatgtgaatgaaccctggaagcattatgctcagtgt

SEQ ID NO: 12849 - DNA, 441 bp, Homo sapiens
ccccaggctggagtgcagtggtgctatctcggctcactgcaagctctgcctcccgggttcatgccattctcctgcctcagcctcctgagtagctgagattacaggcgccasaccatgcctggctaatttttgtatttttagcagagatggggttttaccatgttgtccgtggctggtctcgaactcctgacctcaaatcatctgcctgcctcagcctccccaagtgctgggattacagacgtgagccaccgcacctggcctatccaccctcttcttcctttactggtttctgatgagaagtgggctgtaattcttatctttacccctctatagataaggtgtttccctaccccgctggtcatttgccttagtcattttctctgtctttggttttctgtagttcaaatatggtgtgcctaggtgtagggtattttgcttttt

SEQ ID NO: 12850 - DNA, 415 bp, Homo sapiens
agtttggaggtttctcaaagaacacagaactatcattcaatccagcaatcttgttactaggtgtatatccaaaggaaawgaaattgttataacaaaaagacacatgcactcatatattcattgcagtactatttgctatagcaaagagatgaagtcaacctaggtgcgcatcagtggtggatttggtaaagaaaatggtacatatacaccatggaataatgtacagccataaaagagaccaaaacaggccgggcacagtggctcacatctgtaatttcagcactttgggaggctgaggcaggtggatcacctgaggtcaggagttcaagacaagcctggccaacatggcaaaagccccgtctctactaagaatacaaraaacattagctgggcatggtggtgcgcacctgtactc

SEQ ID NO: 12851 - DNA, 497 bp, Homo sapiens
agtttggaggtttctcaaagaacacagaactatcattcaatccagcaatcttgttactaggtgtatatccaaaggaaaagaaattgttataacaaaaagacacatgcactcatatattcattgcagtactatttgctatagcaaagagatgaagtcaacctaggtgcgcatcagtggtggatttggtaaagaaaatggtacatatacaccatggaataatgtacagccataaaagagaacaaaacaggccgggcacagtggctcacatctgtaatttcagcactttgggaggctgaggcaggtggatcacctgaggtcaggagttcaagacaagcctggccaacatggcaaaagccccgtctctactaagaatacaaaaaacattagctgggcatggtggtgcgcacctgtactcccaactactcgggaggcaggcatgagaatcacttgaacccaggaggcagaggttgcagtgagccgaatcattccactgcact

SEQ ID NO: 12852 - DNA, 397 bp, Homo sapiens
ctgaaagtgcagaagttggccgggcgtggtggcgggcgcctgtagtcccggctactcgggaggctgaggcaggagaattgcttgaatctgtgaggtggaggttgcggtgagtggagatcgcgccactgcactccagcctgggcaacagaatgagactccgtctcaaaaataaaaaataaaaaaaaaaaagaaagatttttgttacacggttgggctcggtggctcamacctgtagtcctagcactttgggaggccgaggcgggcggatcacgaggtcaagaggttgagaccatcctggccaacgtggtgaagccctgtgtctgctgaaatttcaaaaattagctgggcgtggtggcgcatsctgtggtcccggctcctcgggaggctgaggcagaag

SEQ ID NO: 12853 - DNA, 476 bp, Homo sapiens
gtatcttgttttttccgccctcggaattttatccaaagcagttttctacgttgccactaatcgtcataattgttcatttcagtggttgtgtacaatgccattgatgagaacagcagttctcaaacgtttctgtctcagaactcctttaaattgaaaattgaggcgtgagcaccacgcctggtcagttgtctttttttgagaatgtcaaataaaatgggatcatatggtatgtaaccttttgaaactggcttcttctcactcagcatcatgtctttgagattgattcaggctgttgcatatattgacagtttgttcctttttgttgctgagaagtattctgttgtatggctgtgctacagttggtattagctcccccactgaaggacatttgaatagtttccagtgtttggcaattatgaatagaactcctggtacaggtttttctgtgaacataagtttttaattttctctaggag

SEQ ID NO: 12854 - DNA, 513 bp, Homo sapiens
agaatgtaaacatttgaagacagcagggcagatactcagctcacatacgttactgcaaacccatctctcatgactgccttgaagaaaactaagtttggagggcaaactgccatacgaaaatgtggaaagacagatgaatctgcagagtcaaagacaagatctgcttacctggagcagaagccataaactgagaaactggacttcaacagaaagggagaaataaagactatcccaggctctgaaagacatacgaaagtaacttcttcagggagaaggaaaatcatataggagtaattcaatccagattgtgaagaagtcttagtgccaattgctctggcagccatgttatgaccatgagacaatcagccatagaaagaaatattctgcatgatagtttagaaagaagcaggacagaaacttctagagttacactgattaatgactgaatctgtgaatcctgatgtctgtcctaactttggatacatacttatataagtaaattattttccttat

SEQ ID NO: 12855 - DNA, 115 bp, Homo sapiens
ggccgggcgcggtggctcacgcctgtaatcccagctctcagggaggctaagaggcgggaggatagcttgagcccaggagttcgagacctgcctgggcaatatagcgagaccccgt

SEQ ID NO: 12856 - DNA, 97 bp, Homo sapiens
caaaatattaaaaataaaaggttgggacaaaagaatagcatgagaacacatggaagtaaaaagcagggatcacaatattgcttttctgttaaaaaaa

SEQ ID NO: 12857 - DNA, 267 bp, Homo sapiens
gggtgcattggctcacgccagtaatcccagcactttgagcggctgaggtgggaggattgcttgggcccgggagttcaagaccagcctggacagcaaggtgaggccccatttctacaaaaaattagccacatgtggtggcatttgcctgtagtcccagctgcatgggagagtgaggtgagagggtcgcttgggcccagagggtagagactgcagtgagccgtgtttgcacccctgcactccagcctgtgtgacagagtgagactgtgt

SEQ ID NO: 12858 - DNA, 397 bp, Homo sapiens
atttctggaccaaggggctgccataaggagtctgtgactagagatgggaggtggtggccacggcctctcgctgtatgctgtgtggaaggtcgaatcatcatcatcataaaacttaatattgcccttatgtgccaggaactactatctcagcaatggagatgtggtgcttggccgcaatcgtgaatcggccctggaggggacacaggaaggggctgcctgctactcatgacctcctgcgtgcctgcctgctgacctatgacccttcaagttcccacccctcagccacgcctgtgaggaggtatgaagaagacctgaggtgtgaagaagatcgagagggtcttgttttgtcgcctacgctggagtgcagtggtgtgatcacagctcactgcagcctcaa

SEQ ID NO: 12859 - DNA, 313 bp, Homo sapiens
tgaaggatctctctctctcatttgttttggattatttggatcaaagcattgtctgctttcttttttaatttcattctatgtagaaaagtactcttcatagaagagcaaggagaaaagttgtttggggccagacttggcaagtagatgtgaacattcttgatgttttaaaagtagcatataggctgggagtggtggctcatgcttgtaatcccaggacttcgagaggctgaggccgtatcacttgaggtcaggtgtttgagattagcctggccaacaagctgaaactccatctctactaaaaatgcaaaaaaaa

SEQ ID NO: 12860 - DNA, 492 bp, Homo sapiens
gtttttggtggagacggggtttcgccatgttgcccaggctggtctcaaactactgagctcaggcgatccacctgcctcggccatctaaagtgctgggattataggtgtatgccactgtgcccagcctgagtaattatttttaacttcactgatttttttaattggaatttaattttttataaattttgaagatctctgagaagtatttcaaattgatattacagtttttttttcttctttggttttatcatagtcatttgtttatgaacagatcttgttgaactgctttgttttcctaaagaaataaaggtcttcgaggctgggcatagtggctcacgtctgtaatcccagcactttgggagcctgaggtgggtggatcacctgagtgcaagaccagcctggtcaacatggcaaagcccgtctttactaaaaaacacaaaaattagccgggcatggtggcacatgcctgtgatcccagctacttggggaggc

SEQ ID NO: 12861 - DNA, 326 bp, Homo sapiens
ctggcgggaaagtggaaaactatcggcggtggcccaggctcggtggctcactcctggaatcccagcactttgggaggccaaggtggggggatcacgaggtcaggggatcgagaccatcctggctaacaggtgaaaccctgtctctactaaaaatacaaaaaaattagccaggcgtggtggaggcgcctgtagtcgcagctactcgggaggctgaggcaggagaatggcgtgaacccaggaggcggastgcagtgagccgagattgctgcactgcactccagcctgggcgacagaggaagactccgtctcaaaaaaaaaaaaaaaaa

SEQ ID NO: 12862 - DNA, 303 bp, Homo sapiens
  misc_feature 29,172..173,230: n=a, g, c or t
acatacgttactgcaaasssrkctctcangactgccttgaagaaaactaagtttggagggcaaactgccatacgaaaatgtggaaagacagatgaatctgcagagtcaaagacaagatctgcttacctggagcagaagccataaactgagaaactggacttcaacagaaaknnagaaataaagactatcccaggctctgaaagacatacgaaagtaacttcttcaggganaaggaaaatcatatagaattttatttaccatgtggttctggattagaatctaatgatagaaatgcttttgtag

SEQ ID NO: 12863 - DNA, 536 bp, Homo sapiens
ggattacaaaaattggctgggcatggtggcgtgtggctgtggtcccagctacttgggaggctgaggcaggagagtcacttgaactcgggagccagagactgcagtgagctgagatcgcgccactgcattccagcctgggcgacagagtgagactctgtctcaatcagtcaatcaatcaatcaatcaaattggaatatgagcactaaccttggtaagttaaaattttgggaaaattgtacctgcagaatatgatggatgaaaacaacagccaggtgcggtggctcgcgcgtgtaatcccagcactttgggaggccgagacaggcacatcatctgaggtcaggacttccagaccagcctgtccaacatggtgaaactccgtctctactaaaaatgcaaacaattggccaggcatggtggtgtgtgcctgtggtcccagctgcttgggagggtgaggcgggagagttgcttggacctgggagacagagattgcagtgggccgagatggcgccattgcacccccagcctggcgacaagag

SEQ ID NO: 12864 - DNA, 238 bp, Homo sapiens
aatttttaaaatttctatttctattttttctgcagcagttgggttagaggaggaggagccttttagcctctcataaactgacctctctacttcctcgtgtatttttaagattgattgatgatgtggaaagggctttgcttgtctgctactgaaaactttatccttgcggtttttgtggaaactgcttttggaaagagaaaagaaatgaactttactgacttgacatttttgcacctcc

SEQ ID NO: 12865 - DNA, 475 bp, Homo sapiens
caaaataaaaataatgactaacttttattgaataacccctacttgccaagcactgagcctgagtaatttagatatattatttcatttaatcttcaagataaccccctgaggtaagtactgttgaaatccccattttcaaatgagaaaattgaggctgatagaagttagctaactcacccatggttacacagctaggaagtggtacaaagtcggatgtaaagccaagtagcttgactccaaagcacatatgcttaaacacagacttactatctccctaatttttagacctgagttaacttttgaggtgacgacaggtcattcaagtgaaaataatccactaagtaatgcaactataagataagatatgtcatttcataggagcaatagttgacattattgggggaggtgttgattaataggaggaatgtaattggcatctgtcagaaaaatcttcccttagtggaaatcccacctg

SEQ ID NO: 12866 - DNA, 356 bp, Homo sapiens
  misc_feature 208,211,312,316: n=a, g, c or t
agccgcgcggccacgacggccgstgccccggagcgccggggtctttcctgggctccaaagtcaagagctcacgttccgggaggatctgtccgcggaaattcggttctgagcgtcgccggactccgccgcggggaggcggaaaagcggacgtaagtgctgccgaggagatggaggcgttggaccccctcgcgcattgtcggggcgggtncanccgcggtgcaaaaggaccttcctcagaaagttgagcacgaagttcccacaggcccggaatttcccctcccgggcgctccccagagagctgaagactgggcncgtnccggcggcaaatgttcacagcaaagggcggcccagtgcgc

SEQ ID NO: 12867 - DNA, 208 bp, Homo sapiens
tgtttaatgccatttattttttaagatgggatatatattttaattagctgggcgtcgtggcgggtgcctgtggtcccagctactcaggaggctgaggcaggggaatgccgtgaacccggaggcagagcttgcagtgaaccgagatcacaccactgcactccagcctgggcgaccgagtgagactccatcgcaaaaaaaaaaaaaaaaa

SEQ ID NO: 12868 - DNA, 319 bp, Homo sapiens
tatcgtcgggcacggtgactcacgcctgtggtcccggcatcttgggaggctgaggcgggtggatcatgaggtcggatcgggaccatcctggccagcatggtgaaacctgtctctgataaaggtgcaagggttatccgggtgtggtggtgtgtgcctgtggtcccggctgctcggggggctgaggcgggagagtcgcttgggcccggaaatcggaggttgcagtgagtgagctgggatcgcgccactgcactccagcctggcgacggagtgagactctgtctcaataaaaaaaacaaaaaacaaaaacaacaacaacaaa

SEQ ID NO: 12869 - DNA, 443 bp, Homo sapiens
gaggaacaaaaatgatctctagcaaatgatgccaactggcaccaaattctttttgaatcttaaacatatatgcacacgtgcacacacacacacacacagagcttcggcataatttagtaaatgcataaagatgccgtaagaaggactcgctatcatttggagtaattgcaggtctttgctcttggaccttgtagcacacttgattcctggcatacacatcctagcataacatataacagtgtggcttcttcacctagtgtaggcataaatcctttgcttttcatggttttgtaaaaaggtagtaacatacctattatgctttgaaatttgattcgttatgctctgcataagtggtaaaggctgtattgctttgcactgttaattatgaacaagaaataaaacaaatttgaagatagtattctgggcatactacatgttatatt

SEQ ID NO: 12870 - DNA, 118 bp, Homo sapiens
ctttttttttctgttttgggtgtactctaggggccaggttgggagggggaaggtgagggcttcgggtggtgctataatgtggcactggatcttgagtaatcaaatttgctgtggtttg

SEQ ID NO: 12871 - DNA, 320 bp, Homo sapiens
aatttgcattttaaaaattactagtgtttttttggccaggcatggtggctcatgcctgtaaccccagcactttgggaggccgaggcgggtggatcacttgaggccatgatttcgagaccagcttgggcaacatggtaaaaccctgtctctactaaagtaaattacaagaaktagccggatgtagtggtgcatgcctgtgatcccagctgctcgggaggctgaggcacaagaatcacttgacccagggaggcggaggctgcagtaagccaagatcacaccactgcatgccagcttaggsaacagagtaagactctgtctca

SEQ ID NO: 12872 - DNA, 440 bp, Homo sapiens
cctgcgcacaggtgggaggaaagggcctggccagtcctggtcctggctgcactcttgaactgggcgaatgtcttatttaattaccgtgagtgacatagcctcatgttctgtgggggtcatcaggaagggttaggaaaaccacaaacggagcccctgaaagcctcacgtatttcacagagcacgcctgccatcttctccccgaggctgccccaggccggagcccagatacgggggctgtgactctgggcagggacccggggtctcctggaccttgacagagcagctaactccgagagcagtgggcaggtggccgcccctgaggcttcacgccgggagaagccaccttcccaccccttcataccgcctcgtgccagcagcctcgcacaggccctagctttacgctcatcacctaaacttgtactttatttttctgatagaaa

SEQ ID NO: 12873 - DNA, 359 bp, Homo sapiens
  misc_feature 284: n=a, g, c or t
ttttataagaagtcttgtaatcaggtaatgctggtcctccaactttgtattttaacattttctatatttgggccgggcgcggtggctcatgcctgtggtcccaccactttgggaggccgagatgggtggatcacgaggtcagggtttcgggaccaggctggccaacatggtgaagccccgtctctagctagaagtacaaagattggctgggtgtggtggcgggcggctgtaaccccagctgctcgggaggctgaggcaggagaatcttttgagccccggagcgnatgttgcagtgagccgagatcgcaccattgcactccagcctgggcaacagggtgagactctatatcaaaraaaaa

SEQ ID NO: 12874 - DNA, 400 bp, Homo sapiens
tagtgaagatttaaaagtgggtagtgttataaagagtaaagtatatttgtagttattgacctgcgaggatacgcgattttgattgagtaaaggaagcaaattggccgggcatggcggctcatgcctgtagtcccagcactttgggaggctgaggcgggcagatcagttgaggttagtttgaggccagcctgaccaacatggcgaaaccccgtctctacaaacaaatgcaaaaattagccgggcaaggtggtgcctgcctgtaataccagctacgcgggaggctgaggcaggagaatcgcttgaacccgggaggtggggctgaagtgagctgcaattgcaccactacactccagcctgggcgacagagcaagattcggtctcaaaaaaacaaaacaaaaaa

SEQ ID NO: 12875 - DNA, 443 bp, Homo sapiens
catacagcaccctctaccstccgtggccatggcaacgtccagggcccagaaccctgaggagtgagcggccgagacgctgctcsssascccccacctccatgcctsagcctttgcctacsccaggaatgagcttggcctccaacatcccttgsctgctgccattagtagagggggmccstwctgmatctgagcsccccatccctgtgccacctgggtgtggagcccatggaacactctggtccgcctcattttaaaccaaaaaactgctccttcaccctcascctgaggccccaggggagaggacccgtgggatggtgcccaggggttgccttgggacctcggatctcctctggggggcttggctgctgctgttgctgctctgtatttgcctctcgtgattctgttttttacacatgttcacttcccccaggagaggccttggt

SEQ ID NO: 12876 - DNA, 129 bp, Homo sapiens
ttatgttctgatacgcaactgtcttcctgtgcctccttagataagaaatcaccccccaggtcgggtgcggtggctcacgtcctgtaatcccagcactttgggaggatccctcaaccccaggagtttgag

SEQ ID NO: 12877 - DNA, 484 bp, Homo sapiens
tttctctcttgaatagccagcgtggccatttttaaatttctcttgctctccaatctagtctaatttattctgtcagctgtcacatctactaactaggtagtccataggtgcatattatatgcatgtaatggacccattgttgtgtgaagggtggtgaagatttaggagcacagatttatcctgcagaccatttcccacatgaatgtgttcctgggaggatacattttggatttttaatacccatgcttcgtattttatacacatattttaataaaatgattttaagctgctgtttatataggaaattatatttacagcctccaaacgcaatataacattttagtgaaaagtcttgagttacatttcaagtacagttgatagaatgtgggaatcacttgtgggtgttggtgtagagcccgtcgagtgtcaataaakggggacttgctttgggggatgtgtctgggccccaggaccacattcgagg

SEQ ID NO: 12878 - DNA, 357 bp, Homo sapiens
agaacagcctaggtaactttgcaagactccatctctgctaactttttttttttttaaactgggctgggtgtggtggctsamacctgtaatcccagsactttgggaggstgaggsaggcggatsatgaggtaaggagattgagaccatcstggstaacacaatgaaaccccatcgstastaaaaatacaaaaaaatagccaggcgtagtggcaggcgcstgtagtcccagstastcagtaggctgaggcaggagaatagcatgaacccaggaggcggasttgcagtgagstgagattacgccactgcactccagcctggatgacagagtgagactccgtctaaaaaaaaaaaaaaaaa

SEQ ID NO: 12879 - DNA, 611 bp, Homo sapiens
ttaagggctgtagtgtgaggattgggaggaactcgacctactccgctaacccagtggcctgagccaatcacaaagaggattggagcctcactcgagcgctccttcccttctcctctctctgtgacagcctcttggaaagagggacactggaggggtgtgtttgcaatttaaatcactggatttttgcccaccctctttccaaataagaaggcaggagctgcttgctgaggtgtaaagggtcttctgagctgcagtggcaattagaccagaagatccccgctcctgtctctaaagaggggaaagggcaasgatggtggaggctttctgtgctacctggaagctgaccaacagtcagaactttgatgagtacatkaaggctctaggcgtgggctttgcactaggcaggtgggaaatgtgaccaaaccaacggtaattatcagtcaagaaggagacaaagtggtcatcaggactctcagcacattcaagaacacggagattagtttccagctgggagaagagtttgatgaaaccactgcagatgatagaaactgtaagtctgttgttagcctkgatggagacaaacttgttcacatacagaaatggggatggca

SEQ ID NO: 12880 - DNA, 425 bp, Homo sapiens
actgctgcygccgccgccgccgcagcaggtcacagcccctcgaggcgacagggccccgccgacccagagcagtggtacaggcatggatgggaagaaatgcagcgtatggatgttcctacctcttgtatttactttgtttacttcagctggattgtggatagtatacttcatagctgtggaagatgdacaaaattttaccattaaattcagctgaaaggaaacctggtgtgaagcatgcaccatatataagcattgcaggtgatgatcctcctgcaagctgtgtgtttagtcaagttatgaacatggcagccttcctagcccttgtggtagctgttctgcgcttcatacaactgaaaccgaaktttttaaacccgtggctgaatattagtggattggtggctctgtgtckgggctttccttcggaa

SEQ ID NO: 12881 - DNA, 106 bp, Homo sapiens
caaaatattaaaaataaaaggttgggacaaaagaatagcatgagaacacatggaagtaaaaagcagggatcacaatattgcttttctgttaaaaaaaaaaaaaaaa

SEQ ID NO: 12882 - DNA, 473 bp, Homo sapiens
acattgtctgcgacttacctttctaggttcctttctcccatgtgcatccccttccttccaaagcactcattgattctagcctgcagtgtatagtttcctgatcaagccaagctctcccacacctctgtaacttttgcgtatattgttcagtctccctgtaagtcttccctaccttcaccttttatagaaactgcagggtacctacttgccccttgagatagctattcctgaatttctcccgaatttaagcattcctcctctatactttcataaatctttcacacacctctttcatcctacaatgtcataatattagttggttttatctgtcttccttaatgtatccttaactcctgagagtggacgctacatcttagtcatctatgaaaccccagaaaatgtaatcaagctaaaatggctcactcatttcctagcaaatattggttaaatgactgaatggatgatacaggggg

SEQ ID NO: 12883 - DNA, 397 bp, Homo sapiens
tcgtcctctagtttggggcggaatgaggcctgctcctcttgtaaatacccccttccctcgaagctccctcccggtgctggggggcagctgaggggctgcaggggcagtctccctcctccaagcccctgtacataacctggagcgtgtgaccttcagagcttttcactttatgcaaaatggctcctgtgagggctgcaasctggagggtggtgcaggccttgggcacaggaaggcgcctgtggaatagggggagttcatgcaccccttttttccccagagggctggactcaggttagtttgggggtgggggctcctgcactttgccacaggcacgggggagggttttctcctcrccccctctgccctcccaacttgggttgtactttctaagaaggtg

SEQ ID NO: 12884 - DNA, 496 bp, Homo sapiens
ctttctaactgttaagtctgagtgtttcacattcactgttgactgcaggctatcatcaaaacattacatttccttttacaaaggttctggtaactcaaaatgttttctaaaagacactccctaattggggaggggtcttttgagacaattttgtatgtacttaatccgtgtttaagaaaactgtcctttaactcttacctttgtttacagtatatgttgtttatgtaatgtcctgatgtacattgatatacaggaagtacattaatatattaatcaggccaaggccgggcgccgtggctcgcgcctgtagtcccggcactttgggaggccgaggtgggtggatcgcctgagatcaggagttcgagaccggcctggccaacatggtgaagccctgtctctactaaaaatacaaaarattagccaggcatggtggcgcggacttgtagtcctagctgctacttgggaggctgaggtgggaggattgcttgagctggtg

SEQ ID NO: 12885 - DNA, 101 bp, Homo sapiens
ggccgggcgcggtggctcacgcctgtaatcccagctctcagggaggctaagaggcgggaggatagcttgagcccaggagttcgagacctgcctgggcaata

SEQ ID NO: 12886 - DNA, 439 bp, Homo sapiens
  misc_feature 167: n=a, g, c or t
aaatttcccgggccgggagcgctgggcctgccgggaaggcgctgggacggttacccagcgggccgccggcggtcgtgggcaagcttcgccatgcagagcactgacctaggcaacaaggagagcggcaagatatggcaccgcaagccgtccccggccacgcgggacgnaattatagtgaacattattcacaacacttccgattaccatccaaaagttttgcgatttttgaatgtggcttttgatggcacaggcgactgcttaattgctggggaccaccaaggaaatatttatgtttttgacttacatggaaacaggtaccttgcaaaatactgtcataagtgctaaaggacgaaagtgggaaaaaacagaatgataacatggttcacattttaaagaattaaagtgctggttttaatagtaaaaaaaaaaaaaaaaaggc

SEQ ID NO: 12887 - DNA, 307 bp, Homo sapiens
  misc_feature 305: n=a, g, c or t
ttagcaagacattgtaaatcggccaggcatggtggctcacgcctgtaatcccggcactttgggaggctgaggtgggtggatcacgagttcaggagttcaagaccagcctggccaacatggtgaaaccccatctctactgaaaatacaaaaattagccaggtatggtgtcaggcgcctgtaatccctgctgaggcagagaatttcttgaacccgggaggcggaggttgcagtgagctgagatcatgccactgtactctagcctgggtgacagagtgagactccattgcaaaaaaaaaaaaaaaaangy

SEQ ID NO: 12888 - DNA, 297 bp, Homo sapiens
ttagcaagacattgtaaatcggccaggcatggtggctcacgcctgtaatcccggcactttgggaggctgaggtgggtggatcacgagttcaggagttcaagaccagcctggccaacatggtgaaaccccatctctactgaaaatacaaaaattagccaggtatggtgtcaggcgcctgtaatccctgctgaggcagagaatttcttgaacccgggaggcggaggttgcagtgagctgagatcatgccactgtactctagcctgggtgacagagtgagactccattgcaaaaaaaaaa

SEQ ID NO: 12889 - DNA, 68 bp, Homo sapiens
ttccgccactgcactccagccttggtgacagagcaagactctgtctcaaaaaaaaaaaaaaaaaaaaa

SEQ ID NO: 12890 - DNA, 211 bp, Homo sapiens
  misc_feature 98: n=a, g, c or t
sgaaaaaaagggtsttstgagctgmagtggcaattagacmagaagatccccgctcctgtstctaaagaggggaaagggmaaggatggtggaggctttntgtgctacctggaagctgaccaacagtcagaactttgatgagtacatgaaggctctaggcgtgggctttgcactaggcaggtgggaaatgtgaccaaccaacggtaattatca

SEQ ID NO: 12891 - DNA, 454 bp, Homo sapiens
tttaccatgttgcttaggctggtcttgaactcctgagctcgggcaatctgcctcccttggcctcccaaagtgctgaggttacagatgtgagccactgtgcccagcctattctttagcttttataaatagattcataaagtatatactgtttggttttggtttctttcattcaacataatgttttttagatttatacatgatggtgagtttattcttttttattgctgtatagcatttcattgtgtaactatattatgctttatttttaccatttgttcgtgatcatttgggttgttccctagtttttggttataaatacattcttgtacatgtcttttggtagacatatacatgcatttactttgaagagcatacttaggagtataattgagtaacagatttattatatgtttaactttgatactgccaaatggtttttctaattgcagttgaa

SEQ ID NO: 12892 - DNA, 130 bp, Homo sapiens
atatataaaataaaaggagacatgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12893 - DNA, 184 bp, Homo sapiens
agaagggattggcctccctgaaacctcccagctcaatgaccagatctccaggcacaggaacgggggcaggggatggtgaatgacggggtattgcctaaggctggtgcacttttatttaaataaacttgtgtggtaaaaaaaaaaaaaaaaaaaaaaaaaaaaaaaaaaaaaaaaaaaaaaaaaa

SEQ ID NO: 12894 - DNA, 289 bp, Homo sapiens
gggtgcattggctcacgccagtaatcccagcactttgagcggctgaggtgggaggattgcttgggcccgggagttcaagaccagcctggacagcaaggtgaggccccatttctacaaaaaattagccacatgtggtggcatttgcctgtagtcccagctgcatgggagagtgaggtgagagggtcgcttgggcccagagggtagagactgcagtgagccgtgtttgcacccctgcactccagcctgtgtgacagagtgagactgtgtctccaaaaaaaaaaaaaaaaag

SEQ ID NO: 12895 - DNA, 335 bp, Homo sapiens
atagctggtgtctctatttaaaaaaggatcttttggccaggcacagtggctcacacctgtaatcccagcactttgggaggccaaagtggatgaatcacttaatttcaggagtttgagaccagcctggccaacatagtgaagccccatctctactaaaaatgcacaaaaaattagccaggtgtggtggcggatgctgtaattccagctactccagaagctgaggcaggagaatcactggagcctgggagagtgaggttgcagtgagctgagattgcatcattgtactccaacctgggtgacaagagcaagactctaatctcaaaaaaaaaaaaaaa

SEQ ID NO: 12896 - DNA, 323 bp, Homo sapiens
atagctggtgtctctatttaaaaaaggatcttttggccaggcacagtggctcacacctgtaatcccagcactttgggaggccaaagtggatgaatcacttaatttcaggagtttgagaccagcctggccaacatagtgaagccccatctctactaaaaatgcacaaaaaattagccaggtgtggtggcggatgctgtaattccagctactccagaagctgaggcaggagaatcactggagcctgggagagtgaggttgcagtgagctgagattgcatcattgtactccaacctgggtgacaagagcaagactctatctcaaaa

SEQ ID NO: 12897 - DNA, 397 bp, Homo sapiens
atttttaagttttggttttggagttttgctattctgggaaggtaccttttactacaacaagtaaacatgcataataaagtaggattcatccaatgtctgacctttctttgcatcaaaagaacatttccggccaggcacggtggctcacgcctgtaatcccagcactttgggaggccgagccaggtggatcacgaggtcaggagatcgagaccagcctggcctaacatggtgaaacctgtctctactaaaaatacaaaaatgagccgggcatggtgggggggcacgtagtcccagctacttgagaggctgagacaggagaatggcgtgaacccggggggcggasttgtagtgagccgagatcgcgccactgcactccagcctgggtgacagagtgaga

SEQ ID NO: 12898 - DNA, 440 bp, Homo sapiens
  misc_feature 409: n=a, g, c or t
tttcagccagcaccatgtggagcagctggacctaaacgtcagtgctgtggaactgctggcacgcaagtttcctgggcggcctgaggaggagtaccgtcaccagctgggtcggtatggcatctccggagaactggccatgcgtcctcttgccagcctgtctgggggccagaagagccgagtggcctttgctcagatgactatgccctgccccaacttctacattctggatgaacccacaaaccacctggacatggagaccattgaggctctgggccgtgcctcaacaatttcaggggtggtgtgattctggtgtcccacgatgagcgctttatcaggctggtgtgccgggagttgtgggtatgcgaaggaggcggcgtcacccgtgtggaaggargatttgaccagtacngcgccctcctccaggaacagttccgccgcga

SEQ ID NO: 12899 - DNA, 345 bp, Homo sapiens
  misc_feature 272: n=a, g, c or t
atttattcctttgtcttgactactgctccgattatgctcatgccctattctgaacccctcagatgagttccgtgtttgttttgcttgtcctagtgctcaaagacaaaggctataccacccttcaggatgaggccatcaagatattcaattccctgcagcaactggagtccatgtctgacccaattccaataatccagggcatcctacagacagggcatgacctgcgacctctgcgggacgagctgtactgccagcttatcaaacagaccaancaaagtgccccaacccggcagtgtgggcaacctgtacagctggcagatcctgaacatgcctgagctgcacctt

SEQ ID NO: 12900 - DNA, 459 bp, Homo sapiens
agattctcrggctcagaaccagaatttcttcatctgaggctattatcttgctctggaggakggagtgagaactggatcactggttacggtggtgactgggacaacagcacagccacagacaggaacacagaaggcagaggcagccttgatctgcaagggctccagttaaccccaatgggkaccctcgatggacaaaggcactctcctaggcttggtgatgaaagtattcctcttacagccaggcaaggcactcagggctctgcagcagagaagttagagctgtagcttttttgcttggtgttttcactaaaacttaatttcttgttgcacttgttggatgggcatgtcccataggggaagtttccactactgtgttctaaactttggactgcttgtaccatcttacttgttccctcattaataatgaactaaataaaacctttagtatatgccaaaaaa

SEQ ID NO: 12901 - DNA, 352 bp, Homo sapiens
tgcaatccaatcctagaatatagattagtagaattgtatagtgggattgtagctggagaagattctgggaaagttctttcttactagaccttataatcattcaattaaaatatttctaatattaaatcatctttgcatttctggattaatgcttacccttttttttttccttaaatgaaacaaacaccttcagatgaaaaagagcagtactgatctaaaataacaggtaggaccaggcacaatggctcatgcctgtaatcccagcattttgggaagccaagacaagagaattgcttgagcctaaggagttcaggaccagcctcggcaacatagttaggcctcgtctctcaaa

SEQ ID NO: 12902 - DNA, 318 bp, Homo sapiens
gaaggtcaaagtgatgtgtcttttagaggctttgggacactttttagtaagtatgagcagacaaatgcaatgaaatatgctatgaaaaaacccttctgaactgagagagggcttatcactatatccagctaagatttgtatttgaatcatctgtaaagtcgcactcttacaacaagcttctgggttttaaatacctccgtacagcaagtaaacgttccccgctttctgttctcagtgtcctcggtcatggtgcttttcgttgcattaaaagtgccggtcaaactttgatagtatttttttatagttggttgcagagtg

SEQ ID NO: 12903 - DNA, 124 bp, Homo sapiens
caggagggaggattgcctgagcccaggagtttgaagccaggcatggtggctcataccataatcccagcactttgggtgggaagattgcttgagactgtctctacaaaaaaaaaaaaaaaaaagc

SEQ ID NO: 12904 - DNA, 468 bp, Homo sapiens
caaaaattaactgggtgcagtggtgcgcatgcctgtagtcccagctacttgggaggctgaggcaggagaattgcttgaaccctgggaggcagaggttgcagtgagtcgagatcgcgccactgcactccagcctcggtgacagagcaagactccatctcaaaacaaacaaacaaacaaaaaaaaaccctgatgccattcccagtccccgttgtaggacatcacatttataaatccaggctttagtcttctgggctccaccagtctctgccccaccatattcctttgtcactacctctaagtttttttccccacttgaggatttggagttaaacgaactcaaaatgtcttgtcattgtatgtattcttgcccctgctttgaaaacagggccatgggaactctgtttatgccctgttttaatgtttctgttttatgttttactgttaatatgaaaataaagaatttgctat

SEQ ID NO: 12905 - DNA, 479 bp, Homo sapiens
ctttaatccaagaaaaatattctctatatcctttgtttttaaatcttttaaacatatagagcatattttatgttgttaaatttttgagaaactacttactagcaagtaaaatgttggcagattttctttgcccctattaaatgaaaacatttacaagatgctgcatgttactggacaggaacagttgttgcacataggtaatcttaagattttttaaagtattttcaaaaagctataagactacttatatggtaggatcacaatagtttcaaaactcagggtttggcttttaaaattttcatactttggtagaatgttaaagaacacaagatgtttcacagtcttttagcagaagagaatctgaacattccaattagaactttattccaaagaagggtaattttattttgtcttttaagtaatttgacccatttatatctgtatgctatatattttactgtaggttgcctgttagtctg

SEQ ID NO: 12906 - DNA, 288 bp, Homo sapiens
aaataaagatgagggtactaaagttgtcttggtttttattttattattatttttttctttttccagtatactagcttgtcttttaagaaaggggatattaaaaaaaaaaaaagacaaaagtgtttttaaaaaaaagcaacacccacacctgtgtctgtatatagtcagcttatctcgtgttcaatcgtctgatctctacagagagaagtggaaaatgctgtatcaagggtgggcttagctgtgcctttccaataaagatgtgagaagctccaaaaaaaaaaaaaaaag

SEQ ID NO: 12907 - DNA, 357 bp, Homo sapiens
tggctagagtgtacctagagagggaaaatttcaatagacagtaggccagttcaagactggatagaggccgggcgcggggcctgtggtcctagcactttgggaggtcgaggcgggtggatcacctgagctcaggagttcgagagcaacctgaccaacatggtgaaacaccgtctctgctaagaatacagaaattagctaggtgtggtggtgggctcctgtagtcccaggtactcgggaggctgaggcaggaggatcgcttgaacccggaaggcgaaggttgcaatgagccgagatcgtgccattgcactccagcctgggcgacttagcgaaactccgtctcaaaaaaaaaaaaaaaaa

SEQ ID NO: 12908 - DNA, 380 bp, Homo sapiens
atatataaaatataaaaaatatgtggcaccaccattccctatttatattttagttgtgatttaaaaatgagatttgactaaagcatttagcatacatgatcatccataatatgtgccctactccttaattcttactggttaccttagaaattttaagtttgactgacttctttagaaaaatgtacgtaaatcacagatgccccaatgtggtattgaaagcaaattaaaaattttaaattagggccaggcacagtggctcatgcctgtaatcccaagtgctttgggaggcagaggtgggaggattgcttgaggccaggagtttgagaccagcctgagcaatatagtgagactcctccatctacaaaaaaaaaaaaaaaaag

SEQ ID NO: 12909 - DNA, 300 bp, Homo sapiens
ttgtcttgactactcaaagcccctgaattgttgtcaactttcccctttgtgttgtgtagccctaacgtcatttagcttgttgtctgatgcctccagtaggacacctccgatggagctttgatttctgagcagcgaaastcccttcctaagatgcatctcgcataggctgcctatgatgaaggaccgtgcacctccactccaacagagtgctgagtttaaaagttgacctgtgtttgtaatttcactttcatcttgcttaataaatatctgctggattctttcaaaaaaaaaaaaaaaaag

SEQ ID NO: 12910 - DNA, 476 bp, Homo sapiens
aaaatggattgtttttgaaatttctaggtttggctctatttactgtaatggttgaaaacaatttagtatttgggtgacccttttgtttttcttctaaatgtgcctctggtaaaatacagaactagactaaagatgtagctttttaatatttgtcttttgatggtggcaggagttcatacattaattgaactaacacatcatattttgacctactatttctatcatattgacttactgtttctgcacttctttgaccagacttatcttgaaaaagtccacttttgttaaaatgtagtcacacctctgatataatccaacaagaagtgttcaaaatattttaaatatttgtgcattttataatcactaaattaatctctctctcttctctttgaacagcttagcagtgtctgcaaaaacgaatcttttcctacaacctgttaactgactggactgttggtaacaaagtaattgtgaga

SEQ ID NO: 12911 - DNA, 431 bp, Homo sapiens
  misc_feature 417: n=a, g, c or t
ttttttgtattttttgtagagacagggtttcgccatgcttccctggctggtctcgaactcctaagctcaagcaatccacctgccttggcctcccagagtgctgggattataggcacgagccactgtgcctggccggaagctccttaatttggccccggtgtctcattgacatacctccatcattgtgctttttgttttgttttgtttttagcacttccttacctttgggcactacaacatgctccagactcatcatttgtatttcttgcctaattttagaattaaccattccttcaaggagccctggttccttctataactattttttttaattgcgatataactcacatactatataatccacctatttaaaatgtgcaactcagtagcttttgatatattcacagatgtgcagcnattgccgcaatcaa

SEQ ID NO: 12912 - DNA, 257 bp, Homo sapiens
gactcacgccttgggaggccgaggcgggtggattacctgaggtcaggagttcaggaccagcctggccaacatggtgaaactccgtctttacaaaaaatacaaaaattagccgggcgtggtggcatacgctgtaatcccagctacttgggaggctgagacaggagaattgcttgaacctgggaggtggaggttgcagtgagccaagatcgcgccactgcactctagcctgggggacatagcaagactttgtctcaaaa

SEQ ID NO: 12913 - DNA, 271 bp, Homo sapiens
gactcacgccttgggaggccgaggcgggtggattacctgaggtcaggagttcaggaccagcctggccaacatggtgaaactccgtctttacaaaaaatacaaaaattagccgggcgtggtggcatacgcctgtaatcccagctacttgggaggctgagacaggagaattgcttgaacctgggaggtggaggttgcagtgagccaagatcgcgccactgcactctagcctgggggacatagcaagactttgtctcaaaaaaaaaaaaaaaaa

SEQ ID NO: 12914 - DNA, 283 bp, Homo sapiens
atttttagtagagacggggtttcaccgtgttagccaggaaggtctcaatctcctgacctcgtgaatcgcccccctcggtctcccaaagtgstggattacaggcgtgagcaccatgcccggcccaaatattttttattcaggatggtataacctaactgataataggtaataaggttaaatttttttatgasgtattttatttacaaatatcatacactgctggtgttaccatatgaaaggaaataaagtcaattgataattgcctcaaaaaaaaaaaaaaaaa

SEQ ID NO: 12915 - DNA, 297 bp, Homo sapiens
tacaaataaaatatcaaaaacatggccaggcgcggtggctcacgcctgtaatcccagcactttgggaggccgaagccggcggatcacgaggtcaggagatcgaaaccgtcctggctaacacagtgaaaccccgtctctactaaaaatacaaaaaattagcctggcttggtgctactcgggaggctgcggcaggagaatggcgtgaacccgggaggcggasttgcagtgagccgagatctcgccactgcactccagcctgggtgacagggcaagactccatctcaaaaaacaaaaaca

SEQ ID NO: 12916 - DNA, 307 bp, Homo sapiens
tattacgattactcaagaaatgcaaaataggccgggcgcggtggctcacgcctgtaatcccagcaatttgggaggccgaggcaggtggatcacgaggtcaggagatcaagaccatcctagctaacacggtgcaaacccatctactaaaaataaaaaatattagctgggcgtggcggcaggcgcctgtagtcccaactactcgggaggctgaggcaggagaatggcgtgaacctgggaggcggasttgcagtgagccaagatcgggccactgcactccagcctgggcgacagagggagactccgtctc

SEQ ID NO: 12917 - DNA, 203 bp, Homo sapiens
tgaactatcaaacttaggagccatctagcttacacgtgttccttaaaaagtttgctgtaggccgggcacagtggctcgtacctgtagtcccagcabttttgggagcccagggtgggggatcacttgagctcaggagttcaagaccagcctgggcaacatggcaaaacgbcatctctacaaaaatacaaaaaaaaaaaaaaaaa

SEQ ID NO: 12918 - DNA, 61 bp, Homo sapiens
acatatattcttttgtcttttgcttctctcagtcgactaacattgtaagagtcagcttcaa

SEQ ID NO: 12919 - DNA, 274 bp, Homo sapiens; identical to SEQ ID NO: 12787

SEQ ID NO: 12920 - DNA, 209 bp, Homo sapiens
ttctggtcagtttttttaagggggggtgttgtggttttttgtttttgttttgcttctgagaaagcatttgcctttcttcctctcccaacataacaatcgtggtaacagaatgcgactgctgatttaccgatgtatttaatgtaagtaaaaaaaggaaaaaaagaaaaaaaaaaaaaaaaaaaaaaaaaaaaaaaaaaaaaaaaaaaaaa

SEQ ID NO: 12921 - DNA, 338 bp, Homo sapiens
agttttctatgtagatgttttacttacatttcattaaatttattgttaggccgggcatggtggctcacgcctgataatcccagcactttgggaagccgaggcaggtggatcatgaggtcgagatcgagaccatcctggctaacaaggtgaaacccgtctctactaaaaatacaaaaaattagccgggcgcggtggcgggcgcctgtagtcccagctactcgggaggctgaggcaggagaatggcgtgaacccgggaakcggastttcagtgagccgagattgcgccactgyagtccgcagtccggcctgggcgacagagcgagactccgtctcaaaaa

SEQ ID NO: 12922 - DNA, 68 bp, Homo sapiens
attctgstttccaactgcctkmttgcttgttcgtctcastggtgtgagctccagcatcscctttgctc

SEQ ID NO: 12923 - DNA, 184 bp, Homo sapiens
ttttggggggataaatasctagatagatagggactgctaggtcatgtggtcagtgcasgstcaaccttttacaaaactgsscagttgctttscacatggstgcaccattttgsattcccatcaacamyggataagaactccggctgggtgcmgtggctcacgcctataatcccagsactttggg

SEQ ID NO: 12924 - DNA, 502 bp, Homo sapiens
taaataaattagccagggacgctgatgcacatccatactcccagctacttgggaaactgaggcaggaggattgcttgagcccaggaatctgaggctgccatgagctgtaatcactgtgctgcactctagcctgggcaagagggcaagacctcatctcaaaaacaacaacaacaaaagaaagtttaaagctcttgataaagcaattagatttgaggtaaagggactaatataatacatatgaaagaatgaacaattaggctgggcatggtggctcacgcttgtaatcccaacactttggaggctgaggcgggcggattacctgaggtcaagagtttgagaccagcctggccaatgtggtgaaacccatctctactaaaaatacaaaaattagccaggcatggtggcacgtgcctgtaatcccagctacttgggaggctgaggcaggagaattgcttgaacctgggaggcggagatgcagtgagccaagattgcgcccactaca

SEQ ID NO: 12925 - DNA, 421 bp, Homo sapiens
cacgaggtagaattaggggccttgaaaatatgacaaactctgagggaaacaaagacaatgtggaaagaataacttaattttaattccatctccagagagatttgaggtgtatttaagatgaaaaacaggatactacaaagaaacggaaaactcaggagttcgagaccagcctaggcaagatggcaacatcccgtctctacaaaataatttttaaaaattagccaagcatggtggcatgtgcctgtggtcctagctacttgggaggctgaagtgggaagatcacttgagcccaggagttcaaggcttcagtgagccatgatggtgccactgcactccagcctgggggacagagtgagaccctgtctcttaaaaagcaagaaaagaaagagaagactgagaataagaagatctctttgaaaat

SEQ ID NO: 12926 - DNA, 491 bp, Homo sapiens
tattaagtgcccaaatgtcggcatcatgcagtatacctatgtgacaaatctgcacgcataccctcaaatgtaaaataaaaagaataaaatgctttgggctataacaacatcacatttttstagctcttggttaatagctgaaattaggggtgaaagacaaggaattatatcccctttggcatggggtgaatgtttctattccaggtcaccccaaattttatgagbtaacatctataaaagctcttggcctatagcccaaggttttcttctcaagtatgcagttaaaataaatgactctacatstttattttttattaakstgtacgttagastatagagttaatttgtcastctgstctttggggaataaatattagtatasaacctgtattastttaataaagaaattatttstttagttttgattsttcaggatgattcaattccctggtgagagaataacttactttattaaggtaatagatgtaggg

SEQ ID NO: 12927 - DNA, 414 bp, Homo sapiens
ctaagaattgggcacaacaaatttgcactctaagaaatgttaaaggaggttcttcaggctagaagaaaataataccagatagaaacgttaaatgtccgctttaaaaacgaggagcatggccgggcacgtggcttacacctctaatcccagcactttgggaggctgaggcaggcagatcacctgaggtggggagtttgagactagcctgaccaacatggagaaaccccgtctctactaaaaatacaaaaaattagctgagagtggtggcgcatgctgtggtcccagctactctggaggctgaggcaggagaatcgcttgaacctgggaggtggaggttgtggtgagctgaggtcacgccactgcactccagcctgggcaacaagagtgaaactctgtcaaaaaaaaaaaaaaaaa

SEQ ID NO: 12928 - DNA, 259 bp, Homo sapiens
taaattagtaggctgggcacggtggctcacgcctgtaatcccagcactttgggaggccgaggcgggtggatcacgaggtcaggagatcgagaccacggtgaaacccgtctctactaaaaaaaaaaaattagccgggcgcggtggcgggcgcctgtagtcccagctactcaggaggctgaggcaggagaatggcgtgaacccgggaggcggasttgcagtgggctgagattgcgccactgcactccagcctgggtgacag

SEQ ID NO: 12929 - DNA, 222 bp, Homo sapiens
  misc_feature 17: n=a, g, c or t
tacagaaatasaatgtntgataaaatttcttgatcacaatatcttttttttattgttaaacttaaaggaactttattagtataaatttatggaggccgggcgtggtggctcacgcctgtaatcccagctactcgggaggctgagccaggagaattgcttgaatatgggaggcagagtttgtggtgagctgacatcatgccactgcactccagcctgggtgac

SEQ ID NO: 12930 - DNA, 71 bp, Homo sapiens
ctttttttttttttcttttttcsggcgttcaagwtgtcaaagcgaggacgtggtgggtcctctggtgcgaa

SEQ ID NO: 12931 - DNA, 53 bp, Homo sapiens
atccgggggtcgtttccaggagctgcagccctccagcctggggtctggccagg

SEQ ID NO: 12932 - DNA, 339 bp, Homo sapiens
aaaaaggcaggagctgagctctgggaacggctctatccctcctgcagcgtcccgggacaggccctcggattttgggggacccttccctggytttcagagtttcttgaacgttctctccctggtgctgcctccgccacccttcggtagccactcgctctcggctgttmgcactaaaggcggcccctcgtattaacaacgggccctacttctgctgtccctccaaggggcggactcggagaagakcacggtggtggaaggcggtgaagtgcgcttcaatggcaagggaaaaaagatccgtaaacccaggacgatttattccagtttgcagttgcaggcttt

SEQ ID NO: 12933 - DNA, 493 bp, Homo sapiens
gacagggtttcctcatgttgcccaggctggtcttgaactcctgagttcaagcaatccacctgcctcggcttcccaaagtggtggtattacaggtgtgagccagtgcacctggcccatatttatcttaaaaaaaaaatagatgtttatcattttttatatagactcattgaaaaaatgactttgtgttcttccagtacataccatcatgtctgagagggcagagatctagacaagtgtgggaaagatgactttggatcaaaattttcttgtgaatataatgtgcttatgcgtaatttaaagctgactgtattaaagatacattttttgtcaaccagatgattgttaaatacctgtgaagtatgtgtggcccggtcctatttcctcacctgtttacagtgaatcagacgtcccaatagatgtggagacggtcacatcaacgcctatgccactctatgacaatcagaaggcacgcagcgtgatgaatgagtgtgaa

SEQ ID NO: 12934 - DNA, 276 bp, Homo sapiens
ctcacgcctgtaattccagcactttgggagcccgaggtgggtggatcacctgaggttgggagttcaagaccagcctgaccaacatggagaaaccccgtctctactaaaaatacagggttggccgggatggtggtgcatgcctgtaatcccagctactcaggaggctgaggcaggaaagtcgcttgaacccgggaggcagaggttgtggtgagccgagattgcgccattgcactccagtctaggcaacaagagtgaaactctgtctcaaaaaaaaaa

SEQ ID NO: 12935 - DNA, 233 bp, Homo sapiens
atttgtgttgttcgccagctaggcctggcctcgtcccgsttckhtcggtasggtstcgcgcgcccccatagswsttgstagagggttagmgttagcttaagtgtgsgaatccgaggagcagcgagakactcgagaccacgctccttcctcgggaaggaggcggcacctcgcgtttgaggcccgcctgcgtttgaggcccgcctgcgcttgcggcccgcctgcgcttgaggcct

SEQ ID NO: 12936 - DNA, 350 bp, Homo sapiens
gaaaaaggccgctcgctcgagattacgcgcgctggagtgcaatggcgcaatctcagttcgctgcaacctccacctcccagggattgtgctgcctcagcctcccaagttgttgggattgtagacacccaccaccacgcccggctaattttttgtatttttagtagagacggggtttccccatgttggccatgcgatctccaactctggacctcaggcgggcagatcacttgaggtcgggagtttgagaccagcctggccaatgtggcgaaaccccatctttattaaaaatacaaaaaatgagctaggtgtggaggtgcgsacstgtggttctcagctactcaggagactga

SEQ ID NO: 12937 - DNA, 256 bp, Homo sapiens
ctttctttcccagccacagccagggtagggctgataaggcgctgatgcgttgatggcagccttgcagagctagacctgcacttaacttgcagctgcctcccgagcctcccaagatgtccacgccctgggtgacaggcggcagggcgctgcccgtgctcccccggctctgctcgacagcagcacgcagtagagcctcgccgccgccgaggagcaacttcatgtaacggcacagcaacaagatgaacgggagcttttg

SEQ ID NO: 12938 - DNA, 340 bp, Homo sapiens
ttggggattgatgtaagatcatctgtttttcatgttgcaaagtaaggatgttttaaaacaaggtagctgggcgcagtggctcatgcccgtaaccccagcactttgggaggccaaggcaggtggatcatctgaggtcgggaattgagaccagcctggccatcatggtggaaccccatctctactggaattacaaaattagctgggcgtggtggcgattgcctatgatcgtagctactcgggaggctgaggcaggagaatcgcttgaacctgggaggcggaggttgcagtgagctgagatcgtgccactgcactccagcctggatgaaagagcaaaactctg

SEQ ID NO: 12939 - DNA, 62 bp, Homo sapiens
aaaaaaacaaaaaaaaaaasggagsgagsgaktggagagagggttasggagagtgtgasaaa

SEQ ID NO: 12940 - DNA, 372 bp, Homo sapiens
catctgaggttctaaatagggcaggagcgcccctgccagtcccctttggcacagttctgcgtgcacagcctgtctcctctgagctgttcaaggtggtgactgatgccatatgtttttgcgcmmcttcccaacacgtgtggtgaaggaccaggattttggttttttgttttgtttcgaattttctaatccactgcacgttgatacgtctgtaaaagacaatacaaatgaattactaggaaaatgatcacacatttggttgtcactgcagtgttgaattgcaggtttctaaatgcttcttttcaatttctgcacttatttcctggcctggtaacagtttgcagtctgtcactggggasacactttgagcagctg

SEQ ID NO: 12941 - DNA, 330 bp, Homo sapiens
  misc_feature 73: n=a, g, c or t
tattctggattttctctaacaaataatasttgatagggccaggcatggtggctcacgcctacaatcccagcanttttggaggctgacaggggtggatcactttagctcaggagtttgagaccaacctgggcaacatggtgaaacccatgtctaccaaaaatacaaaaaattaaccgggcctggtggtgtgtggtcccagbtactaaggaggctgagatggaaggatgacttgaacccgggaggcggaagttgcagcaagccaagatcacgctactgcactccagcctgggtgacccagtgagaccacatctcaaaaaaaaaaaaaaaaag

SEQ ID NO: 12942 - DNA, 413 bp, Homo sapiens
gaaaaaggccgctcgctcgagattacgcgcgctggagtgcaatggcgcaatctcagttcgctgcaacctccacctcccagggattgtgctgcctcagcctcccaagttgttgggattgtagacacccaccaccacgcccggctaattttttgtatttttagtagagacggggtttccccatgttggccatgccgatctccaactctggacctcaggcgggcagatcacttgaggtcgggagtttgagaccagcctggccaatgtggcgaaaccccatctttattaaaaatacaaaaaatgagctaggtgtggaggtgcgcccctgtggttctcagctactcaggagactgaggcaggagaatcacttgaacctgggacgtggaggttgcagtgagccccaaatagcaccactg

SEQ ID NO: 12943 - DNA, 417 bp, Homo sapiens
cataggaataaccttgaaacagatcttctataatatgccaaccaagtaaatgtttgcaaacacaggaaattttatgattagtgactattggttgtaaaaaaaaaaaaattctcactcaaatacaataagtaccaatgtcttaatgcttatctggcatggccaaggtcactattttaggaagtttgaataccaggattgtcagcagtgttgccaaattctttcatggctttactctggaatatggtgtgcttgttatcccaaggcttgcttttctagagacagctgattgaatcaaagagagaaatccatatccaaattaatgattacmtactttgacctctactgctgacagctactgatttattacattaccatataccaagtagtatgacacttttacaaatattattttattta

SEQ ID NO: 12944 - DNA, 514 bp, Homo sapiens
gcacttccggtctcgtgccgccttcccaggaccctcagggagagcgggcagccttccaggtggacaggtaacccaggtttttctgccttttatgtgccatttgcaaaggctttatactctttgacaaacagacgctttccagtttggactatcagtcatgctgggcatgcgttggctcccaaagacaagaagattcttacaacatcagaggattcaaacgctcaagaaattaaggacatttatggactaaatggacaaatagagcacaaactagctttcctgagaactcatgtgccaaaggacatgaaacttgtgctcattggccattcaataggcagctatttcacacttcagatgctgaagcgagtccctgagctcccgctaatgctgcctaccttgggggccaagaaatgatggaggtggtgaagagagatgacgaaaccataaaggagcatttatgtaagcttacattttattatggtactatagatccttggtgtccaaaagagtacta

SEQ ID NO: 12945 - DNA, 482 bp, Homo sapiens
atttcagcttttgggtgaagacggaggcggttctggacagacstacgctgtcagggagtgtttacttcgcctccacttctgttcctccccgccctggtgctgctccrggtcacatactcktcctgagccggcttcagcctctcygcgcagaagtstcccggagccatggcckagtawtcttatgygaagtctaccaagcttgtgctcaagggaacgagatttgcctgaggttgactgtacatgcaaatattgagctttcctcctggcctccgtgataaacagaagttttgatattgttaggcgagatggaaagaaagtatcaaggagtgagctgaagccactgcccttgagaaccctctcgaggagtctggcctcatgaagatgccagaataaatggcagagctaagaagtgacagaatcgggatttaaaatctggcggtgtggctctacaatctgctttgaactttaaacataatatgtac

SEQ ID NO: 12946 - DNA, 324 bp, Homo sapiens
tattacgattactcaagaaatgcaaaataggccgggcgcggtggctcacgcctgtaatcccagcaatttgggaggccgaggcaggtggatcacgaggtcaggagatcaagaccatcctagctaacacggtgcaaacccatctactaaaaataaaaaatattagctgggcgtggcggcaggcgcctgtagtcccaactactcgggaggctgaggcaggagaatggcgtgaacctgggaggcggasttgcagtgagccaagatcgggccactgcactccagcctgggcgacagagggagactccgtctcaaaaaaaaaaaaaaaaa

SEQ ID NO: 12947 - DNA, 399 bp, Homo sapiens
tcttataaaagttgttaattttgccatgagcttttcattaaaaatttatgatttgatcaacttcatttgatttcaaattatcactaaaatgtgtgctttttgcattaaataggcatgtaattcttccttttattcagttccaatccacgttgacctgtgattataaacccccattgtgttatagaacttgacaaatgtctgcttgttctggatattaggcaaagtatgagaatctgactttatttcagatctttttatacgtctgaaagaagcctaggttggatagttttcaaacatttgcaaatcataatagtattttatttttaaaagagtctaatggtaataataaatacgaatttattgataaataataataaaaataaataagttaatatttat

SEQ ID NO: 12948 - DNA, 281 bp, Homo sapiens
atgttgtgaaccgggtcgcggcggccgaggctcgggcctccaggaccactggctgcccatgagagacgaaggatggcatccaagggggccggcgtgtctttctcccgcaagagctgtaggctgacctcagatgctgagaaatccagggtcacagttactcgggaggctgaggcaggagaatcgcttgaaccggagaggcggacgttgcagtgagccgaggtcaaaccagtgcactccagcctgggcaacagagcgagactccatctgaaaaagaagcaaaa

SEQ ID NO: 12949 - DNA, 365 bp, Homo sapiens
catttatatacaaggttgtccaggatgtataatccaggctttgttgagtggatgagggtatcctgactggggcctggcaaccccccgacatccacagaggaaaacaagtgtttgtgagagaagtgatagaatttgtcaaaagtatatgaaattagttacataaaatctgaaacatacattgtggttctgtttgtcctgtgactatgtaaaattgccattgaaaaaacccagaaagccgggcgtggtgactcatgcccgtaatcccagcactttgagaggctgaagcgggtggattgcttgcgcccaggagtttgagaccagtctgggcaatatagagaccctatctccaaaaaaaaaaaaaaaaa

SEQ ID NO: 12950 - DNA, 513 bp, Homo sapiens
aaaggtagaaacagctgatcacaatggttcactcctgtaatcccaacactttgggaggtcgaagtgggaggattgcttgagcacaggagttcaagaccagcctggacaacatagtgagacatggtctctgcaaaaaaatagaaaaatcagcagggtgtggtggcatgcacgtatactcccagctactcaggaagttgagtgagaggattgcctgagcccaggagtacaagactgctgtgagctatgatcatgccactatactccagcctgcgcaacagagagaccctgtctggaggggtggggggagaaaaaaacaccatagaaacaacccaaatgtccaataacaaattgtagtccatccatacaatggactactactcagccatgaaaaggaatacagcactcacatatgctgcatgtgaatgaaccctggaagcattatgctcagtgtaagaacccagacataaaaggtcacacattttatgattccacctatatgaaatatccagaaga

SEQ ID NO: 12951 - DNA, 308 bp, Homo sapiens
  misc_feature 150: n=a, g, c or t
cgcgttgcccaggctggtctsaaactcctaggctggaagaatccccmagcactttgggaggcsaaggcgggcggatcacgaggtcaggagatcgagagcatcctggctaacacggtgaaaccsgtstytactaaaaatacaaaaaattancsgggtgtggtggtggatgcctgtactccsagctactcgggaggctgaggcaggagaatggcgtgaacccgggaggcggacttgcagtgagccgagatcgcacagctgcactccagcctgggcgggcaacagagtgagactccgtcccaaaaaaaaaa

SEQ ID NO: 12952 - DNA, 82 bp, Homo sapiens
aaaagaaagaaagagagagaaaaaaagaaagaaagaaggaaggaaaaaagaaagaaagaaagaaaagaaagagagagaaagg

SEQ ID NO: 12953 - DNA, 315 bp, Homo sapiens
cgcgttgcccaggctggtctcaaactcctaggctggaagaatcccccagcactttgggaggccaaggcgggcggatcacgaggtcaggagatcgagagcatcctggctaacacggtgaaacccgtctctactaaaaatacaaaaaattagccgggtgtggtggtggatgcctgtagtcccagctactcgggaggctgaggcaggagaatggcgtgaacccgggaggcggasttgcagtgagccgagatcgcacagctgcactccagcctgggcgggcaacagagtgagactccgtcccaaaaaaaaaaaaaaaaa

SEQ ID NO: 12954 - DNA, 509 bp, Homo sapiens
tctctttggatgatctgttcagtgctgaaagtagggtgttgaagtctcctattattgaaatgcagtctgtctctccctttagatctaatatttgctctggtgttgggatttctaatgtgaagtctattttatctgataaaactacaactactcctgctttcttttgctttccatttgcatggaatatcttcatgtgtccttacgggtgaggtctaccagcaacaaattgcctcaatttttgttttctacaaaagtctctgccaggcacggtagctcacagctgtaatcccagcactttgggaggccaaggcaggtggatcacttggtcagcagttcaagaccggcctggccaacatggtgaaaacccacctctactaaaaatacaaaaattagctgggcgtggtggtgtgtgcctgtaatcccagctactcgggaggctgaggcagaagaatcacttgaacctgggaggcggaggttgcagtgagccaagatcacgccattgcactctg

SEQ ID NO: 12955 - DNA, 175 bp, Homo sapiens
caaaaattagccatgcgtggtggcagacgcctgtaatcccagctactcgggaggctgaggcagagagttgcttgaacccaggaggcggagtttgcagtgagctgagattgtaccactgcactccagcttgggtgacagagtgagactctgtcacacacaaaaaaaaaaaaaaaaa

SEQ ID NO: 12956 - DNA, 473 bp, Homo sapiens
  misc_feature 28..29: n=a, g, c or t
ttccccatcttctcctctattctggtcnnccctksscccacgccttcccacccagcgtcttccccaggttcccccactacctctccctcagatccaggccctcagctcagcatgggtggttctccctccaggaaagggggaggagggaccaggacctgagttgcatagcggctgcctggatgggcttagaagcctttttgagggacctccctgcccctatcctggggcttggatacctttccaagtccctggaactgcccacccttcccctgccaccccgtcagagatcctagtatggaggaacatctgtctgtcatgtatgagagactgagacaagaggtaagtcagtgcaaaagtggccttcgtctacagtgggaaggatgtgggtaatccttggacgtacagggatagtcaactggattcttttttggaaccatgaggcaggcatagaaatatattataaacattttcct

SEQ ID NO: 12957 - DNA, 452 bp, Homo sapiens
  misc_feature 20: n=a, g, c or t
attattattattgttattantattttgtagaaacggggttttgccatgttgtccaagctagtctcaatctcctgagctcaggcaagtcgcctgtctcagcctcccaaagtgctgggattacaggcgtgascaccatgcccgtccccagactctcttaaataaccagatctcctgtgaactaactgagtgggaactcactcatcaacaaggggatggtgctaacccattcatgagtggttgacccccttgatccaatacctcccaccaggctctaccccgtctctactaaaaatacaaaaaattacgccgggtatggtggcgggcgcttgtagtcccagctacttgggaggctgaggtgggagaatggcgtggacccgggaggcagagcttgtagtgagccgagatcgcgccactgcactccagcttgggggacagagtgagactctgtctca

SEQ ID NO: 12958 - DNA, 324 bp, Homo sapiens
tattacgattactcaagaaatgcaaaataggccgggcgcggtggctcacgcctgtaatcccagcaatttgggaggccgaggcaggtggatcacgaggtcaggagatcaagaccatcctagctaacacggtgcaaacccatttactaaaaataaaaaatattagctgggcgtggcggcaggcgcctgtagtcccaactactcgggaggctgaggcaggagaatggcgtgaacctgggaggcggasttgcagtgagccaagatcgggccactgcactccagcctgggcgacagagggagactccgtctcaaaaaaaaaaaaaaaaa

SEQ ID NO: 12959 - DNA, 311 bp, Homo sapiens
ttctggatgagtgtagtggctcacgcttgtaattccagcagtttgggaggccaaggtgggagaattgcttgagcctaggagtttgagatcagcctgggcaacataactagatgctgtgtctacaaataataaaaaaattagctgagtgtcgtggcctgtgtatctggtcccacctactcgggaggctgggatgggaggattgcttgagcctaggaggtcaaggcagtagtgtgttgtgataatactaccgtactccagcctgggcaacagagtgagaccccatccctccacaaaaaaaaaaaaaaaaaggs

SEQ ID NO: 12960 - DNA, 372 bp, Homo sapiens
aacaattagagatactttatttatttatttatttatttgagatggagtcttgctatgtcacccaggctggagtgcagtggcacagtctcagctcactgcagcctctgactccggggttcaggcgattctcctgcctcagcctcccgagtagctgggattacaggcgcccgtcaccacgcccggctgatttttttgtattttttggtagagatggagtttcaccatgttggccgggctggtctcgaactcctgaccttaagtgatctgcccgcctcggcctctgaaagtactgggattacagcataagccactgcacccagccagacaattagagatattttagaggagagtacaagggaaactttcagagtg

SEQ ID NO: 12961 - DNA, 458 bp, Homo sapiens
  misc_feature 451: n=a, g, c or t
aggtagaattggtagtttcgtgaacacttaaaaggtgagggatgaggcccagcactttgagaggccaaggtaggtggatcacttgaggtcaggagttcgagaccagtctgggcaacatggcaaaaccccatctctactaaaaatacaaaaagttagctgggcatggtggcgcgtgcctataattccagctactcgggaggctgaggcacaaacattgcttgaacgggggacacagaagctgcagtgagccgagattgtgccactgcactccagcctgggggacagagtgagactctgtctcaaaaaaaaaaagtgaaggatgagaatggtgcggtggcattatcaaagaccggggtttccagtgtggttrattaggcaatgatgttaatggaaatagggaatccaggaggagaatgagggggaaagatagtaagtttaggttttagtcttntcgtggt

SEQ ID NO: 12962 - DNA, 494 bp, Homo sapiens
catttataggaaacaagactttgaggaaatagaccaaaatggtgtcagaggttgtgtgagggagataagaatatggagatattctttccctttctctcattttcacgtttttttctaatgtgattatgttacttttattgtaagaaaaccttcccttctccccttcttttttcctctccactaagagtctcctcttcttttcttctcttctgttgcctaggttggagtgctgtggtgtgatcacagctcactgcagcctcgacctctctggctcaggtgatcctcctgcctcagcgtcccgagcggctgggaccacaggtgcatgccactacatctgattaattttttaattatttgtagagatggggtctccctatgttacccaggctagtctagaacttctgagcggaaacagtcctcccgccttggcttcccaaagtgctggaattacagatgtgagccactgagcttggcctcttttcttcttctctaag

SEQ ID NO: 12963 - DNA, 287 bp, Homo sapiens
aaattagtcgggcatggtgatgtgcacctgtagtcccagctgctcgggaggctgaggcaggagaatcgcttgaacccgggagacagaggttgcaacgagccaagatcgagccactgcgctccggcctgggtgacaggagactccatctcaaaaaataaaattaaaaaaaaactactacaataaattatcaccttggactgtataaaacaacttttaaactagtctttttaaaaagtacacttaaataaaaatctaaacataagagaatgcaaaaaaaaaaaaaaaaa

SEQ ID NO: 12964 - DNA, 366 bp, Homo sapiens
  misc_feature 13: n=a, g, c or t
ttttataagaagncttgtaatcaggtaatgctggtcctccaactttgtattttaacattttctatatttgggccgggcgcggtggctcatgcctgtggtcccaccactttgggaggccgagatgggtggatcacgaggtcagggtttcgggaccaggctggccaacatggtgaagccccgtctctgctagaagtacaaagattggctgggtgtggtggcgggcggctgtaaccccagctgctcgggaggctgaggcaggagaatcttttgagccccggagcggatgttgcagtgagccgagatcgcaccattgcactccagcctgggcaacagggtgagactctatatcaaaaaaaaaaaaaaaaa

SEQ ID NO: 12965 - DNA, 288 bp, Homo sapiens
  misc_feature 286: n=a, g, c or t
gtagtttatccttagtcagaaaggtttcaggatgttggggttcaatttggtagtgctaatcaaaaattttaatttgcatataatttgaccctgcagtttcacttctaggaatctatgcaacagaaatgctcaaacaaatatacagtgcaggccgggcatggtggctcatgcctgtgatcctagcactttgggaggctgaggcaggtggattccttgaggtcaggagttcgagaccagcctggcaacatagtgagacccccatctctacaaaaaaaaaaaaaaaaangs

SEQ ID NO: 12966 - DNA, 509 bp, Homo sapiens
atttaaaaaacaagtaaataactaaagaaaagataactactggccaggtgcagtggctcacacatgtattgccagcactttgggaggccgaggcaggtggatcatgaggtcaggagttggagaccagcctggccaagatggtgaaaccctgtttctactaaaaagacaaaaattagccgagcgtggtggcaggcgcctgtaatcccagttactcagtagctgaggcaggagaatcgcttgaacccgggaggcggaggttgcagtgagctgagatcatgccactgcaatctagcctgggtgacagagcaagactttgtctcaaaacaaaaataaaagataagataattactttatacttagcttgtcttacccatgagtgacgggctgcatgtggcccaggacagttttgaatgcagttcaacacaaatttgtaaactttcttaaaacattaggagattttggccaggtacagtggctcatgcctgtaatcccagcactttgggaggctg

SEQ ID NO: 12967 - DNA, 497 bp, Homo sapiens
cgaaattggacagcgaggctgtgccagggccacctgctgcccggacgtccagcctgaggaagccgaggaccatctctgaccaccctggcaccttaaataaggaagaggcccagattgtgaagacggacccatatatccctacctcccaccacctagtggccaaacaccccgccaggagttcaatgctgggagaggtccagagggttcctataaggaaaaactatttaatacatgacctaggggaggcctaaaacccttttggggataatgtcccagagtccccccactagacacaggtcactgccaagcatcagggccactcgggctcagaggtcactcagggtcaatactcagggtcagtgcaggtdatgagatccttggggtccaccctagtctctgacacctgggacagggtgcttttgctactttggttgtggtcactcccccacacctgcctgcctccttaacggactcgaagtgaccttcctggaggaggt

SEQ ID NO: 12968 - DNA, 540 bp, Homo sapiens
cagaaacatctcggggggacttctaaaatttagtgaagacaaggccttgcaactccaaagaaactttttttcccccccttgaaacagggtcttgctctgttgcccagcctggagtgcagtggtgcagtcacggctcactgcagcctcaagctcctgggctcaagcactatccccacctcaacctccttagtagctgggactacaggtgcacaccaccatgcccagctaaccacagaaactttcatctcttcattttttctttgggcaccattaatacctaagacaggtagaaagggtcccagaaagacaccattggtaatggccgattgccggctgcagtcatcgcccccagatcaggctggtacaggatgccttaaggtgatgagaggtgagggtgcatgaagaataatgagcacagggaagagagaagcaggacaaagtagcagataaaatgccggcaaagcacagatgaatgtcttcaagaagctcttgtatttctctgcacagtgtaaatatccttgctatttcaggatggcggct

SEQ ID NO: 12969 - DNA, 313 bp, Homo sapiens
ctttaaaaagagctttcatggccaggcgcggtggctcacgcttgtaatcccagcactttgggaggccgaggcgggcggatcacaaggtcaggagatcaagaccatcctggctaacacggtgaaaccccgtctctactaaaaatacaaaaaaattggctgggcgtggtggcgggcgcctgtagtcctagctactcaggaggaggcaggagaatggcgtgaacctgggaggtggagcttgcagtgagccgagatcgtgccactccccttcagctagggcgacagagggagactctgtctcaaaaaaaaaaaaaaa

SEQ ID NO: 12970 - DNA, 345 bp, Homo sapiens
agaacagcctaggtaactttgcaagactccatctctgctaactttttttttttttaaactgggctgggtgtggtggctcacacytgtaatcccagsactttgggaggctgaggcaggcggatcatgaggtaaggagattgagaccatcctggctaacacaatgaaaccccatcgctactaaaaatacaaaaaaatagccaggcgtagtggcaggcgcctgtagtcccagctastcagtaggctgaggcaggagaatagcatgaacccaggaggcggasttgcagtgagctgagattacgccactgcactcsagcctggatgacagagtgagactccgtctaaaaa

SEQ ID NO: 12971 - DNA, 486 bp, Homo sapiens
aaaggcaaaacatgtatatacaaaccatgaatttggataaatatagtatatgcatacaagaaaacagtattcagtcttaaaaattaaaattctgatacacagatctatgtaaaattctgatacatagctacaaaacatggatgaactctgaagacattatgctaagtgaaattagccagtcatgaaaagacaaaatactctatggttccacatatatggggtacctagaatagtcaaattcatagagacagtggttcccagggactgtggagagaaggaaatagtagctattgtttaatggatagagtttcggtatgaaatgatggagaagttctggagagggatagtggtgatgacggcacagtgtgaatctacttaatgccactaaactgtaccacttaaaaatgttttaaatggtacacttgatgttatgcatattttaccttttttttttttctttttgagacagagtctcactctgttgcc

SEQ ID NO: 12972 - DNA, 188 bp, Homo sapiens
catcacttgtaaacattttcacatggtttcaggaaatccccagcccttttattaggcctttttaggtactgaaacctttagctgatgttctctgttatttgcttgctttctgctgtcattccagctctctcagtttttattttccccatagcctcactttgaatattgactcctaaataaaagtggtc

SEQ ID NO: 12973 - DNA, 254 bp, Homo sapiens
aatcccagcactttgggagttcgaggtgggtggattgcctaaggtcaggagttcgagaccagcctgaccaacatggtgaaatcccgtctctactaaaaataaaaaaactagccgggcgtggtggtgggtgcctctaatcgcagctactcaggaggctgaggcaggagaatcacttgaacccgggaggcggaggctgcagtgagcagagatcacgccattgcactccagcctgggcaataagagtgaaactccag

SEQ ID NO: 12974 - DNA, 526 bp, Homo sapiens
agtttggaggtttctcaaagaacacagaactatcattcaatccagcaatcttgttactaggtgtatatccaaaggaaaagaaattgttataacaaaaagacacatgcactcatatattcattgcagtactatttgctatagcaaagagatgaagtcaacctaggtgcgcatcagtggtggatttggtaaagaaaatggtacatatacaccatggaataatgtacagccataaaagagaacaaaacaggccgggcacagtggctcacatctgtaatttcagcactttgggaggctgaggcaggtggatcacctgaggtcaggagttcaagacaagcctggccaacatggcaaaagccccgtctctactaagaatacaaaaaacattagctgggcatggtggtgcgcacctgtactcccaactactcgggaggcaggcatgagaatcacttgaacccaggaggcagaggttgcagtgagccggaaatcattccactgcactccagcctgggtgacagagtgagactcc

SEQ ID NO: 12975 - DNA, 477 bp, Homo sapiens
atttaaaatacatcagtgcgggccgggtgtggtggctcacacttataatcccaacacwttggaaggccgaggcgggaggatcacttgaagccacaaatttaagaccagcctggataatatagcgagaccctgtctctacaaaaaaaataaataaagaaaaaaataaaatatgtcagtgtgttttgggaacaggttgagagcatagcatgctcatattatatattcattttaccacttagatttgaattgaggcatctcttagaataggttttattttgtgcataccctcagaggacattgtccctctcatagaaacagatattcaaacatgtaatctgctattttattttaaggtaatagatttttatgattactgtttggaaaaaaaaaaagcacctataggttagcagttgctccagawtctccaaaacaagcttaggagatttttattctttaccagaatgagatggcttggga

SEQ ID NO: 12976 - DNA, 471 bp, Homo sapiens
taacttaaaaaaaatcaaaccttggcaagagctaaaataatttggagatatctttgcccttgacttgtagacgacatctaagaggatgaagaaaggagagtctaagtgagactctggcctacttcctaacaatgtcttggaagtgggatgatggtaaaggagaaaggccacagtccaatccctctgccttcagatagggaactcaaatcctgaaattactgttttctttctggccttttctcctggttagaggaggaagcggaaagtagttttgagtaatactttgttcatattaccccccttttgttttttgtttctggcccctctaccaatagggcagtagcctcctgccctggatgggtataaggtgggcttggtccaacaggttcccagagggtacatactcctttctggggagagaatgctccctaccatatatttgacagtggttaggaactctccctttcccta

SEQ ID NO: 12977 - DNA, 161 bp, Homo sapiens
asaagcgattstcctgsctcagcctcccaagtagctgggattacaggctctggcaccatgcccggataatttatggtttctttccaatttgaggtctctctcctgaagtggctgacacaattkgagaaactggttatttaccaaggctttgacttggaatc

SEQ ID NO: 12978 - DNA, 397 bp, Homo sapiens
tctctttggatgatctgttcagtgctgaaagtagggtgttgaagtctcctattattgaaatgcagtctgtctctccctttagatctaatatttgctctggtgttgggatttctaatgtgaagtctattttatctgataaaactacaactactcctgctttcttttgctttccatttgcatggaatatcttcatgtgtccttacgggtgaggtctaccagcaacaaattgcctcaatttttgttttctacaaaagtctctgccaggcacggtagctcacagctgtaatcccagcactttgggaggccaaggcaggtggatcacttggtcagcagttcaagaccggcctggccaacatggtgaaaacccacctctactaaaaatacaaaaattagctgg

SEQ ID NO: 12979 - DNA, 361 bp, Homo sapiens
ctcattattcatctaccagttgtttattcggcactttttgtctgtccaagattgtgctggatgctggtgtataaagaaaaggtaaaggccgggtgcggtggctcacgcctgtaatcccagcactttgggaggccgaggcaggcagatcacgagggcaagagatcgagaccatcctggccaatatggtgaaaccgtctctcctaaaaatacaaaaattagctgggcgtggtagtgcgtgcctgtaatcccagctacttgggaggycgaggcaggagaatctcttcaacctgggaagcggaggttgcagtgagcsgagatcgtgccactgcactccagcctggcgacagagtgagactccatc

SEQ ID NO: 12980 - DNA, 404 bp, Homo sapiens
  misc_feature 219,239: n=a, g, c or t
ctaaaaaacacggtctcaacctggccaccgtgggtgaggcctgaccaccttgggacacctgcaagacgactccaacccaacaacaaccagatgtgctccagcccagccgggcttcagttccatatttgccatgtgtctgtccagatgtggggttgagcgggggtggggctgcacccagtggattgggtcacccggcagacctagggaaggtgaggcgangtggggagttggcagaatcnccatacctcgcagatttgctgagtctgtcttgtgcagagggccagagaatggcttatgggggcccaggttggatggggaaaggctaatggggtcagaccccaccccgtctacccctccagtcagcccagcgcccattcctgcagctcagctggggascatcattc

SEQ ID NO: 12981 - DNA, 450 bp, Homo sapiens
caggatattacccacttggtttaagttgtgatttcaaatcccattttctatgggagatacactggtggaacaaatctgcagagggccctgcacctgcgctggtggatcaacggtgtcttctcacctccagggctagctgccttgccttccctcgtggggcttaagtggctgggaagcagatagacagtgtagatgaagtcctgggccactggctgctggactgaggcagtgagatgactgggctggcatttgttctttctctgcctgtgtgtgacctctaactatgtgcctggaaactgaattacatgtaattaatgctgcaaacaggattttcttattgcctaagcatgaacttggtatgaaaataatagttaataatttactatgtaacttggattcttataacctggactgtaagtttgttttagctccagtgggagtttccttttc

SEQ ID NO: 12982 - DNA, 309 bp, Homo sapiens
tgaaggatctctctctctcatttgttttggattatttggatcaaagcattgtctgctttcttttttaatttcattctatgtagaaaagtactcttcatagaagagcaaggagaaaagttgtttggggccagacttggcaagtagatgtgaacattcttgatgttttaaaagtagcatataggctgggagtggtggctcatgcttgtaatcccaggacttcgagaggctgaggccgtatcacttgaggtcaggtgtttgagattagcctggccaacaagctgaaactccatctctactaaaaatgcaaaa

SEQ ID NO: 12983 - DNA, 356 bp, Homo sapiens
caaacattttctttgagctcctgctaaaaataggacatgtctatgattgttcaaaaatatgttaaatttaggctcagcacagtagctcacacctgaaatcttagcacttcgggaggctgaggcaggtggatcacttgaggttaggagttcaagaccagcccagccaacatggtgaaaaccctgtctctactaaaaatacaaaaattagccaggcatgatggtgcatgcctttaaacccagctactgaggaggctgaggcatgagaattgcttgaaccaggagacggaggttgcagtgagctgaaatcctgccactgcacaccagcctgggtgacagagcgagactccatcccaaaa

SEQ ID NO: 12984 - DNA, 351 bp, Homo sapiens; identical to SEQ ID NO: 12784

SEQ ID NO: 12985 - DNA, 465 bp, Homo sapiens
acgtaactgatcggagcattctgggaagaagtaatttattccttttcggcagccgaatgaaaaaaaaatttaaaaaaatgtgcgagctaatatggcaaaacaactggaaggacgctaaataataggattgctcataccagcgcgttatgaactcaccctagcttgtaacggaatctttttcactgagtgcagaatgtcggctatttgcctgtatcgtcaggtgggataatccttacctgttcctcctccggaggcagattagaacatgatgattggagatgcatgaaacgtgattaacgtctctgcgtaatcaggtcttgcaacaccctgattgctcctatctgattctttctgacgatcacttacatttgtgttatgctgattagcagatatccacaaacatagctatgaagttctgactgggataaccttgctgtttgtctattttgcagtcttgctattgct

SEQ ID NO: 12986 - DNA, 188 bp, Homo sapiens
tccattatgggaggctcattaaaagttggaagaaggccgggcgcggtggctcacgcctgtggtcccagctactcgggaggctgaggcgggagaatggcgtgaacccgggaagcggasttgtcagtgagccgagattgcgccactgcagtccgcagtccggcctgggcgacagagcgagactccgtcsc

SEQ ID NO: 12987 - DNA, 439 bp, Homo sapiens
agcatcgatcgctggctttctctgacccaacagtgggtgaaggaaagagactgaaagctggcaaggtgggggtggaagaagactgggacagcttttgtagagaaagaaagaaaaaggaggaaaacgggtgggggccatggggactaggcttaactgatgcctgcctgcctctctttgatttgatggcctttattccttctaattggataaaataggaagtcactggcagtcctgtgtggctggggatactgattttactcagaccagcctgcagctctagagtgtgggtagagagcggggagtgagggttgggagagggggaggaaagagagagaggagagaggacgggcttggatgaagaagggaaagaaagagaaagagactgaagcagagaagagccgcagaggaagaaagtgaatgagcactcaagaaggacaaa

SEQ ID NO: 12988 - DNA, 103 bp, Homo sapiens
atcgccttcgccgccgcccgcccgcaaaccttcgtgcccggcccgtggcctgcgcggagtgttgtccaataaagttcttggatgtgaaaaaaaaaaaaaaaaa

SEQ ID NO: 12989 - DNA, 294 bp, Homo sapiens
cagatgatatgtccttgaagctggcaggggattcscagtccagggaatatccctacatgatttttgtcattcatgggtsctcsctgggcctgacaacgggagtggtgggtgggtgagaacagsttctgagagggggcttctaggaaggccccagccctagtcctaggcgactttgaataaagtggggaggtcaaacatgggssttcggsattkggtttctagggaatatggctcagtagggsstgssscttcaagggcagcaagaacgaagcaggatgttgtsactcscgtctg

SEQ ID NO: 12990 - DNA, 299 bp, Homo sapiens
aaccatccgggcgtggtggctcacgctgtaatcccagcactttgggaggctaaggtgggtggatcacgaggtcaggagttaaagaccagcctggccaagatagtgaaaccccgtctctactaaaaatacaaaaattagctgggcatggtggcaggtgcctgtaatcccagctactcaggagggtgaggaggagaattgcttgaacctgggaggcggaggttgcagtgagcccagattgcgccactgtactccagcctcggcgacagagcgagactctgtctcaaaaaaaaaaaaaaaaa

SEQ ID NO: 12991 - DNA, 440 bp, Homo sapiens
atagaacaaagtttctcatgctgtttctgtttaagtgaaaatttccctgagattgcaaagcaaaccgttaccactgtagccacttatttgtgtgcatcaagatttttttcagtattatgcaattaagttaaaatagagacataggtgttgaggtaaatgttaagactataccttgccgggcgcggtggctcacacctgtaatcccagcactttgtgaggctgaggcgggcagatcacgaggtcaggagatcgagactatcctggccaacacggtgaagccccctctctactaaaaatataaaaaattagccgtgcatggttgcgggcgcctgtggtcccggctgctcaggaggctgaggcaggagaatgatgtgaacccgggaggcggaccttgccgtgagccgagatcgcgtcactgcactccagcctgggtgacagag

SEQ ID NO: 12992 - DNA, 307 bp, Homo sapiens
tatatgtttggctgggtgtggtggttcacgcctgtaatcccagcactttgggaggccgaggcaggcggatcacaaggtcaggagatcgagaccatcctggctaacacggtgaaacccatctctactaaaaatacaaaaaattagccgggcatggtggtgggcgcctgtagtcccagctactcgggaggctgaggcagaagaatggtgtgaacctgggaggcggasttgcagtgagccgagatcgagccagtgcactccagcctgggagacagagcgagactctgtctcaaaaaaaaaaaaaaaaagg

SEQ ID NO: 12993 - DNA, 348 bp, Homo sapiens
actcttaacaacagacaagatttggaaacaacctaactgtccatcaacagatgaatggataaaggaaatgtggtacatatacactgtggagtactattctgccataaaaagaatgagatcctgtcatttgcaacaacatggatggaaccggagtcattatgttaggtgaaataagccagacacagaaagacaaacatcacatgttctcacttatttgtgggaactaaaaatcaaaacaattgaatacagggaaatagagagtagaaggatgggtaccagaggctgggaagggtagtgggaggtgggtggaggtggggacagttaatggttacaaaaaaaaaaaaaaaa

SEQ ID NO: 12994 - DNA, 324 bp, Homo sapiens; identical to SEQ ID NO: 12946

SEQ ID NO: 12995 - DNA, 441 bp, Homo sapiens
atcacattctgtgttattgccatgttaactccacatgcagcttgagcattcagtcttctgacctgttccacctctacagggcattttatggcttaaggatgacggcctagaagggaagggagagacttactttggattaaatttacaatgggaaagtgcttaagctgctgcaaagaggaccagagcttyccaacgatgttctccagaagatcaagttagtacagacgcccagcatcgtggagcctcttctatttcacaaccaagtatatctcttggtcataaaacatcttattcccctgtaacacataaagtcaatgcagccaaagcaagtagaaggttattatctgtatcaagtccatctttctctgaaagaagatattctttatttgttggatttcaaaaaagaaatgcttccccttactggcaacaaagtagagctaa

SEQ ID NO: 12996 - DNA, 354 bp, Homo sapiens
tgtatgttacctatttcaagatttaagagtcattgctgggcacggtggctcacacctctaatcctagcactttgggaggcgaaggtgggtggatcacctgaggttgggagtttgagaccagcctgaccaacacggagaaactccgtgtctactaaaaatacaaaatgagccaggcgtggtggcgcatgctatgatcccagctactcgggaggctgaggcaggagaactgcttgaacccgggaggtggaggttgcggtgagtggagatcacaccattgcactccagcctgggcaacaagagtgaaactccatctcaaaaaaaaagaaaaacaaaaacaaaaaaraaaaaaaaaag

SEQ ID NO: 12997 - DNA, 155 bp, Homo sapiens
attagctaggsatggtggcgtggcacgtgcctgtagtcccagctactcgggaagctgaggcaagagaatcacttgaaccagggaggcggaggttgcagtgagccgaggtcgcaccgttgtactccagcctggtgatagaacgagactccacacaa

SEQ ID NO: 12998 - DNA, 156 bp, Homo sapiens
aaataaagatgagggtactaaagttgtcttggtttttattttattattatttttttctttttccagtatactagcttgtcttttaagaaaggggatattaaaaaaaaaaaaagacaaaagtgtttttaaaaaaaagcaacacccacacctkgtgtc

SEQ ID NO: 12999 - DNA, 419 bp, Homo sapiens
  misc_feature 137,285: n=a, g, c or t
attcctggtagccgactcgtcgtctgascagggccgtgccgcaatcttcctaaggcactggtttccggccctggggagactggaattgagacgacagggcctccgctgaccagtccttggacacaacgcggasgggnctgaggggccgccctgccaggcctgcgctgccgtgcttttagtgttccctgaagaatactaggaagaaatggaaatcagtgttctgaagaacggcacggactcttaggcagttccatcagcaagaacctgagtttgaagtgacaackngctgttgagaggcaaggttacagaattacagtacatcgtttgacttctgtgacaccggcattattttctggcgtgtgtgtgtgtgtgtgtggctaaggtcgtaggtaatgctaattttttaaattttyccaact

SEQ ID NO: 13000 - DNA, 359 bp, Homo sapiens
atgaggatggtcaggtgggcgatgcaacattaatactcaggaccccaagatacagaaggaaatcatgcgtgtgatcggaactcaggtttacacaaactgagggggccccagcctcgtaccacccctgttaccccaggatccatctgccctcataaaagtgttcaggtacagcagctgaggctgccctgaggaatcaaggggccattaccaaggggcaggaaaaggatatgtaagaggtggccttcatggtagagcttgacccaagaactactccacattcggatggcccagactgactccatcccctgactttccctttgacttcaccctgtttgtaaataaaacaataaaatgcaaaa

SEQ ID NO: 13001 - DNA, 325 bp, Homo sapiens
tattacgattactcaagaaatgcaaaataggccgggcgcggtggctcacgcctgtaatcccagcaatttgggaggccgaggcaggtggatcacgaggtcaggagatcaagaccatcctagctaacacggtgcaaacccatctactaaaaataaaaaatattagctgggcgtggcggcaggcgcctgtagtcccaactactcgggaggctgaggcaggagaatggcgtgaacctgggaggcggasttgcagtgagccaagatcgggccactgcactccagcctgggcgacagagggagactccgtctcaaaaaaaaaaaaaaaaag

SEQ ID NO: 13002 - DNA, 293 bp, Homo sapiens
gactacgtgttttagaactgtgctgaagacatctgtaagactattttgtgggggaaaaaagtagtttcctttaaggtaaaaagcattttatatgatccttagcacatttttaagttttatcttaagggagacgcgcacaaaagcggctgccaaaccgtttcgtcatcctcacagcaaggaccggacgcttgctagccaccccggagcactgctctccttttaatcatgtattcatctattttaaattgccggcgacgacttttgtctatttatgaagaaaccttgagaacgaa

SEQ ID NO: 13003 - DNA, 119 bp, Homo sapiens
aaacagcctgaatgtatcctttgtggtcctggcaggaaatagatggcacatctcaaggatttgactgaaaatagttgaagagtaaagctaagggggccaaaaagaaaaaaaaaaaaaaa

SEQ ID NO: 13004 - DNA, 471 bp, Homo sapiens
tacaattcatgggacttttgcagaccttcagaaatgcagataagcattgctctgctcactttgaatatcggatacatcctccttgcactttgaaaagcaaatagaatacatacatttatcaatgctgacattgatacctttctacatagctcagcaaagaatcatccaaataatacaaaattgaaaaactggaaggctaaacaaaataagccgtcttatattttacagttgaaatacttagatgtaagtgaattaagtaattctacccctatataaagtgatattttttcctcctcttaattctttctttcaggaagaagcacagataaacagaaggctaacacaatatgatttatttatttatttatttattttatttcatttttttaagaaaaggtctcactctgccacccagactggagtacagtggtgcaatcatggctcactgcaacctcaacctccagggctgaa

SEQ ID NO: 13005 - DNA, 291 bp, Homo sapiens
tatcgtcgggcacggtgactcacgcctgtggtcccggcatcttgggaggctgaggcgggtggatcatgaggtcggatcgggaccatcctggccagcatggtgaaacctgtctctgataaaggtgcaagggttatccgggtgtggtggtgtgtgcctgtggtcccggctgctcggggggctgaggcgggagagtcgcttgggcccggaaatcggaggttgcagtgagtgagctgggatcgcgccactgcactccagcctggcgacggagtgagactctgtctcaataaaaaa

SEQ ID NO: 13006 - DNA, 99 bp, Homo sapiens
gtttgatatttattttaaattgtggactagatgcataaattcacatttctgcctttcctttgcatcttctcatatattgtgtttttttttttttttccc

SEQ ID NO: 13007 - DNA, 94 bp, Homo sapiens
aaatcccagcactttgggaggccgaggtgggtggatcatgaggtcaggagatcaagaccatcctggctaacacgatgaaaccccgtctctacta

SEQ ID NO: 13008 - DNA, 346 bp, Homo sapiens
gagtaatttcagcggactctgggctggaggagtssgaattagctagtcctgtgagggcagtctctcaaggatcaaggccccagatgccagagcatcaagaatatggaaaatcagagaacatgatcaatataccagctcatccctggatgaagctccctgcctttcctcatacagacaaaaaagtgcaatcctcaattttccggcctaccttgtagctgggagctataaaatgaagttcatcaggcatkagcgggtctgctggtactgcttcttcccgcttccccttcttcttgctttagggatgggatgcgatgttttgctgctctaacagccattttgcagccat

SEQ ID NO: 13009 - DNA, 329 bp, Homo sapiens
tctactgaaattatcagacagaaaactggacgggcgtgatggcttaggtctgtaatcccagcacttttggaggctgatgtaggtggatcacttgaggtcaggagttcaagaccagcctcgccaacatggtgaatccccatctctgttgaaaatacaagaaaaattagccagccttggtggtgggcacctgtatcccaactactcaggaggctgaggcacgagaattgcttggactcaggagtcggaggttgcagtgagccatccctgcactccagcctggacgacagagcaaaactgtctcacaaaaaaagaagaaaacttagtggctg

SEQ ID NO: 13010 - DNA, 498 bp, Homo sapiens
aatgcttcttgttcatgggtttcttccgtatggagtggattaagagtgttttattttgttgttctaactgagaaaaaaaggaggcacccacaaggttgaggtcacacagtctccacagtttccaggaggcgtttgggggtggggaaggcacctccagagcatgaggctctaaggggacatgagtaaagcatgtctgtgacccagtgaggaagggagaggccagctgcactcctgcacggggttcctagctgcagaagggtcccgcctaggccgaggggaaacacctgatagcagaagaggcctggatgcacacctggcacgccgaggctctccgcccagacacagtgctccatgtcagcccctgcacctggggtgtgtgattcacgtgcacagatgccacaatcctgcaccaatatcccacagatgggggaaggtgagaggaaggggcaagtgatgtgtaactgctcaagagatgcttaaacctccatagagaggagc

SEQ ID NO: 13011 - DNA, 91 bp, Homo sapiens
tattttttatagagacaaagtctcgctgtgttgcccaggttggtcttgaactcttaggctgaaacgatcctgctgtctcagcctcccaaaa

SEQ ID NO: 13012 - DNA, 364 bp, Homo sapiens
aaaatataaattacttctacaaagtttagtgaaactgatttatggtgggtaagaaaagcaaaaatgggccgggcacagcggttcatgcctgtaatcccagcactttgggaggccaaggtgggcggatcacgaggtcagcaattcaagaccagcctggccaacatggtgaaaccccatctctactaaaaatacaaaaattagccaggcatgatggcgggcccctgtaatcccagctactccggaggctgaggcaggagaatcgcttgaacctggaaggcggaggttgcagtgagccgagaccgcaccattgcactccagcctgggcgacagagcgagactccgtctcaaaaaaaaaaaaaaaaag

SEQ ID NO: 13013 - DNA, 284 bp, Homo sapiens
aaattagtcgggcatggtgatgtgcacctgtagtcccagctgctcgggaggctgaggcaggagaatcgcttgaacccgggagacagaggttgcaacgagccaagatcgagccactgcgctccggcctgggtgacaggagactccatctcaaaaaataaaattaaaaaaaaactactacaataaattatcaccttggactgtataaaacaacttttaaactagtctttttaaaaagtacacttaaataaaaatctaaacataagagaatgcaaaaaaaaaaaaaa

SEQ ID NO: 13014 - DNA, 309 bp, Homo sapiens
ttctggatgagtgtagtggctcacgcttgtaattccagcagtttgggaggccaaggtgggagaattgbttgagcctaggagtttgagatcagcctgggcaacataactagatgctgtgtctacaaataataaaaaaattagctgagtgtcgtggcctgtgtatctggtcccacctactcgggaggctgggatgggaggattgcttgagcctaggaggtcaaggcagtagtgtgttgtgataatactaccgtactccagcctgggcaacagagtgagaccccatccctccacaaaaaaaaaaaaaaaaag

SEQ ID NO: 13015 - DNA, 443 bp, Homo sapiens
tttagtttaactaagtgaaggtctcactgctcacaagtagcagagccagaatttagaatacaggcagtatagctctctagtgtccatgttttttttcttttgagagggagtctcgctctgtcacccaggctggagtgcagcgcttgatctcagctccctgcaagctccgcctcctgagttcatgccattctcctgcctcagcctcccgcgtmstgggactacgggcgcccgccacaacgcctggctaattttttgtgtttttagtagagacgggatttcaccctgttagccaggatggtctcgatctcctgacctcgggtggatcacctgaggtcagagttcaagaccagcttggacaacatggtgaaacctgtctctactaaaaatacaaaaattagttgggtgtggcggcacatgctatagtccagctactcggggggctg

SEQ ID NO: 13016 - DNA, 508 bp, Homo sapiens
  misc_feature 436: n=a, g, c or t
cagtctagctagttttgtcagttttattgatgttatcaaagaatcaactttggttttcttgatttttctccactgtttttcgattctctatttcatttgtcttcactctaatcttgattatatccttccttctgtgagctttgggtttagtttgctcttcaagctctctggtctttactttttccttttctcattccttaaggtgtaatgttaggttactgatttaagatttttttaatatatgcatttgcaactataattttccctctcagcattgtttttgctgcatcccttaggttttagcgcggtgtaaggtgtgtgtgtgtgtgtgcacgcgcgtgtgtgtgtgcgtgtgtgtgtgtgtgtgtttctgcctttctcatgttacctcctaatttacctcatgatttctcttttgacccattggttttgtgtntgtttgtgtgagacagagtcttgctctgtcacccatgctggagtgcggtggcmaaatttcggctcactgcaa

SEQ ID NO: 13017 - DNA, 420 bp, Homo sapiens
ttttggggggataaatacctagatagatagggactgctaggtcatgtggtcagtgcacgctcaascttttasaaaactgcccagttgctttccacatggctgcaccattttgsattcccatcaacaatggataagaactccggctgggtgcagtggctcacgcctataatcccagcactttgggaggccgaggcagttggatcaactgaggtcaggagtttgagacaaggcggactaacatggtgaaacctgtctctactaaaaatacaaaaattagctgggcatggtagcatgggcctgtagtcccacctgsttgggatgctgaggcaggaggcaggagaatcacttgaacccaggaggcaaaggttgcagtgagccaagatcacaccactgcactccagcctgggagacagagcaaga

SEQ ID NO: 13018 - DNA, 487 bp, Homo sapiens
gaaaaaaatataactttcatttctgtttatatattttctagttattataaaagtacttaggtacatgaatattggtaaagttcttaaaaattgtatagaagatactcgggagcatagaagactactttaagagagcttagctttacaaatacacctaacattctcattttccttgagggatattatgcttcctgtttaaaaaacaaagttcccagccagcctcagtggctcatgctgtaatcccagcactttgagaggccaaggcggtaggatcacttgaggccaggagtttgaggccagcctgggcaacatagaccctgcctttacaaaaaaaatttttttaaaaaacatgccaccacacgcccatggccacacttattcaggaggctaaggtggcaggatcgtttgagcccaggaggtcaaggccagtgagccaagattgtgccactacaccacagctaggtgacagaggaagacctatctttaa

SEQ ID NO: 13019 - DNA, 347 bp, Homo sapiens
ctgaaagtgcagaagttggccgggcgtggtggcgggcgctgtagtcccggctactcgggaggctgaggcaggagaattgcttgaatctgtgaggtggaggttgcggtgagtggagatcgcgccactgcactccagcctgggcaacagaatgagactccgtctcaaaaataaaaaataaaaaaaaaaaagaaagatttttgttacacggttgggctcggtggctcamacctgtagtcctagcastttgggaggccgaggcgggcggatcacgaggtcaagaggttgagaccatcctggccaacgtggtgaagccctgtgtctgctgaawtttcaaaaattagctgggc

SEQ ID NO: 13020 - DNA, 435 bp, Homo sapiens
cctggcataactgataggcatgtatgggaggaccacattcctggggacagcctgggtatgtgacatggcaggtgaccaggttcccatgaatgcccgaggctgtgccatcccatgagctggggcttccctggaggtaaagagctagggtggggtggcagtgggtagaaccccagctggacagctccttccttagctctgtgattgctacagctggttctggaagccacaggcgccctcaggacaaatggggcttcttcagcacagggtagtgagtgctgagctaagcaaggacactgtcccttctctgcccaggctcgagctgtgcacctttaccctggcaattgcctgggtgctgtcctgctcctgcccttctccatcatcagcaatgaggtgctgctctccctgcctcggaactactacatccagtggstcaac

SEQ ID NO: 13021 - DNA, 250 bp, Homo sapiens
ccatttgtaaggtagatgacactttgctcctaagtagacctgcaaacaaagacaatggggtctttcctgattcctttagtttggagatgcagagaaccccacgtttctctaagtgaaatggcaagaagttatttgttagaatatggaactggtaacaaattcatgtttgcaccttgaatttgctttcacagacctggctgtattgttggacaggaataaagtaaattggagacaaaaaaaaaaaaaaaaa

SEQ ID NO: 13022 - DNA, 311 bp, Homo sapiens
tttttctagggttgttacgaagctgcaggaggaaaatgaaatggaggaggaggaggaggaaaaagaaatggaggaggaaaaagaaacaggaggaggaaaaagaaacggaggaggaagaggaggaggaggacaaagaaacagccaggccggacgtggtggctcacccctgtagtcccagctgctcgggaggctgaggcagaagaatcgcttcaacccgggaggcagagtttgcgtgagccgagatcgtgccactgcattccagcctggagacagagtgagactccatctcatctcaaaaaaaaaaaaaaaaa

SEQ ID NO: 13023 - DNA, 528 bp, Homo sapiens
cttcactccagccccccgcgtccgagagacttagcagggcgtcaaactggagagcggaaggatggaaccttttattctcaggtggagaggattaagctttgcgtgttagcagaaaatgatcgagctccagaaaatgatttggagtctgcaggtgtacccagcagctccgaagagacagcgaccatcgagaacaagccatgatgatgatggtggtttgtcgaaaaggaaatggggaaatgtggggaaaagagagatcagactgttactgtgtctgtgtagaaagaagtagacataagagactccattttgttctgtactaagaaaaattattctgccttgagatgctgttaatctgtaaccctacccccaaccctgtgctccctgaaacacgtgctgtgtcaactcagggttaaatggattaagggctgtgcaggatgtgctttgttaaacaaatgcttgaaggcagcatgcttgttaagagtcatcatcactccctaatctcaagtaccagagacaatacgctgcgga

SEQ ID NO: 13024 - DNA, 304 bp, Homo sapiens
taaaaatacaaaaattagccaggcatggtggcgtgtgccagtaatcccagctacttgggaggctgaggcgcgagaatcgcttgaaccctggagatggaggttgcagtgagcagagatcgcaccactgcactccagcctgggcaagagtgagactgtgtctcaaaaggaaaaaaaaaaaattaaaaatgttgctggtattacatcaaacctactctggataaattttccagtagggcatctgaaattgctttggcaaaagcaaaacaggttatcaatacaccaaggacatcaagtagttttaatg

SEQ ID NO: 13025 - DNA, 435 bp, Homo sapiens
catcttctccattctcctttgttttattcacacttagcagcttctagccaacctgtgtaggaaccgttcgttatctatttactgtgatataaggagcttgtgccagaatgtaaaccagtgccccctgcttcctgcattaagatagccttgcaagacaaaaagtgcgagctgagtcgaacggcacgcttggtgcatagttgatctacattgtggtgctgcgtccttattttgtcaccaactggtcacaaagtgtggattgtcagtgtctcataggccacatgtcaagtggcatggtctaaacacactctaaaatttacttattttgggctgggtgcggtggcttgtgcctgtaatcccagccctttggagtccaaggtgggtagatcacttgaggccaggagctcgagaccagcctggccaacctggtgaaacctg

SEQ ID NO: 13026 - DNA, 268 bp, Homo sapiens
cattttagaaggatctatttggaaggatccatttggaaggattgcttgagcccaggagttcgagactagcctgggcgatgtgatgagacactgtatttacaaaaatacaaaaaaattaaccaggtgtggtgacatgtgcctgtagtcccagctattcgagagcctgaggtaggaggatcacttaagcctagggaggccaaggctgcagtgagccgagattgcaccattgctctgcagccagcctgggtgacagagtgagaccgtgtaa

SEQ ID NO: 13027 - DNA, 484 bp, Homo sapiens
aatactgggctgagtttgtggcgcgcttagtgatgggatggccctgtgcaggacgccgacacgaaaagatgaagagttcaatccgtgctgtctgaactcacagtgtagcaggcgagatagacgggaagatcggtagggtgggagatgccggaaaggcttcccgtgagactggataagaaatcaaaaatctggtgaaattgccggcaagagggagttaaggacattccaggcagaggcaagttggtccttgctggctgatccagcttccccgtcagcatatggtgagcagttcggtgagaggaccacacttccaatactggcagatgaagccagatactcctctatgaagttaaatgactggttcagtgttaacactgctagtgagcgacagagatggaatttgaacgcacacctgtctgactccacctcgtgttccttccacatggccagcaagctctgctgtcccacctcgcacttcttggga

SEQ ID NO: 13028 - DNA, 498 bp, Homo sapiens
aaatacaaccctcccatcacagtcagacgggcacaaaacttcaaccagccgtttctctgcctggaagcggcgaacatgtaacctggacgggaggctggatggggacacataccatgagtgacatcttaccagagggtggccatgaacttcatcatgttccacaactgttaatgaccactggcgctggccctgctgctctctgaactcctctctatggaactgtgccccttctctgggaagagtccttgaagctctactgagaatgaaacctcttctttcagctcatgtcaatcttgaatcttgctctgttgcccaggctggagtgcagtggtgtgatctcggctcactacaacctccatctccaggattcaagcgattctcctgcctctcagcctcctgagtagctgggattacaggtgtgtgccaccatgcccggctaatttttttgtacttttagtagagacggggtttcacatgttggtcagcctggtttcaact

SEQ ID NO: 13029 - DNA, 386 bp, Homo sapiens
  misc_feature 311: n=a, g, c or t
caacactatttcattaagttcttgataatatgtagtcttctgtgtgcaaggaaagaaataaataacacatttatttgctgaatgagttttaaggtgtgcaagttgtagtgatgtttttcccacacaggattctatacacttataccatcttaaatctggcattttttttttcagatagcttctactgacaaacacaaagcttgtttgtgtgcaaatataaggctaawtaaatggtgcyaaagtgtattatgactgtcagataaaatcaggcaaaattttgtggtgctyaaatgaatttttbcattgatttnattgawcagtgcattgaacagtgtttattatycacaagttgtctttwattagtaaatcaaggcctcatagcacat

SEQ ID NO: 13030 - DNA, 445 bp, Homo sapiens
ctttttttctcctgctctaggcccagcgccttggacgtgcacagtagatccctcccggcttcccggcttcccgtctcgtcaccctctgctcagaacctgaggacgcagccatggagctggtcttgaactcttgaccttgagtgatcccctcacctcagcctcccaaagcctcagcctcttacagtgttgggattacaggcatgagacactgtggcccgggatgattttcagtcacagttttttgttacgagtggaaaatgcgtatttataaaaatgaaatagtacagacatgaacgtgtagaagtctctataatcctgccatccaaggatggcacctgttaacgtgtatatcagggatgtccaatcttttggcctccctgcaccacactggaagaagaagaatcgccttgggccacacataaaatacactaatgctagcaatagc

SEQ ID NO: 13031 - DNA, 433 bp, Homo sapiens
gagttccctgttgcccttggtctcggggtcgctgtcggcgctgaggctgcagagatgtgaccgagtgaccgcccgctaaccggactggagagaagaccggcccggatcccacgcctggcctgaagcagggaagacgctgcctcccctccgcgagcagcttacattcgtccaagttccagccttctgtcttctcgctaacctcgctcttttccaaatcgcaaatcctcttgagccgacaccgttgcgcctaaatgatgcgcttacccttttactttgcttttttatttttgagacagagattcactcttgtcacccaggctggagtgcaatggtgcaatctcggctcactccaacctccgcctcccgggttcaagcgattctcccgtcccggctactcgggaggctgaggcaggagaatggcgtgaacccggga

SEQ ID NO: 13032 - DNA, 64 bp, Homo sapiens
gagtaatmcmggaaggacagggagagaggggtggmmgtgggtggggtggggtggggtggaaggg

SEQ ID NO: 13033 - DNA, 336 bp, Homo sapiens
tttatatttttaaaatgttctttgaattatgtttttattgtacatttcttcagactgaaaagtatgtacatatctttgttatttttgcacaattttgtcttgttcggtttcagaggtctgttgttttttataatttattttgagttgtaaaacttgcaggagtaaaaacaaaaaacaaaatctccacaacaaaataaccctctgatttataaactcttatagtcaaagagggaaaacaaaggttgagagattaagtggctgcttctgagaaataatgtctcaaggactaaaggagcaattcaataggtttagacattgtagctctctacatcttga

SEQ ID NO: 13034 - DNA, 524 bp, Homo sapiens
aaccttaaatagatgtaatttctatttgtcaatgatgcctcagcaaagctagggagaaaataaaaaggatccttctgtgcaacagcccgcatgtccattaccgatgactggataaagaaaacgtgctccacccatgcagtggaatactacgcagccataaaacggaatgaagctcggatccaagctagaacgtaggtgagccttggaaacgtggcgctgagtgagagaagctggacacaaaataaggccaggaatggtggctcacagccgtaatcccagcactttacgaggccaagatgggcagatcacttgagtccaggagtttgaggccagcctgggcaacatgacgaaatcctgcctctacaaaaaatacaaaagttagccaggagttcatttagaggagtcatgtgactatagtcccagctactcaggaggctgagatgggagaatcacttgagcctgggaggtggaggttacagtgagccgagattgggccacggcactccagcctgggcaacagagtg

SEQ ID NO: 13035 - DNA, 330 bp, Homo sapiens
gatcaataaagaactgtaagtgtgttatgatctagaaaagtgtttctttttttttttagatggagcstgggcaasaagrgsgaaactcsgtgtcaaaaaaaagaagagagagaaaavcagacactggggactactagaagcaggagagaggaaggaggacaggggctgaaacactacctattgggtactatgctcagtacccaataggcagtggaattaataagagtagaagttaaagatcctgggtgatggggtctttcatacctcaarcctcagtgtcatgtaataaactcatgtaaacaaacctgcacacataccccttaaatctaa

SEQ ID NO: 13036 - DNA, 315 bp, Homo sapiens
  misc_feature 31: n=a, g, c or t
acactcgcacaaacacacactcgtacactcnygctcttctctctytccggcttgctctsccacgcaagcggaatgcagcagcgcctggagagcgtgtctcggaccgccgcctgaatgtacctcgctcccgggagccggacgsccataggcgcactggaggacgctccgctgcgggacctggacagttttttgasggtgcagtcttgctatatggtgtgagaaatggctgtaggraacaacactcaacgaattattccatcatcccgtgttttatatttgttgagcttgtcatcatggctggggacattgctgctt

SEQ ID NO: 13037 - DNA, 483 bp, Homo sapiens
agtttggaggtttctcaaagaacacagaactatcattcaatccagcaatcttgttactaggtgtatatcyaaaggaaaagaaattgttataacaaaaagacacatgcactcatatattcattgcagtactatttgctatagcaaagagatgaagtcaacctaggtgcgcatcagtggtggatttggtaaagaaaatggtacatatacaccatggaataatgtacagccataaaagagaacaaaacaggccgggcacagtggctcacatctgtaatttcagcactttgggaggctgaggcaggtggatcacctgaggtcaggagttcaagacaagcctggccaacatggcaaaagccccgtctctactaagaatacaaaaaacattagctgggcatggtggtgmgcacctgtactcccaactactcgggaggcaggcatgagaatcacttgaacccaggaggcagaggttgcagtgagcgaaat

SEQ ID NO: 13038 - DNA, 462 bp, Homo sapiens
acaatgcagttcgcggcgscggacatggcggtggagtcctgagctagtcgtgtcccggcctccagcggcggcasggcgacggcggcggcagcagggaggcggagggagagcaggagccactgagatgaggaggcgtcgcgcgcgcctgtagctcgcgggcctcgcagtttgcttgcctaaactggacttgaagcaatttaaactactggagatctgccattttataatatcacaattggaaagaaacagattttcaaataatggaagagtctaaaaccttaaaaagtgaaaatcatgaccaaagaagaatgttatttgtgaagaaagcaaagcagttcaagttataggtaatcaaacattgaaaactagaaatgataaatccgtaaaagaaaattggagaacagctctccaaataggaatagtagtaaaaaaaaataagcaaaatgatatttgtatagaaaa

SEQ ID NO: 13039 - DNA, 456 bp, Homo sapiens
aaggatacatcttgtaattataactgggggtatttcttttttcttcgtgatttcattaaaaagatggggggtcttaaaattgatggcttcttaaattgtacaaaataagagtgttagctaccattagctgtcaggctgatgtttttcaagaaaagatacaaatttgaagctgagctctgtgttgcatgcgtgtagtcccagctacttgttagactgaggtgggaaaattgcttgagctcaggagttcaaggatatagtgagctatgaatagtgccactgcactccagcctgtacagcagagcaagaagatcctggctctaaaaaaagaacagtgaagaaaacatagaaatctggatttttaaatgctggcttaaaatttattttaaatgctgtatgagtcaaatagatttttcaaataatatagtaaatataatacattattattattattattat

SEQ ID NO: 13040 - DNA, 468 bp, Homo sapiens
  misc_feature 444: n=a, g, c or t
cattcaaaatgtgttttgtgttatgatcttaccatttctttcaaatgttcctagcagcctgcattatttataatgttctgtattcctggtttaggtaagtccagaggtgagagctggtattaggraaatgacatagtaaggcatttgttttcagtaatggcagcatccgtttgacctcctttcccatttggaagggctttctccatcctaaagctcctgtagacttggtgctcttttttttttwaggattcatacsagttgaagastttcaaagcsttsagtgtaactggttatgttcttactagaaaagtatttagggccaggcgcagtggctcgtgcctgcaatcccagcaccttgggaggccgaggcaagtggatcacttgaggtcaggagttcgagatcagcctggctaacatggtgaaacactgtctctacgaaaagtncaaaaattagccagtcggggtggt

SEQ ID NO: 13041 - DNA, 442 bp, Homo sapiens
cacactttgttctaccatattaatcaaatgtgaatatgtaatttgtgttttgagttaacccttaaataaaaaggaatgtgccccccgtccaacactgacatcatctgagtgttacattcgtgtcagattatcagtggcagtgtaatgtgttaaaacacagacttgagctccaggaatgcctagatttcaattcctggccctgtctcttaataattatgtgatcttgtgcaagtcctgagcctcagtttccttaacttgaaaattgggataatagtatctatcttggagttggtatgaaaattaaacacaatttggctgggcacggtggcccacgcctgtaatcacagcactttgggaggccaaggcgggtggatcatctgaggtcaagagttcgagaccagcctggccaacatggtgaaacctgcctctattaagatacaaa

SEQ ID NO: 13042 - DNA, 486 bp, Homo sapiens
tccgatatatgggagagtgtcttgtcttctatctgattctgctttcaacttgactccttctgattgatcctgcacaggggtcatgcataattaaaaggtcactttagcttcagaatgcagttagtccagggaggtacctgtaggcttgagctttctttgaatctgataagagaactctttggcctcatgctcgtagtaggatctgcagaggcctgtgaagtgtccaatgatgagtcattccatggttatacagtcaagccctgactgttgttctttatcatgatttttatgcctgagaataccttctaaaaatatcacatgataataggtaacatatacgcctgtagtcccgacactttgagaggccaaggagggtggatcgcttgagcccaggggtttgagaccagcctgggcaatatggtgaaaccccatttttacaaaaaatacaaaaattggctgggcatggtggcacacacttgcaatccc

SEQ ID NO: 13043 - DNA, 127 bp, Homo sapiens
ttatttgagcgtggtggtggatgcatgtaatcccagctactcgggaggctgaggcaggagaatcgcttgaacttgggaggcagagattacagtggagccaagattgtgccactgcactgcattccag

SEQ ID NO: 13044 - DNA, 306 bp, Homo sapiens
tttcagtttagtaagttctaactataaattcatcttgcaatacttaacacattcaaaagagaaaaaatgataagccagtagtaattaattttatcacaaccaaatcctcaaaatgatgacagggcaaataaaacagtggctaatgatagaccacctttcaaatacaggaaatataaaccccaagaaaagaaaaagttcaatttctccactttaaacaactaacttcagatatacttgaactggtaccttttaaakacagagggattagtttcattacttactgctactttcatctccatacttgta

SEQ ID NO: 13045 - DNA, 413 bp, Homo sapiens
  misc_feature 382: n=a, g, c or t
attgtattttttagtggagatggggtttcaccgtgttggccgggatgatcttgatctcctgacctcgtggtccgcccgcctcagcctcccaaagtactgggattacaggcgtgagcaccgtgcccaaccatttgtcattttttattgtgggtacactagtgggtgttaagtcatatctgcttgtggttttgattttgcattttcttgatggcttgtgatgttaggcttttcttcaagcacttattggatgctcttatatcttcttcacaaaaatgtctatttaaatattttgcctatttttatgtattttttctttttgttgttgagttgtaaaagttatttgtgcattttggatacagatttctaatcaaatatataagtngcaaacattttcaaaaaaaaaaaaaaaaagg

SEQ ID NO: 13046 - DNA, 309 bp, Homo sapiens
atgggacatagtcttaaaaatgtctgaaacaggctgggcatggtggctcacacctgtattcccagcagtttgggaggctgaggtgggtggatcacgaggtcaggagaccgagaccatcctgaccaacacggtgaaacctcgtctctactaaaaatgcaaaaattggctgggcatggtggtgtgcacctgtagtctcagctacttgggaggctgaggcaggagagtcatttgaacccgggaggcggaggttgcagtgagccgagataggccactgcactccagcctggcagcagagtggagactccatct

SEQ ID NO: 13047 - DNA, 109 bp, Homo sapiens
agttaagtcacttgcaatcatttggatccgtctgcgctttgcttttcagctttgtgagggtgggtccggagaagcctttggtttcgggataactttctcccctcgtaac

SEQ ID NO: 13048 - DNA, 152 bp, Homo sapiens
caaaaatgtaacaggtacacaaagaggaagtggggaaaaaggcaaaatgagagtctgattcccaggcatgtgcagcgcccattgggacataacggcagtgcggcgcgasagaggaatgggctggaaccggatctgtttccagacgcagaagc

SEQ ID NO: 13049 - DNA, 396 bp, Homo sapiens
  misc_feature 254: n=a, g, c or t
aaaatggcgatgctaccacctagaactggattgtgcgctccatttctttcacctcaaagctggccgccaccgctgccacctgctcagagtgaaataatgaaggtggtcaacctgaagcaagccattttgcaagcctggaagagcgctggagtgactaccaatgggcaatcaacatgaagaaattctttcctaaaggdgccacctgggatattctcaacctggcagakgcgttactagagcwggccatgattggncatcccccaatcctctcatcttgtmctacctgaagtatgccattagttcccaggtaagcttcccgcaaacccccaccaagaagtgagagttctgggggtaaaaaacttggagtgcatttgggcmccggtggttcatggctgt

SEQ ID NO: 13050 - DNA, 438 bp, Homo sapiens
tttatatcggtcccggaagacatagatgctcccgttacagctggcaatcttccagagggatggggcagagctccaggcctcaggaaggcaaagcggtgaagctgtctagcgagggattgtagcacacagggagtccccttcagccacgatgaacaccagatctttatgcacagctgcgtgcatgcggcctgcaaaggcagcacatagggcttcacatggcatttgtctgtctctgtgtcaaagcactggatgagtcgggaaggtttggtaaagaagtccagatcattctcctccccccctagtaagtagatgatcccgttgaggttggcaccagcagcccctgacacagccacctctagctgagttgtctctgtccacacattatcacctacgcgataataaatgactgcgttggagagggcaaaaaaaaaaaaaaaa

SEQ ID NO: 13051 - DNA, 179 bp, Homo sapiens
aaaaatacaaaaaattagccgggcatggtggcgggtgcctgtagtcccagctacttgggaggstgaggcaggagaatggcgtgaacctaggaggcggasttgcagtgagctgagattgcgccactgcactctagcctaggtgacacagcgagactccgtcaaaacaaaaaaaaaaaaaa

SEQ ID NO: 13052 - DNA, 425 bp, Homo sapiens
ttgaaggagttaaggtctgtggaatcaaagcatgagacaacatgcaaggaccaggttggtttccatttaacagccaacctaatctaactgaaaggattgagaggtttgtcttttttggaaagtgttaaggttcttccaagtaaccagcaatgtgactttaccacactgttcattaacggggctttggatggccaccatgtctgctgctggctgagtccaaaactgcggtcactctctccagcaagctcatggagggttacgtcatcttcactcagccagcccaacgctttttccatctgctaaaatgtagaacatggttgttgattctactctttctacaaagaaagagagggaacatggatgagttgctgcttttaaagattatatgttaattgctgttttaaaaatctgctcagctaagcacg

SEQ ID NO: 13053 - DNA, 204 bp, Homo sapiens
  misc_feature 52: n=a, g, c or t
tgtttaatgccatttattttttaagatgggatatatattttaattagctggnmgtcgtggcgggtgcctgtggtcccagctactcaggaggctgaggcaggggaatgccgtgaacccggaggcagagcttgcagtgaaccgagatcacaccactgcactccagcctgggcgaccgagtgagactccatcgcaaaaaaaaaaaaa

SEQ ID NO: 13054 - DNA, 381 bp, Homo sapiens
tatacgtgtagatagaaatacagatacagcatacaaacatactatatgtatttagaaaacacatatgtttacatatgtaattaagaaaaaataggccgggtgcggtggctcatgcctgtaatcccagcactttgggaggccaaggtgggcggatcacctgagatcgggagttcaaaacccgcctggcccaacatggtgaaaccctgtctctactaaaaaatacagtaattagctgggcgtggtggtgcatgtctgtaatcccagctactccggaggctgaggcaggagaatcacttgaacctgggaggtggaggttgcagtaagccaagattgcgccattgtcactccagcctgggcaacaagagcgaaactccatcccat

SEQ ID NO: 13055 - DNA, 178 bp, Homo sapiens
tacctaaagtcatcattagaaagtcagagcaacggctgggcgtggtggcgcaggcctgtaatcccaacactttgggaggccaaggcgggcggatcacctgaggtcaggagttcaagaccagcccggccaacatggtgaaaccccgtctctactaaaaatacaaaaaaaaaaaaawtta

SEQ ID NO: 13056 - DNA, 542 bp, Homo sapiens
atctctttaagataggatactgttacagttctgacttaaaatgtgaggcttggctccagactccatgatgatccttataaaataaagtggagaggctttgtggatttataaatgcatcttttccataaagtatagcatttcacgtgcataacttaaaatagtctgaaatgatattagtatcattgctaagggatttaagaatcgaaaatattttaaagtaaattaggtagcctaccaaataggattttcttgtcctcattttgattattaaatctcaaagaaactcaaagcaaaaaaataagttacttttttatatttgaagatggggattttcctctgtttgtgtggagtcttttttaggatctgccaaatgttgatgctctcttctctggactatttctttttataaccatgggaaggctattttagaccaccgagagacagagcctgtctaaagattttagttgccctttcttcatatcaaatgaaatgtccatcaatattcttatctcaacccactctgcttcagcgttctacctgaa

SEQ ID NO: 13057 - DNA, 448 bp, Homo sapiens
  misc_feature 432,443: n=a, g, c or t
aagggtggctttagaggctcagtccccgcgacgccgcgctggttggtgctcctgcgccggagagttctgcgtctcggggtggtgactgggtccagaatggcttcggattcggggaacaggggaccctctgcacgttggagttcgcggtgcagatgacctgtcagagctgtgtggacgcggtgcgcaaatccctgcaaggtggcaggtgtccaggatgtggaggtgcacttggaggaccagatggtcttggtacacaccactctacccagccaggaggtgcaggctctcctggaagcacggggcggcaggcggtactcaagggcatgggcagcggccagttgcgtgagtgaccactgtggccttggccctctcggagggaggtggctcagagctggtacaaatctaatcataggattctcaggctctgggttngagtggctttnaggaa

SEQ ID NO: 13058 - DNA, 219 bp, Homo sapiens; identical to SEQ ID NO: 12704

SEQ ID NO: 13059 - DNA, 192 bp, Homo sapiens
ccagatttagctttcaaggtgcgtgcatgttgaatgatccagaagcaacgaaaactctggggtgagggattgaaaaaatctgaaatcacagttggatttttaaattcaaccatcaaaaatatgtactatcagtttttttttacattgatgtgaaataagcaaattttcatgataattaatgckgcaaaattt

SEQ ID NO: 13060 - DNA, 294 bp, Homo sapiens; identical to SEQ ID NO: 11407

SEQ ID NO: 13061 - DNA, 430 bp, Homo sapiens
aaatgaaggagaaatacataggtaaaaaattaaaactgggaaaaaaaagtttggcagaaaagatctaatatagatatataataggatcttcccaccccgcccccagaaagaaaaccaaaataaaggaatagcttaaatactgacaagtggccgggtacgtggctcacacctgtaatcccagcagtttgggaggccgaggggggcagatcacgaggtcaggagatcgagaccatcctgactaacatgttgaaaccctgtctctactaaaaatacaaaaaattagccaggcatggtggcgggcgcctgtagtcctagctactcgggaggctgtgaggcaggagaatggcgtgaacccgggaggtggagcttgcagtgagctgagatcgcgccactgcactccagcctggggacagagtgagactccgtccca

SEQ ID NO: 13062 - DNA, 341 bp, Homo sapiens
gtttgaatcttggaattaaaaagagggcaggggctgggcgcggtggctcactcctgtaatcccagcactttgggaggccgaggcgggcggatcacaaggtcgggagttcaagaccagcctggccagtgtggcgaaaacccgtatctactgaaaatacaaaaaacaaaattagccaggcgtggtggcacgcgcctgtagtcccagctacttgggagactgaggcagaagaatcgcttgaacctgggaggcggaggttgcagtgagccgggatcgcgccactgcactccagcctgggagacagagcgagactccgtctcaaaaagtaaaaaaaaaaaaaaaaa

SEQ ID NO: 13063 - DNA, 381 bp, Homo sapiens
tcttatttttgccttttcttttgcttttaaaaaaaacttttgagtcaaagttcatatactttaatattaagaattttcttttggctgggtatggtggcttgcgcctgtggtcccagcactttgggaggctgaagcaggcagattgcttgagcccgggggttcgaggtcagcctgggcagcgtggtgagactccgtctctaaaaaaaaaagttaaaaaattggctgggtgtggtggcggacgctgtggtcccggctgctcggggggctggggtggggattgcttgagtctgggaggtcgagtctgcggtgggccgtggtcgtgccgctgcactccagcttgggtgacaagctggartctctttgggtctcaaaaaaaaaaaa

SEQ ID NO: 13064 - DNA, 442 bp, Homo sapiens
ttgaaaaaaaaaataggaaaatgaacatgttctcctcagtttttctttgtcttaatttggccaacttacattagtagtaactttgtcctttatggtagccgatatcaacactaaaaaaggactgtgccctccatagcgtcatgactacctttgcccaaccttttcaccaacctctggacctattgagagacatggtccaaggtacaacacattctaaatagagaattttctcagcagtcaggtatgttctataaataaatctggacgatgaatcttctgctttgagactttaaagcagccctggaggccgggcttggtggctcatgcccgtaatcccagcactttgcgaggccaaggcgggcggatcgctgaggttgggagttcgagaccagcctggccaacatgatgaaaccccatctctactaaaaatacaaaattagcc

SEQ ID NO: 13065 - DNA, 295 bp, Homo sapiens
tgtctactcactgggcacggtggctcacacctgtaatcccagcactttgggaggctgaggcaggtggatcacctgaggtcaggagtttgagaccagcctgaccaacatggtgaaacccgtctctactaaaaatgcagaaattaggtgggcgcctgtaatcccagctacttgggaggctgaggcgagataatcgcttgaacctgggaggcagaggttgcagtgagccgagattgcaccactgtcgtccagcctgggtgataagagtgaaactccatctcaaaaaaaaaaaaaaaaa

SEQ ID NO: 13066 - DNA, 492 bp, Homo sapiens
  misc_feature 26: n=a, g, c or t
tttttattggtcttgtggtctttttnssccccctttcccctccctccttgaaggctaccccttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattagtgtaagaaattcttggattatgtgtttaagtcctgtaatgcaggcctgtaagtggagggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttcccttctgtgtct

SEQ ID NO: 13067 - DNA, 500 bp, Homo sapiens
aaaggtagaaacagctgatcacaatggttcactcctgtaatcccaacactttgggaggtcgaagtgggaggattgcttgagcacaggagttcaagaccagcctggacaacatagtgagacatggtctctgcaaaaaaatagaaaaatcagcagggtgtggtggcatgcacgtatactcccagctactcaggaagttgagtgagaggattgcctgagcccaggagtacaagactgctgtgagctatgatcatgccactatactccagcctgcgcaacagagagaccctgtctggaggggtggggggagaaaaaaacaccatagaaacaacccaaatgtccaataacaaattgtagtccatccatacaatggactactactcagccatgaaaaggaatacagcactcacatatgctgcatgtgaatgaaccctggaagcattatgctcagtgtaagaacccagacataaaaggtcacacattttatgattccacctatatga

SEQ ID NO: 13068 - DNA, 353 bp, Homo sapiens
atttatggattttttctcttgttcaggggcttctttcctgtcgttgttggctttattagaagagtgccagtccttggatccctcctaaatttacctggaattagatcagtaagtaatcatgtatattttaggccaacaaaatacgtattttgatgctttttacttctagaaatttgagtaattgatacttggttaattgctgagttttgtattatgatatagttacttcacatagatcatgagtaccatgaagaccaaaaaataattattgctaaacctataaaatgtgaaattttgttttaccgtatccatttctggatccatattctctattttttaaatgttactcagat

SEQ ID NO: 13069 - DNA, 53 bp, Homo sapiens
ctttcygstcscaggggcgttgggaacgkttgtaggasgtggctctytattcg

SEQ ID NO: 13070 - DNA, 292 bp, Homo sapiens
cttttttaagactttctggctgggtgctgtggctcatgactgtaatcccagcactttgagaggccaaggagggcagatcaaggtcaggagtttgagaccggcctggccaacatggtgaaaccccgtctctactgaaaatgcaaaggttggccgggcatggtggcaggtgcctgtagtcacagctgctcgaggctgaggcaggagaattgcttgaacctggggggcggaggttgcagtgagctgagatcgcgggcaacagagcgagactttgtcacaaaaaaaaaaaaaaaaa

SEQ ID NO: 13071 - DNA, 434 bp, Homo sapiens
cataggaaaaacttgtaatctgagtgccagcatgactatccccctaaatataccccccagacatgatacatgtagtaagtggataaacacctccacgatggtgctattagctgaaaatataaacaaaccagcagatcctcactttaagtagcacaatgactcttgaaggcgtcataaaactatgacagtaaacgtagtaaaagaattgtgtataacattttacatgtaacattacctcacatcattctcccattatttctattgtaatttaaaagagtactttggtttcagagaataaaaatcatgcttaatgattttgactgtttaaggaaagattttaaaaaggttattaacagagctgagtgcatcacattttctcccgaagactacagtgaaaattttcctcaataaaatattgactagctgtggccaaa

SEQ ID NO: 13072 - DNA, 361 bp, Homo sapiens
agaggaatagcaaaaacaaatttttaaggtaaaactataaattttcttttgaaattgtacatattcgttggactcaatagtcatcttctcttactggaactaactaagagttagtccctgtgactgcttacaaggcagagccaggtaattgatgcgtcagaaacctagctgttgaaccactgtgtgaatctttaggccatgaggcttaattctaattttaagcagatttggctcttataaatcctaaagagttataaagccttgagttattttcttgaaaatatctgataattcaatttataatttattcttaacactctctttaaaaaaaaaagaaagaaaacttaaagtataataataa

SEQ ID NO: 13073 - DNA, 469 bp, Homo sapiens
  misc_feature 341: n=a, g, c or t
tcaagtttgggaacagaaaatgggattgcttggtacaagaggcattttacaggcagaaccatcaggcttgtggaatgcttccatccagctggaccattgattctcattagaatcgcctgtgctgagaggcctaggcccaccctggccacaccgattcagggagtagggctggggttccataggtaatctcattgtgcagcaagggtggggaatcattgagccaggtactaggccagccagtggggatgaaacaacggttagctgtgtgagactcagccctttggaggctcacaatgtacaggggaagaaaagagaagggaagatcgctataaaggcactgntattattgtagtgacgaagaaaatggttaggcccatgtatgtattcctcatagttttaggatttcccatgtaaaatgagaaatctttgagttggaatcctgacacaggaggcagcaggctctgaagta

SEQ ID NO: 13074 - DNA, 295 bp, Homo sapiens
cattttagaaggatctatttggaaggatccatttggaaggattgcttgagcccaggagttcgagactagcctgggcgatgtgatgagacactgtatttacaaaaatacaaaaaaattaaccaggtgtggtgacatgtgcctgtagtcccagctattcgagagcctgaggtaggaggatcacttaagcctagggaggccaaggctgcagtgagccgagattgcaccattgctctgcagccagcctgggtgacagagtgagaccgtgtaacaaaaaacaacaaaaaaaaaaaaaaaa

SEQ ID NO: 13075 - DNA, 134 bp, Homo sapiens
ctttttttttctgttttgggtgtactctaggggccaggttgggagggggaaggtgagggcttcgggtggtgctataatgtggcactggatcttgagtaataaatttgctgtggtttgcaaaaaaaaaaaaaaaa

SEQ ID NO: 13076 - DNA, 390 bp, Homo sapiens
  misc_feature 382: n=a, g, c or t
gcagtttgttcgaaataataataccagcaatgtattcagtgattaccttatgaataagtgaaatacatgacaacaatgttataaagaatgaggctgggcgtggtggcttatgcctgtgatcccagcactttgggaggctgaggtgggcagatcataaggtcaagagttcaaggccatcctggcaacatggtgaaacccgtctctactaaaaatacaaaaattggctggacatggtgtcatgcgcctgtaatcccagctactcaggaggctgaggcaggagaatcgcttgaacccaggaagcagaggttgcagtgagccaaaatcacaccattgcactccagcctgggtgacctcttgtcaaaaacaaaaacaaaaaaraaangawtggga

SEQ ID NO: 13077 - DNA, 82 bp, Homo sapiens
ctcttstgaggatccggyaakatggcagaagtagagcagcagaagawgcggaccttccgmaagttcacstatcgcggmgtgg

SEQ ID NO: 13078 - DNA, 506 bp, Homo sapiens
taggcatagttcccggagccttgcttaaccagcctgtctcttacatattcctccctgaccttactgcttagagttaagcaatttcttctgctctctgttcccctgggatctcctgaatgcccctgttccagcacttgtcacatttcggtgaattttttattcatttaacagtatttcccaatagagtattacctcaggaaggcagaaacgtggctttcttcatgtctttatcctcggggcctggcacagagtaaggtcttaatacatttctgtgaaatgaatgaataaaatttgcttggaagcattaaaaatacccacagaatttgaagaagagaaggaaaaaaaagtactgtatttaaatatattttaagtaaaatttcggtgatgagtggaaaggaattagaaagctgtgtttctttaaatgatgtgagcaatggccaaagagaatgacagtcatttaattttctaacaacttaagaaaatgtttttcattcattgaaattaat

SEQ ID NO: 13079 - DNA, 72 bp, Homo sapiens
ttatttaatattttgaagcaagtgaactgattctctagggtctcactccatcaccctgtctggagtacagtg

SEQ ID NO: 13080 - DNA, 438 bp, Homo sapiens
  misc_feature 130: n=a, g, c or t
attattattattgttattactattttgtagaaacggggttttgccatgttgtccaagctagtctcaatctcctgagctcaggcaagtcgcctgtctcagcctcccaaagtgctgggattacaggcgtganaccatgcccgtccccagactctcttaaataaccagatctcctgtgaactaactgagtgggaactcactcatcaacaaggggatggtgctaaccattcatgagtggttgacccccttgatccaatacstcccaccaggctctaccccgtctctactaaaaatacaaaaaattagccgggtatggtggcgggcgcttgtagtcccagctacttgggaggctgaggtgggagaatggcgtggacccgggaggcagagcttgtagtgagccgagatcgcgccactgcactccagcttgggggacagagtgag

SEQ ID NO: 13081 - DNA, 190 bp, Homo sapiens
tgaactatcaaacttaggagccatctagcttacacgtgttccttaaaaagtttgctgtaggccgggcacagtggctcgtacctgtagtcccagcacttttgggagcccagggtgggggatcacttgagctcaggagttcaagaccagcctgggcaacatggcaaaacgccatctctacaaaaatacaaaa

SEQ ID NO: 13082 - DNA, 320 bp, Homo sapiens
cataaaacttcagtcagtgttagcttctagtagtactttctgcttctccaatagaagtgggtaagaataggtaaccttgccacattggtatttcttagccttaattttcagtcttctagtgtttattcctctttccttaaacccgtccctgatcacactcctctctctgccctgatagsttgactgtagtagactctgatggagctaccaactctactactgcaaacctgacagtgaacaaagctgtggattacccccctgtggccaacgcaggccccaaccaagtgatcaccctgccccaaaactccatcaccctcttt

SEQ ID NO: 13083 - DNA, 400 bp, Homo sapiens; identical to SEQ ID NO: 12874

SEQ ID NO: 13084 - DNA, 59 bp, Homo sapiens
aaaaaaaaaaaaaaaaaaaaaaaaaaaaaaaaaaaaaaaaaaaaaaaaaaaaaaaaaaa

SEQ ID NO: 13085 - DNA, 458 bp, Homo sapiens
attttctgtttttaaattgtatttcatctgcttcctccccattctctcactttaagtgacattgaggaaggtattctgtcccacaggtttctgtgacagcgatacagcaggagtcagtgaaatcaactggggagctcacttgagctcttgataagaaatgtggagaaaagtaaaaaccaagctttgaagaaacagaagaaattaatcttttagttagttgaacataccaaagcagaggactggaatctgtttgttctaaccaacccgttctccctggcttggcacgtgccgtgagagcgcasttgccggaggagggccgctgtgtgcgcctcacatctggctcccagtggaaacttttactcctcctcatccgcagatgtgatagaactgaagtatctaggaattctgcctttgtcatttgttttaatttgtgtgccctgttcattttttttgtcttt

SEQ ID NO: 13086 - DNA, 207 bp, Homo sapiens
  misc_feature 64: n=a, g, c or t
cagggaaacctcatctctactaaaaatacaaaaaattagctgggcatggtggcgggtgcctgtngtcccagctacaggctggamtgaggcaggaggctcaggaggctgaggcgggagaatggcgtgaacctgggaggcagagcttgcagtgagctgtgattgcgccactgcactccagcctgggcaacagagtgagactccgtctca

SEQ ID NO: 13087 - DNA, 461 bp, Homo sapiens
aaaaaatgtccctggaacagaggaggaaacgcaacctgggcggctcctaggacgcagagacgccgtccccgccttcattgagcccaacgtgcgcttctggatcaccgagcgccaatcctttattcgacgatttcttcaatggacagaattattagatcctacaaatgtgttcatttcagttgaaagtatagaaaactcgaggcaactattgtgcacaaatgaagatgtttccagccctgcctcggcggaccaaaggatacaagaagcttggaagcggagtcttgcaacagtgcatcccgacagcagcaacctgatccccaagctttttcgacctgcagcgttcctgcctttcatggcgcccacggtatttttgtcaatgacgccactgaaagggatcaagtccgtgattttacctcaggttttcctctgtgcctacatggcagcgttcacagcatcaatgg

SEQ ID NO: 13088 - DNA, 416 bp, Homo sapiens
ttttggggggataaatacctagatagatagggactgctaggtcatgtggtcagtgcacgctcaaccttttacaaaactgcccagttgctttccacatggctgcaccattttgcattcccatcaacaatggataagaactccggctgggtgcagtggctcacgcctataatcccagcactttgggaggccgaggcagttggatcaactgaggtcaggagtttgagacaaggcggactaacatggtgaaacctgtctctactaaaaatacaaaaattagctgggcatggtagcatgggcctgtagtcccacctgcttgggatgctgaggcaggaggcaggagaatcacttgaacccaggaggcaaawgttgcagtgagccaagatcacaccactgcactccagcctgggagacagagc

SEQ ID NO: 13089 - DNA, 319 bp, Homo sapiens
ttgtcaaagatggttgtaggctgggcacagtggcttacgcctgtaatcccagcactttgggaggccgaggcaggcggatcacctgaggttgagagtttgagaccagcctgacgaacatggagaaacccctgttgggagaaatctctactaaaaatgcaaaaaaattagccgggcgtggtggcacatgcctgtaatcccagctactagggaggctgaggcaggagaatcacttgaatctgggaggcggaggttgtggtgarccaagatcacaccattgcactccagcctgggcaacaaaagtgaaactccgtcccaaaaa

SEQ ID NO: 13090 - DNA, 266 bp, Homo sapiens
agagtcagtcagcaagagacgctggggagagagcagggatcgcgagcccggcgatgcggcacggcggaaggcggctggggagacgctactccaactgttgaattgaattttcacctttcctttcatccgctgctttgcttgcggagatggatttatttgctttgaaatccgcatatctttctcagactgtggggtgatcccggcagacaccagactgaaagagaccacccgtgacagaaaaggaggaattaaaaaaaaaaaaaccc

SEQ ID NO: 13091 - DNA, 311 bp, Homo sapiens
ttttaaagctcagsattctcaaagctatttaaagaaccccttcatcaccaccactttggaccaatgttaaaagcaattcagtagagasattctccttcsataaccccccaaataattattgctgacctagaggcaattctgaaaggatgtatasgttagcccttctaaaaatcttatgtaggccgggggcggtggctcacgtctgtaatcccagcabtttgggaggccgaggcaggcggatcacgaggtcaggagatcgagaccatcctggctaacacggtgaaacctgtctctaccaaaaaaaaaaaaaa

SEQ ID NO: 13092 - DNA, 426 bp, Homo sapiens
  misc_feature 389..390: n=a, g, c or t
ccgtgttcatttttgtcctcgtgctacagttagctccctgccgcctcttgcaggtcttacttcagctcttgcctgtgacccacacagcttctgggctctgctctgctctaagaagtgctgtgggggtagagaaccaggaaggacatgctgttgggaatgtacacctgggcagaggtggccctgttaagatgtgactgtagccacagccagggatgggatccctcggtctctggaatctgaaacctcaacaaataccagtcttgacccctagcagcagagataagaataaaggggttggtttghtattaagtcagatgggggctctctccttgtcatgctgtccctgtggtaacagacagggattgaccatcttactgttgtacatgtanntggtggtgttggattattsccattgaagctgggaca

SEQ ID NO: 13093 - DNA, 219 bp, Homo sapiens; identical to SEQ ID NO: 12704

SEQ ID NO: 13094 - DNA, 320 bp, Homo sapiens
agtattagcatgatacatstttttttcataattttattttaacacattatgttctttaaatttaaatttcttgggaggctgaggtggctggatcacaaggtcaggagtttgagaccatcctggcyagcatggtgaaacccatctctactaaaatacaaaaaaattagctgggtgtggtggcgagcgcctgtggtcccggctgctctggaggctgaggcaggagaacggcatgaacctgggaggcggacttgcagtgagccgagatggggccactgcattccagcctgggcgacagagggagactccgtctcaaaaaaaaa

SEQ ID NO: 13095 - DNA, 97 bp, Homo sapiens
  misc_feature 12..13: n=a, g, c or t
asacagcccgcnnccccttccgcccggcccggavwrgcattcatgacggaggccggcgcagatgggaacaacaggcttttagtgtcgcsmcccgtaa

SEQ ID NO: 13096 - DNA, 179 bp, Homo sapiens
aaaaatacaaaaaattagccgggcatggtggcgggtgcctgtagtcccagctacttgggaggctgaggcaggagaatggcgtgaacctaggaggcggasttgcagtgagctgagattgcgccactgcactctagcctaggtgacacagcgagactccgtcaaaacaaaaaaaaaaaaaa

SEQ ID NO: 13097 - DNA, 289 bp, Homo sapiens
  misc_feature 109: n=a, g, c or t
tagctgttatggtggccgggagcagtcatcacgtctgttctcccggsattttgggggactgaagcgggcggatcacctgaggtaggaakttcgagakcagtctggccancatggggaaaccccgtctctactaaaaatacaaaaattagcakggcatgctggcacaagcctgtaatcccagctactccggaggctgaggcaggagaatctgttgaacccgggaggcaggggttgcagtgagccaagatcacgccgctgcactccggcctgggtgacggagcgagactcc

SEQ ID NO: 13098 - DNA, 496 bp, Homo sapiens
ttaaagcaatatatctgtgacatagaaattgtttctccaaagtattgctggggtcaatgggaaataagcaacgacaagcctgttcccataaactttattgcctcctgtaactgactttctaagtaaataaaggttcttagttttgcttttcttgcagaaaggaaagaaagagggatacccgagggatagatatccaagagttatgctaattctctgatattttataataaaagagatttcatctaaaaagaaaaggaggttctgaaggtggttatgtacattcttccaaactcaaagtcacgtctggaacattcttatatggaaagagctaaaaatacttaaaaatttaccttgaaacaatttctcatccaatcatattatggtccaggcaggtgctgatatgagggacatgatggtgcatatcctttgacaagcagaagggactgtgagtctctgagggatgggatgcagactttgatctgctccatacaactat

SEQ ID NO: 13099 - DNA, 55 bp, Homo sapiens
actcctcttcctttctccgccatcgtggtgtgttcttgactccgctgctcgccat

SEQ ID NO: 13100 - DNA, 346 bp, Homo sapiens
atgtacagattgaaatttagttgtttcattgtctgtctgaggaggtgtggacttttatatatagatctacataaaaactgctacatgacaaaaaccacacctaaagaaattttaagaatttggcacagttactcactttgtgtaatctgaaatctagctgctgaatasgctgaagtaaatccttgttcastgaagtctttcaattgagctggttgaatactttgaaaaatgctcagttctaactaatgaaatgatttcccagtaggggtttctgcatatsacctgtatagtagttatatgcatatgtttctgtgcatgttctctacasaattgtaaggtgtcactg

SEQ ID NO: 13101 - DNA, 503 bp, Homo sapiens
accctctgcttaaagtgttttttgtgtttttcactactgaaaatgtttagagattgacttacctattgctgatactcaaaacatctgatatcttaatatttttaaataactcactaaaagcatatgttgaaaatggcaatgtatagtctgagactggtgattagactggactaaaagcatatgttggaaatggcaaatatatgatctgagactggtgattaatttacagtattggcacctaaagagatactgagatgaataacttattaatttccttcttaaaatcataattttggatctgtaaaggactatacaaaaaaaaattttagtattatacctgcattttataattgtggaaatggaggccagaaagaataagaggcaagttaggggcagatcttgggtttggatcagctcttctgatgcctggttctgtgacattacaaaagcctgaaattcagctccaacatctattaaacatttgcagagtatcagctgggtgc

SEQ ID NO: 13102 - DNA, 272 bp, Homo sapiens
agggacctggattcttagtatttcaggctgctgtcccttttttttttttsatttcctttttgtttttgttgttgatgtgaccgcgtgtccasaaccctgggattccctcgccctcagattccagaatccaatttcttggatttcagtgtttttaagckgctcgggaggctgaggcaggagaatcgcttgaacctgggaggcggaggttgcagtgagccgagatgacaccattgcaccccagcctgggcaataagagcaaaactctgtctgga

SEQ ID NO: 13103 - DNA, 282 bp, Homo sapiens
gtttcagagaatatctttatttctgccttcattttattatgtacccagtagtcattcaggagcaagttgttcagtttccatgcagttgtgcagttttgagtgagtttcttaatcctgagttctaattttattgcactgtggtctgtgagacagtttgttgtgctttctgtccttttacatttgctgaggagggtggatcacttaaggtcaagagttcaagaccagcctggccaatatggtgaaaccccatctctactaaaaataccaaaaaaaaaaaaaaaa

SEQ ID NO: 13104 - DNA, 302 bp, Homo sapiens
tgaaggatctctctctctcatttgttttggattatttggatcaaagcattgtctgctttcttttttaatttcattctatgtagaaaagtactcttcatagaagagcaaggagaaaagttgtttggggccagacttggcaagtagatgtgaacattcttgatgttttaaaagtagcatataggctgggagtggtggctcatgcttgtaatcccaggacttcgagaggctgaggccggtatcacttgaggtcaggtgtttgagattagcctggccaacaagctgaaactccatctctactaaaa

SEQ ID NO: 13105 - DNA, 370 bp, Homo sapiens
cattgcatcctttaggacccagtggaacctgacagagcccataggattccctcttctactttcttagacagcagggatgtcagggtctcaaactgcctaacactttgtagcttttctttaacacaaaagcacccttctctcctaacttgggctctgaatactttcccaacagggaagtctgatctgttgccagacttcttkgttagatggctcatacatttatctagagaagcacactcttgmttgmtgtcaaactttagaacaccatggaaggtctaagggcatcctgtgccagggaaactttttaaggaattttatctatgggataaaccccatattccctctagtgtctactggtggctctaatact

SEQ ID NO: 13106 - DNA, 69 bp, Homo sapiens
  misc_feature 44: n=a, g, c or t
caaaatattaaaaataaaaggttgggacaaaagaatagcatganarcacatggaagtaaaaagcaggga

SEQ ID NO: 13107 - DNA, 272 bp, Homo sapiens
accaaggccgagtgtggtagctaatgcctgtaatcccagcactttgggaggctgaggtgggcggaacacttgagctcatgagttgaagatcagcctgggtaacatggcaaaaccttgtctctacaaaaaatatagaaattggcgtggtgtggtggtgtgtgcctgtagtcccagctgcttggggggccgaggcaggaggatcgcaccagcctaggaagtcaaggctgaggtaagatgtgttcatgccactgtgctccagcctgggcaacaca

SEQ ID NO: 13108 - DNA, 319 bp, Homo sapiens
atattagagaagaaaagtttggccgggcacagtgcctcacacctgtaatcccagtactttgggaggccgacgcaggtggatcacttgagatcaggagttcaagaacagcctggccaacatgacaaaaccccgtctctactaaaaattcgaaaaattagcctggcgtggtgatgcatgtctgtggtcccagatacttgggagactgaggcaggagaatcgcttgaacccaggaggcagaggttgcagtgagctgagattgtgccactgtactccaccctgggtgacagaatgagactccatctcaaaaaaaaaaaaaaaa

SEQ ID NO: 13109 - DNA, 235 bp, Homo sapiens
gtacttccaggtgcacgtgatactgatggggaagggtcggctgattgctgccagaaatggagagctcgttttaaggaaatgcggcgtctcctgggagtgaagaggcttttgggccaccttgaggcacgacgggtgccgcttcgtttccctgcgaccgctgcctgtttcgactgagccccttacaggaggacgtggcgggggcagacgggcgcastcccgccctctccgtgactca

SEQ ID NO: 13110 - DNA, 375 bp, Homo sapiens
cattakttaggtactcaaggaaacttttcaccaaatttttattctaaaaattgaaaactcaaaatattgagtacaatttttttttctttttttagtaatagagttctactaatgggaataatgggattttttggcaggggrcgggaggtaacattttgctcaatttgggctgaaagttggtatcccctcattggaataaatagaaaatgttaatctgttaatgctgatgtgtaatgtgatttcacgtatttcatctttgaaaatgtcttttcacacaaacaggtcaaggtactgctaaatactgacacatccacccatgagcatgtgattttagttaagcatattcatcacttgtaaggcatttgtaggattcat

SEQ ID NO: 13111 - DNA, 325 bp, Homo sapiens
  misc_feature 309: n=a, g, c or t
agccagggcaggccgggcacagtggctcacgcctgtaatcccagcactttgggaggccaaagcaggtggattacccaaggccaggagttcaagaccagcctggccaacatggtgaaacccgtctctactaaaaaatacaaaaaagctgggtgtggtggcacacacccgtagttccagctacttgggaggctgaggcagcattgcttgaacccgggaggtggaggctgcaatgagctgagatcatgccattgcactccagcctgggcaacgagagtgaaactccgtccccaccccctcgccaaaaaaaynaaaaaaaaaaaaaaaa

SEQ ID NO: 13112 - DNA, 298 bp, Homo sapiens
tacaaataaaatatcaaaaacatggccaggcgcggtggctcacgcctgtaatcccagcactttgggaggccgaagccggcggatcasgaggtcaggagatcgaaaccgtcctggctaacacagtgaaaccccgtctctactaaaaatacaaaaaattagcctggcttggtgctactmgggaggctgcggcaggagaatggcgtgaacccgggaggcggasttgcagtgagccgagatctcgccactgcactccagcctgggtgacagggcaagactccatctcaaaaaacaaaaacaa

SEQ ID NO: 13113 - DNA, 179 bp, Homo sapiens
tatgactaggaaacaaatgtaatgactgagttctgctttctatgtatgcaactcaccctaaaaacgttttgtaaggtagctggttgaagatatttggaatgtctaacaagttggctgactaatgtcatgaaaactgtacaattgtgttggagccagtctttttttttttttttttccct

SEQ ID NO: 13114 - DNA, 219 bp, Homo sapiens; identical to SEQ ID NO: 12704

SEQ ID NO: 13115 - DNA, 499 bp, Homo sapiens
aaccttaaatagatgtaatttctatttgtcaatgatgcctcagcaaagctagggagaaaataaaaaggatccttctgtgcaacarcccgcatgtccattaccgatgactggataaagaaaacgtgctccacccatgcagtggaatactacgcagccataaaacggaatgaagctcggatccaagctagaacgtaggtgagccttggaaacgtggcgctgagtgagagaagctggacacaaaataaggccaggaatggtggctcacagccgtaatcccagcactttacgaggccaagatgggcagatcacttgagtccaggagtttgaggccagcctgggcaacatgacgaaatcctgcctctacaaaaaatacaaaagttagccaggagttcatttagaggagtcatgtgactatagtcccagctactcaggaggctgagatgggagaatcacttgagcctgggaggtggaggttacagtgagccgagattggggccac

SEQ ID NO: 13116 - DNA, 317 bp, Homo sapiens
ttaaaaattgaggaatatcagccgggcacgatggctcacacctgtaatccctgcactttgggaggccaaggcgggcggatcccgaggtcaggggatggagaccatcctggccaacatgttgaaaccccgtctctaataaaaatacaaaaattagctgggcatggtggcacatgcctgtaatcccagctacttgggaagctgaagcaagataatcgcttgaacccggtaggcggaggttgcagtgagctgagatcatgccactgcactccagtctggcaacagagcgagactccatctcaaaaaaaaaraaaaaaagg

SEQ ID NO: 13117 - DNA, 461 bp, Homo sapiens
gagaagaggtggagctggagtggagcctcaggccctgtggtttgctgtgtttggggcctgctgtcacagcactgggagccttggagagagatggggagctgggatccccaggagtgacatacaactcctgaaatcctcagaatctccgtggtgctctttctgtgcgctggtgttgactgatagcttccgggtggcgctggtcactggaaagaccaaggcaggattagcgggttagaactttcagccccacccccaaccgcggggaggggagaggtccagaggtggaaggtcaagttgattgccagtggggtaatcagttatgcctacttaacaagggctccatgtcaaccctagaagacaggacttggagagcttctggacagctgaataggagggagtgcctggagggcagcaccgtgtccctctcccgtacctcaccctaaaggtctcttcatctgtgt

SEQ ID NO: 13118 - DNA, 295 bp, Homo sapiens
aaattttgaagcctgggccaggcgcggtggctcatgcctgtagttccagcactttgagaggccgaggcaggcggatcacgaggtcaggagatcgagaccatcctggccggcatggtgaaacccatctctactaaaaatacaaaaaattaactgggcacacctgtggtcccagctacttgggaagctgaggcggagagccgcttgaacccgggaggcggagagtgcagtgggccgggatcacgccactgcactccagcctggtgacagcaagacttgtctcaaaaaaaaaaaaaaa

SEQ ID NO: 13119 - DNA, 507 bp, Homo sapiens
attaactgggcgtggtggcgcacscggtagtcagctactcgggaagctgaggtgggagaatctgctactcggaaggctggggtgggagaatcccttgagcccaggagattgaggcttcggtgagctgagattgtgcctttgtgctccagcctgggacactgtctcaaaacaaacaaataaaaaaacaaaagttaatctcactgcttttctttttctctttttttagtgtggctatttggaaatttaaaatgacatatacgggccgggcggggtggctcaacgtctgtaatcccggcctcccaaagtgctgaaattacaggcatgagccacagcgccccgcctcaatggatcctgatgagctacgcaaaccattatttttatgtctttatgaatgccaccagaaagtttcattttgttctttctgaaaacaaccatgattataaaatgtcttctgaaacacggaagtgatgagaacatgttgtacagagaagcatggcattccctctg

SEQ ID NO: 13120 - DNA, 258 bp, Homo sapiens
cactttgggaggctgaggtgggcagatcgcttgacatcaggggtttgagaccagcctggccaacatggtgaaactccgtctctactaaaaatactaaaaattagctgggcgtggtggcgggtgcctgtaatcccagctactcgggaggctgatgcaggagaatcgcctgaaccaggcagatgcaggatgcagtgagccaagattaagacactgcactccaacctaagcaatactttgtctcaaaaaaaaaaaaaaaaa

SEQ ID NO: 13121 - DNA, 357 bp, Homo sapiens
ttaaatcatttacaacaaaaggggtgtgaacctaagactatttaaatgtcttatgagaaaatttcataaagccattctcttgtcattcaggtccagaaacaaattttaaactgagtgagagtctatagaatccatactgcagatgggtcatgaaatgtgaccaaatgtgtttcaaaaattgatggtgtattacctgctattgtaattgcttagtgcttggctaatttccaaattattgcataatatgttctaccttaagaaaacaggtttatgtaacaaagtaatggtgttgaatggatgatgtcagttcatgggcctttagcatagttttaagcatcctttttttttttttttttg

SEQ ID NO: 13122 - DNA, 125 bp, Homo sapiens
caattcattatggtgttgtgctttttaaatacactttttttgttgttgttgttgagaaagggtgtggctctgtcgcccagcctggagtgcagtggtgcagtcatggctcactgcagccttgacct

SEQ ID NO: 13123 - DNA, 82 bp, Homo sapiens
acttttttttttttycccsggttgctgcttgctgtgagtgtctcwagggtgatacgtgggtraaaaaggtcstggtccgsgc

SEQ ID NO: 13124 - DNA, 298 bp, Homo sapiens
atattagagaagaaaagtttggccgggcacagtgcctcacacctgtaatcccagtactttgggaggccgacgcaggtggatcacttgagatcaggagttcaagaacagcctggccaacatgacaaaaccccgtctctactaaaaattcgaaaaattagcctggcgtggtgatgcatgtctgtggtcccagatacttgggagactgaggcaggagaatcgcttgaacccaggaggcagaggttgcagtgagctgagattgtgccactgtactccaccctgggtgacagaatgagactcc

SEQ ID NO: 13125 - DNA, 85 bp, Homo sapiens
taatttattttggatgtcaaaaggcactgaytgaagatattttctctggagtctccttctttctaacccggctctcccgatgtga

SEQ ID NO: 13126 - DNA, 185 bp, Homo sapiens
  misc_feature 80: n=a, g, c or t
agggggcttggctctgcccggccacagagccggagctggaggtgctgtcccgtctggcggcgatccccgggcagggccgnccggggttttgaagatgctgaacgtcccttcccagtctttcccggcccccaggtcgcagcagcgttgtcgcctccggggggcgtacaagggtacctttaaaacag

SEQ ID NO: 13127 - DNA, 327 bp, Homo sapiens
tattacgattactcaagaaatgcaaaataggccgggcgcggtggctcacgcctgtaatcccagcaatttgggaggccgaggcaggtggatcacgaggtcaggagatcaagaccatcctagctaacacggtgcaaacccatctactaaaaataaaaaatattagctgggcgtggcggcaggcgcctgtagtcccaactactcgggaggctgaggcaggagaatggcgtgaacctgggaggcggasttgcagtgagccaagatcgggccactgcactccagcctgggcgacagagggagactccgtctcaaaaaaaaaaaaaaaaaagc

SEQ ID NO: 13128 - DNA, 322 bp, Homo sapiens
tatcgtcgggcacggtgactcacgcctgtggtcccggcatcttgggaggctgaggcgggtggatcatgaggtcggatcgggaccatcctggccagcatggtgaaacctgtctctgataaaggtgcaagggttatccgggtgtggtggtgtgtgcctgtggtcccggctgctcggggggctgaggcgggagagtcgcttgggcccggaaatcggaggttgcagtgagtgagctgggatcgcgccactgcactccagcctggcgacggagtgagactctgtctcaataaaaaaaacaaaaaacaaaaacaacaacaacaaaaaa

SEQ ID NO: 13129 - DNA, 319 bp, Homo sapiens
cattagaaatgagcatctagggccgggcgcagtggctcactcctgtaatcccagcactttgggaggccaaggtgggtggatcacatgaggtcgggagttcaagatcagcatggtcaacatggtgaaaacccatctctactaaaaatacaaaagttagctgggcgtggtggcaggtgcctatagtcccagctactagggaggctgaggcaggagaatctcttgaaagcgggaggcggaggttgcagtgagccaagattgtgccactgtactccagcctgggtgacagagtgagactttgtcccaaaaaaaaaaaaaaaaa

SEQ ID NO: 13130 - DNA, 473 bp, Homo sapiens
cacagcatgtgttttgtagaaattgataagccgatcctaaaattatatggaaatgcaaagtacctagaatagccaaagcattttggaaaaagcacagcattagaggacttacacactccgtttcacaactttagtaatcaaggcattgtggtattggtagaaggacaggcatatagatcagtggatccaaattgagaatctagaaataaatatctttacggtcaattgattttcaacaaaagtgccacgatcattcagtgagggaaggacagtctttcaacaaccagtgctgaaacaattgttatccacatgcaaatttaaaaaaagaagccgggcctcgtggctcatgctgtaattacagcactttgggaggctaaagtggtagaatcacttgagcccaggaggttgaggctgcagtgagccatgatggcaccactgcactctaaggtgagccacagagcaagattgtttca

SEQ ID NO: 13131 - DNA, 203 bp, Homo sapiens; identical to SEQ ID NO: 12721

SEQ ID NO: 13132 - DNA, 204 bp, Homo sapiens
tccattatgggaggctcattaaaagttggaagaaggccgggcgcggtggctcacgcctgtggtcccagctactcgggaggctgaggcgggagaatggcgtgaacccgggaagcggasttgcagtgagccgagattgcgccactgcagtccgcagtccggcctgggcgacagagcgagactccgtcccaaaaaaaaaaaaaaaaa

SEQ ID NO: 13133 - DNA, 389 bp, Homo sapiens
gaagatgaagaaaaatgagaaaaaaacacacaaaaggcaactttaaaacaaaatatcacgagcagacggggaggctgaacggctgggagctgggaggagacgctgcttaccgatcccggggcttttccagcccacgggcgcctgacgcaggctggagcaagtggtgcgtggggcctggtccccaaggggcggctgagaggccgcactgagcatctctatctgtcattcctttagctatttagggaccaaaggaccaaactttttattgcagatgtgtagctctatgtcaaatagagggggaatggaggaccccctccttcctgcctcatggctgttcttgaaacagcttagagcgattctatgaaaaaatgtaataaaaaattaaaaaa

SEQ ID NO: 13134 - DNA, 256 bp, Homo sapiens
tatttggtggcagctcttggtcctattgctgtggatgttccactgaaaacacggcgggtaggggggagtggtaaggaaagcaacttttttctaatttttgtattggtatccacaagcgtttgtattttttgaattgcaaacactgtgttttctggtctttgggggttagttgaactttctgtattaccttttggaaaacctgagttttaccacagtcttaagcagatttgaaataaattcttttgacactgccaaa

SEQ ID NO: 13135 - DNA, 444 bp, Homo sapiens
cacagcatgtgttttgtagaaattgataagccgatcctaaaattatatggaaatgcaaagtacctagaatagccaaagcattttggaaaaagcacagcattagaggacttacacactccgtttcacaactttagtaatcaaggcattgtggtattggtagaaggacaggcatatagatcagtggatccaaattgagaatctagaaataaatatctttacggtcaattgattttcaacaaaagtgccacgatcattcagtgagggaaggacagtctttcaacaaccagtgctgaaacaattgttatccacatgcaaatttaaaaaaagaagccgggcctcgtggctcatgctgtaattacagcactttgggaggctaaagtggtagaatcacttgagcccaggaggttgaggctgcagtgagccatgatggcaccactgcactct

SEQ ID NO: 13136 - DNA, 518 bp, Homo sapiens
agtttggaggtttctcaaagaacacagaactatcattcaatccagcaatcttgttactaggtgtatatccaaaggaaaagaaattgttataacaaaaagacacatgcactcatatattcattgcagtactatttgctatagcaaagagatgaagtcaacctaggtgcgcatcagtggtggatttggtaaagaaaatggtacatatacaccatggaataatgtacagccataaaagagaacaaaacaggccgggcacagtggctcacatctgtaatttcagcactttgggaggctgaggcaggtggatcacctgaggtcaggagttcaagacaagcctggccaacatggcaaaagccccgtctctactaagaatacaaaaaacattagctgggcatggtggtgcgcacctgtactcccaactactcgggaggcaggcatgagaatcacttgaacccaggaggcagaggttgcagtgagccgaaatcattccactgcactccagcctkgggtgacagagt

SEQ ID NO: 13137 - DNA, 316 bp, Homo sapiens; identical to SEQ ID NO: 12645

SEQ ID NO: 13138 - DNA, 441 bp, Homo sapiens
  misc_feature 427: n=a, g, c or t
atgtctaagttatgggtgactctggatctccaaaggcaaattagtcatggaagaatctttagttttggaaaatcactatgttgcttctcaaaaagtatactagttacgacaaggtagtatttagtgtcttttacatcaacattgaggctggcacggtggctcacgcctgtaatcccggctcttggggaggctgatgcgggtggatcacctgaggtcgggagtttggggccagtctggccggcatggtggaaccccgtctctactgaaagtacaaaaatcggccgggcgtgttggtgtgcgcctgtggtcccagctactcgggaggctgaggcaggagaattgcttgaacccgggaggtggagattgcagtgggccgggatcgtgtcactgctctccagcctgggcaatagagcaagactccgtccanaaaaaaaaaaaaaa

SEQ ID NO: 13139 - DNA, 471 bp, Homo sapiens
atgatggtgaccctctccacataatgcattacaacagaacattcttgaatcacccaaccctggatcagaaacctccccattaacaaacactgccccttaagtcctcttgaaataaacataggtcacacccccaaagcaaaagagtaacagacattcatgtcattgttccccatttaacatcagtcctctcaagatgtcgtgaccccatggtcacctgaagcccttagattccaacccctcaatcagagacttccttcattaacaaagacccttgttcttatccctcaagaagaaacccaccataaccagcccactgtcacccctaatttacagacaccaaaacagtcctggaagtgctaattacaggaccccccaagtcttcctaccctctgcaccctcaagaaacccccagtgccttgtatgaagcccaccccacatggcccacagctcctgtgctggccagactcccag

SEQ ID NO: 13140 - DNA, 280 bp, Homo sapiens
atgtctaatatataatgtatattttaaagcagagactattttggtggataggtgggagggagcaaggggagtttgagggaatcagagcttgatgctactgtacagaactggacaggttgggccggcagtggtggggccagagggctctgtgctctaggagctaagccagcagcccccgagaggacttggctgggcctttcctatgggcaaggccagtgctcttcctgcccaccagggaccatggagcagtggcaccctatgggctatgatccctaggcct

SEQ ID NO: 13141 - DNA, 394 bp, Homo sapiens
  misc_feature 331: n=a, g, c or t
gtttttctaaatgttcaaatatttcattttgtgcgtgtgaaagggaaaacactttgacggatcgtttttgtcagatgacactggtggctccccttttctcccctcacagtttcttgtttcgagtgctgactgacccgtttctgaaatgggcaccgagctaagtctgtgtgcagcattagtacccgctgccttaaaactcaagtttacattattcattaaaaaaagtacatctagtgttgcctgtaatgctggaaaccagtgtatctaccttgctgtgttaaatcatgacagtgagacggtgagatggattcgttttgcacacaacattcrnaacacttcatattgcccccacttgttgaaaaataaatgtagttcaaattgccactttccagca

SEQ ID NO: 13142 - DNA, 395 bp, Homo sapiens
cagacttggttacatggcttttatgacatcactttttctaaattactggaacctgtgtttgtttttacattgttttgtcatgagaaaatacatttatataacttaaggctcttttcttcatttatttcaccttgtcttcaaaaaattacatgaacatgttaattccctaaaagtgaaagaacattatgttttttattggtgaataagaagttgttatggagtgctctatttttacagctgtgcttcagggtatcacgttctgaagaggtcagcttggcatgatctcatgggcatgaatcttggggagacaattctgaaacagccacaggcctgcagcgtcgcaaagccagggcagaacatccagatgctgtcgttaggaggcacgcggtctgtta

SEQ ID NO: 13143 - DNA, 328 bp, Homo sapiens
tattctggattttctctaacaaataatacttgatagggccaggcatggtggctcacgcctacaatcccagcacttttggaggctgacaggggtggatcactttagctcaggagtttgagaccaacctgggcaacatggtgaaacccatgtctaccaaaaatacaaaaaattaaccgggcstggtggtgtgtggtcccagctactaaggaggctgagatggaaggatgacttgaacccgggaggcggaagttgcagcaagccaagatcacgctactgcactccagcctgggtgacccagtgagaccacatctcaaaaaaaaaaaaaaaa

SEQ ID NO: 13144 - DNA, 81 bp, Homo sapiens
aawattgtggcagtttctggscgggcgcagtggctcacgcctgtaatcccagagctttgggaggccgaggsgggsggatta

SEQ ID NO: 13145 - DNA, 280 bp, Homo sapiens
  misc_feature 278: n=a, g, c or t
tagtgtttcttattttggccagttcttttatttatgtccttgtgacccaggtacttggggggccagctacccttctggctttttagcgtctttgaaggagaccagacatgagtgaatacctaggagagtgtcagcatgtttctggaaaattggcagagaccaagccctgctgcagattcgtcaggccaggtgaaagggccaggcagttgcagctgatgatgtaaatattttgtacagtagataaataaatgtttaaaagaactawcaaaaaaaaaaangc

SEQ ID NO: 13146 - DNA, 376 bp, Homo sapiens
cagattatgtacagttgagagaaactttgtgaactggaagacattttttaagaatgcagccaagagttaacaagacggggaaagtgacagagaggttgattgagacacagaggatagaatgcaaaagtttaagatacatttgatttcagccccagaaggggaaaatagaatggagaagaggcagtatttgaagagccgttggctgaaggatattttgtaactgatgaaagatttgagtccctaggtaatggaaacgcagtatattttaaacaggttaaatgaaagaaatccatgtggagacacatcataggaaagctccaaaacaccaaagaccaagagaagattttaaaagcaatcagaggtaggagagaagtca

SEQ ID NO: 13147 - DNA, 307 bp, Homo sapiens
tgtcttaaaaatagggaaatgtggctgggcgcagtgcctctgcccgtaatttgggaggccaaggcgggcggatcgctgaggtcgggagcttgagaccagcctgaccagcatggggaaaccccgtctctactaaaaatacaaaattaactgggcgtggtggtgcgtgcctgtggtcccagctacttgggaggctgaggcaggagaatcacttgaacccaggaggcagaggttgcggtgagccaatatcacgccattgcactccagcctgggcagcaaaagtgaaacactcaaaaaaaaaaaaaaaaag

SEQ ID NO: 13148 - DNA, 263 bp, Homo sapiens; identical to SEQ ID NO: 12632

SEQ ID NO: 13149 - DNA, 131 bp, Homo sapiens
  misc_feature 110: n=a, g, c or t
tctgattaatattggtgtctgggccgggcgtggtggctcacggctgtaatctgagcactttgggaggctgagacgggcagatcacgaggtcaggagatcgagaccatccntggcaaaaaaaaaaaaaaaaa

SEQ ID NO: 13150 - DNA, 630 bp, Homo sapiens
agaggttatccttgacatctccctccagccccccttctcattgctggagcctcctgttgccctcggagtcccttccagcttcttcccactttcggcaacagcccccacccccaacaaacctaatgctaccaagatgccttgtttcaaaatgaagtgattccagcacagtcattcatgctgggtggtagcaactcagtgagctgcccttctaatagatcattgtaccttgaagagaaggcgatgctcaacctgcaggtggaatgtttattgtatctcagaggtgcgtggaatcttagtgacactgaggtcatagcattgtctcaatggcagccattggaattgggcagccgttttctgtagggctaagaccagccttccctggaggagatcagaggtaatctgcacctttcaaaatcagcctgccaaggagaatgcagccatggcttatgcccccttcacaatgctctctggccacctgaccgcaggagagtattgtggaggacaactgggttgggtattccagcctagagatctactgctcagcccctgaatttctataattcttacccttggctgtgctttaaaaaaataataatttttaaaaaactcaaaaaaaaaaaaaaatgcgaa

SEQ ID NO: 13151 - DNA, 474 bp, Homo sapiens
caattagcaatactatttcaaaaaataaactgatgttaatttataaaagagatttaaattaagaggtaagaaggtagcaggtcagtaaagcaagtcagtcagtaaagtatttattagaaaagttatttatttatttttaacttgatgcggatggtattaagaatggaaatatgaaagagaaattcaaaaatgaaatctgggccaggcacggtggctcacgcctgtaatcccaacactttgggtggccaagacgggcggatcacctgaggtcaggagtttgagacaagcctggccaacatggtgaaaccccatctctactaaaaatataaaaatttgacagccatagtggcgcgtatctatgatcccagctacttgggaggctgaggcaggagaatagcttgaacccgggaggcagagtttgcagtgagctgagatcacaccattgcactccagccttgacaacagagtgcgacg

SEQ ID NO: 13152 - DNA, 81 bp, Homo sapiens
aaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 13153 - DNA, 457 bp, Homo sapiens
tatagttacctttttttaatattgtggcattgacatcacaattttaaataaggaccaaagggaaattttaaaatctattttaaaatatcattatacagtttatgtaatggtggctttttaaatggcttattaaaattggttgatatgattgtttttctcaaactaaattatacacttttttgttttacaatatttcttactgatctaggaatgtgtgtctggggttggaagatctgcagtatgttttcatgatttcttcacatgagcttttcattacattgttgaaagatgaagaacgaaagctacttgttgatcagatgaggaagagatcccctagagtaaatctgtgcattaaacctgtaacttcattttatgatatcccaggttagctctctagtcggccagccaaaatgttggcatgttttgcccctctattcarattaaccttgaaatatat

SEQ ID NO: 13154 - DNA, 402 bp, Homo sapiens
ctatataaaattttcatttgagaatttctcaattgtatctagttaaatagcacagtttggaaacttgtctgagactgactttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggct

SEQ ID NO: 13155 - DNA, 440 bp, Homo sapiens
attatasgcgttctttatacattctctataagtgattttatcagatatgtatttcaccagtatttttttctggtttgtggcttgcccttgcatttttgtaacagtgtcttttgaagcacaaaaggcaaaattttgatgaagtctcgcttgccagtttttgttgtggttcatgtattttgtggcccaagaaatctttgcccaacccaagatcaccttcttcttggaggttaatagttttaacttttacatttagacctatgatctattttgagttaatttttcaatctggtatgaagtaagggtcagggttcattttcttggtcaggtgcaatggctcacacctgtgatttcagcagtttgggaggccgaggtgggtggattgcttgggctgaggagttggagaccagtttgggcaacataatgaaacccccgtctctaca

SEQ ID NO: 13156 - DNA, 384 bp, Homo sapiens
  misc_feature 377: n=a, g, c or t
attaactgggcgtggtggcgcacgcggtagtcagctactcgggaagctgaggtgggagaatctgctactcggaaggctggggtgggagaatcccttgagcccaggagattgaggcttcggtgagctgagattgtgcctttgtgctccagcctgggacactgtctcaaaacaaacaaataaaaaaacaaaagttaatctcactgcttttctttttctctttttttagtgtggctatttggaaatttaaaatgacatatacgggccgggcggggtggctcaacgtctgtaatcccggcctcccaaagtgctgaaattacaggcatgagcacagcgcsccgcctcaatggatcctgatgagctacgcaaaccattatttntaatgtc

SEQ ID NO: 13157 - DNA, 297 bp, Homo sapiens
tacaaataaaatatcaaaaacatggccaggcgcggtggctcacgcctgtaatcccagcactttgggaggccgaagccgcggatcacgaggtcaggagatcgaaaccgtcctggctaacacagtgaaaccccgtctctactaaaaatacaaaaaattagcctggcttggtgctactcgggaggctgcggcaggagaatggcgtgaacccgggaggcggasttgcagtgagccgagatctcgccactgcactccagcctgggtgacagggcaagactccatctcaaaaaacaaaaacaa

SEQ ID NO: 13158 - DNA, 378 bp, Homo sapiens
caaaacaaaacaaaaccaaaccatccatggaaatgttcctacctggacttaggatgggagacggagagttctccctgacagggtaaaagaagccttgacttggccgggcgcggtggctcatgcctagaatctcagcactttgggaggccgactcgggtgattcacctgaggtcaggagttcgagtccagcctggccaacatggtgaagccccatctctactaaaaatacaaaacattagctgggtgtggtggcacaggcctgtggtcccagctacttgggaggctggggcaggggaatcgcttgaacccgggaggcggatgttgccgtgagccgagatcgtgccactgccctccagcctgggcaacaagagcaaaact

SEQ ID NO: 13159 - DNA, 262 bp, Homo sapiens
  misc_feature 262: n=a, g, c or t
tttggggggccgaggtgggcggatcacggggtcaggagattgaccatcccggctggcacggtgagaccccatctctactaaaaatacaaaaaagttggccgggcatggtggcgggtgcctgtagtcccagctactcgggaggctgaggcaggagaatggtgtgaacctggggggtggaggttgcagtgagccgagatcgtgccacagcgctccagcctgggtgaaagaccgagactccatcccaaaaaaaaaaaaaaaaaan

SEQ ID NO: 13160 - DNA, 428 bp, Homo sapiens
  misc_feature 130: n=a, g, c or t
attattattattgttattactattttgtagaaacggggttttgccatgttgtccaagctagtctcaatctcctgagctcaggcaagtcgcctgtstcagcctcccaaagtgctgggattacaggcgtganaccatgcccgtccccagactctcttaaataaccagatctcctgtgaactaactgagtgggaactcactcatcaacaaggggatggtgctaacccattcatgagtggttgacccccttgatccaatacctcccaccaggctctaccccgtctctactaaaaatacaaaaaattagccgggtatggtggcgggcgcttgtagtcccagctacttgggaggctgaggtgggagaatggcgtggacccgggaggcagagcttgtagtgagccgagatcgcgccactgcactccagcttgggg

SEQ ID NO: 13161 - DNA, 326 bp, Homo sapiens
tattacgattactcaagaaatgcaaaataggccgggcgcggtggctcacgcctgtaatcccagcaatttgggaggccgaggcaggtggatcacgaggtcaggagatcaagaccatcctagctaacacggtgcaaacccatctactaaaaataaaaaatattagctgggcgtggcggcaggcgcctgtagtcccaactactcgggaggctgaggcaggagaatggcgtgaacctgggaggcggasttgcagtgagccaagatcgggccactgcactccagcctgggcgacagagggagactccgtctcaaaaaaaaaaaaaaaaagg

SEQ ID NO: 13162 - DNA, 432 bp, Homo sapiens
caaagaaataatccactgcaaaagctgtactctttttcctcaaaatccaaatcttccacctccttccacaagagaacgacctcctgggtgtaagaccgtgtttgtcggaggattaccagaaaatgctactgaggaaattattcaagaagtctttgaacagtgcggtgatattacagcaattcggaaaagcaagaagaatttttgtcacattcgctttgcagaggaattcatggttgataaagccatttacctttctggttataggatgcgattagggtctagcaccgacaaaaaggattcaggccgccttcatgtggactttgcccaggccagggatgacttctatgagtgggaatgcaagcagaggatgcgtgcccgggaggagcggcaccggcgcaastgggaggaggaccggctcaggcccccatcccc

SEQ ID NO: 13163 - DNA, 459 bp, Homo sapiens
  misc_feature 143: n=a, g, c or t
tttagtttaactaagtgaaggtctcactgctcacaagtagcagagccagaatttagaatacaggcagtatagctctctagtgtccatgttttttttcttttgagagggagtctcgctctgtcacccaggctggagtgcagcgncttgatctcagctccctgcaagctccgcctcctgagttcatgcsattctcctgcctcagcctcccgcgtmstgggactacgggcgcccgccacaacgcctggctaattttttgtgtttttagtagagacgggatttcaccctgttagccaggatggtctcgatctcctgacctcgggtggatcacctgaggtcaggagttcaagaccagcttggacaacatggtgaaacctgtctctactaaaaakwcaaaaattagttgggtgtggcggcacatgcctatagtcccagctactcggggggctgaagcaggagaat

SEQ ID NO: 13164 - DNA, 438 bp, Homo sapiens
gttagggcctttgccagggatgccgctgcgtggagctggactgctgggaggggccaggaggggagcccgtcatctatcatggccataccctcacctccaagattctcttccgggacgtggtcaagccgtgcgcgaccatgccttcacgctgtccccttaccctgtcatcctatccctggagaaccactgcgggctggagcagcaggctgccatggcccgccacctctgcaccatcctgggggacatgctggtgacacaggcgctggactccccaaatcccgaggagctgccatccccagagcagctgaagggccgggtcctggtgaagggaaagaagctgcccgctgctcggagcgaggatggccgggctctgtcggatcgggaggaggaggaggaggatgacgaggaggaagaagaggaggtggaggctgcagcgca

SEQ ID NO: 13165 - DNA, 445 bp, Homo sapiens
aaagcctcatctcttgataggtggaatgacatgtgcacattggaaaggaaataatcaatggcggccaagtttggaagattagtttgtggctataccatctattacagtatctaatcttttaatttatttacatgattttatgattaatcctctttatcttgtattttaacatgtaataatttaagtcctcttagaaattaggttataaatctcaaattaaaattattgaccttaatttaatagaagagattttgggataatgggaggcctggataaacctcttttttgtgtcattcactatatattcgtcttgtcattcactataaatttaataagtatcttggtttatttagttgcaaatcttccaaaacatctttgcttagtaattgcagctatattatgagaatttactctttcatcttagttttccctgaactggagggct

SEQ ID NO: 13166 - DNA, 461 bp, Homo sapiens
agtgagtcgsggcgccggcactggtggttgggtcagtgccgcgcgccgatcggtcgttaccgcgagsgctggtggccttcaggctggacggcgcgggtcagccctggttcgccggsttctgggtctttgaacagccgcgatgtcgatcttcacccccaccaaccagatccgcctaaccaatgtggccgtggtacggatgaagcgtgccgggaagcgcttcgaaatcgcctgctacaaaaacaaggtcgtcggctggcggaggcgtggaaaaagacctcgatgaagttctgcagacccactcagtgtttgtaaatgtttstaaaggtcaggttgccaaaaaggaagatctcatcagtgcgtttggaacagatgascaaactgaaatctgtaagcagattttgactaaaggagaagttcaagtatcagataaagaagacacacacaactggrgcagatgttta

SEQ ID NO: 13167 - DNA, 85 bp, Homo sapiens
atccgggggtcgtttccaggagctgcagccctccagcctggggtctggccaggattaaccctgcttcctcccacccccgtaacca

SEQ ID NO: 13168 - DNA, 495 bp, Homo sapiens
cacgagggaagtgccaatcaaaaccacagtgagctaccacctcacccctccaggatggctgttagaaaacaaacaagcagcctgtgcagtggctcacgcttgtaaccccagcatgttgggaggccgaggcaggcagatcacttgaggccaggagttcgagaccggcctggctaacatggtgaaaccctgtctctaataaaaatacaaaaattagctgggtgtagtggtgtgtgcctgtggtcccagctacttgggaggctgaggcaggagaatcacttgaacctgggaggcggaggttgcagtgagccaagatcatgcgactgcactacagcctgggcaacagagtgagactctgtaaataaataaataaacagactggcctggtggctggtgacttaggcctataattccagcactttgggaggccgaggtgggagggtcacttgagcccaggtgtttgagaccagcctgcacaacattgagagacccatctct

SEQ ID NO: 13169 - DNA, 340 bp, Homo sapiens
ttcatggaaaaagctattcagacccctgcttggaaagctaaggcacactgccacgaagcagcaaggacgccttacaagtctcagtgcaacagagatggacacctgggctgggctggacaatgtttaaggttccttttagtccatgactcaagtgatactgttttaggctatcaggtagtaaacacgatcttagacatccccatctttgtaagcagaacagtacggcacttcaccacatctgcttcccaccatgcttctaagcagctgtcttccccctgctaatgttacaaccaaagcagccacccccacctcctctcgtgttgagcctcacgaccgctga

SEQ ID NO: 13170 - DNA, 198 bp, Homo sapiens
  misc_feature 181: n=a, g, c or t
ccagtctccctcatttgagcaatactctcatttcctctgatgtctggatgatcggcagggcaggaatctgagcgctggccccgtggtgaggccatgttctcataatcagsctccagccagaaaaataagaaacaccgcaacaggcttcagtatcagggctgaaactgctggatgaataaantatttattaaaaaccaa

SEQ ID NO: 13171 - DNA, 113 bp, Homo sapiens
atttaaaaattagccaggcgtggtggtgcatgcctgaagtcccagctactttggaggctgaggcaggaggatggcttgagcctggaagattgacgctgtggtgagctgtgatc

SEQ ID NO: 13172 - DNA, 382 bp, Homo sapiens
caattgtgaaaggaaaatgttaggagtatggtttttaaacttgggcttcattttaaacttttttttttaaacccagttatttcacttgatttgctagcttcagagaagagatccgaatctgtgcccagcgctaaaggctcagtgttagcatggcttgtgctggccggtgtgccatattcttgttggagatgaaccgtagcaccagagcccattcttccttgtcagtcttggcccaaagatgtcaccattcctagttatttgtcaccacataattggtgttgattggaaactttttctgagatgggacagaactgctgggttgtctttttccatgtaacttaagcatagtaatataaataaagtaatagttggaaaaaaaaaa

SEQ ID NO: 13173 - DNA, 407 bp, Homo sapiens
caagaagggaacagagcacgccgaccctctccctttcccctctgtctctcttagtggctttacagtgggtaccctgtcagaaaccagcactgggggccctgcsacccccacatggaaggagtgtcctatctgtaaggagcgctttcctgctgagagtgacaaggatgccctggaggaccacatggatggacacttctttttcagcacccaggaccccttcacctttgagtgatcttactccctcgtacatgcacaaatacacactcatgcacacacacactcacacacatgcatacacttaggtttcatgcccattttctatcacactgggctccatgatattctgttccctaagaactgcttctgtgtgccctgttttcatcccaagatttctcacttcatcctct

SEQ ID NO: 13174 - DNA, 407 bp, Homo sapiens
  misc_feature 177: n=a, g, c or t
cagatcaatatctctcatgaacatagatgtgaaaatcctcaacaaaacattagaaaatcaaatccaacaatgtataaaaagaattatacaccatgactaagtgggatttactccaggtatgcaaggctggttcaacattcaaaataaattaatgtaactcatcacatcaacagaatnaaaagaaaaatcatatgatcatatcaattgatgcagaaaaatgcatttgacaaaacccgacattcattcatgttaaatgaacaaccactctcagaaaactaggaatagtgggaaacttcctcaagttgataaaatctaccaaaaaaaccagttaacatcatacatagtggtaacaagctacatgctttccccctaaattcaagaacaagaaaattacatccactctcaac

SEQ ID NO: 13175 - DNA, 470 bp, Homo sapiens
ttttccaaggtgccgcgccaggggttgctgaggtagaggtggctcccctgctcctccttccacctctccgattccacctcctcctcgcaccccgctgggaactcctccaggggctgagattggattcwccgagcctgcggagagtggggaactgcgggcaggtcggcggagttagatggcagcaaaggtgggccggcttggtgtgataaagttccaactgggtccttccgcgagccctgggtccataagatgtcatcggcgagcgctggacttgaccgtcaacttgggattgttaaggtaaatggtgtctccttctgtcgccaaggcggtggcatggtctcggctggctgcaatctccacctccttgcttccagcgattctcctgcctcagccccccgagtagcagaaattacaggagtttcatggcagggcgcttggctggcttgtttaaattcattctgaataagaac

SEQ ID NO: 13176 - DNA, 438 bp, Homo sapiens
ccaaacattcattatcacataaggttgctgcaaacacaggaggatttacttatcttttagttcatttcgcaatctctatttgcaataattttgtgtaggttaatacagaatatgtgctattaagtaacactaaaaaggctgggcatggtggctcacacctggagtcccagcactttggtaggctgagacaggcagatcgcttgagctctggagttcaagaccagcctggacaacatggtgaaacctgtctctaccaaaaatacaaaaagtgagctggtgtggtgatgtgtgcctgtggttccagttacttgggaggctgaaatgggaggatcacttgagctccggaagtggaggctgcagtgagccgagactgtgccactgcactccagcctgggcaagaaagcagacccgtctcagggggaaaaaaaaaaaaaaaaa

SEQ ID NO: 13177 - DNA, 421 bp, Homo sapiens
tgtttttattgtttgtttgtttgttttttgagttggagtctcgctttgtcgcccaggctggagtgcggtggcgcggtcgctgttcactgcaatcttcccctccctggatcaggtgattctcctgcctcagcctcccaggtagctgggattgcaggtgcccgccaccatgcccggctaatttttgtgtttttggtggagacagagtttcaccatgttggccagactggtccggaacgcctgacctcgggtgatctgcccaccttggcctcccaaagtgctgggattacaggcgtgagcaccgcgcctagcctgaccacgtttttgattcttgcttctgttatatctgtattaaccgttcttcttagctttcgtggcagatgtgataagcatgcctttgtgtctttctctaagtcactgactt

SEQ ID NO: 13178 - DNA, 431 bp, Homo sapiens
  misc_feature 106,348: n=a, g, c or t
tkwctttgtaggttcatgccatttstaaaascctctttgttgtctttttattggaattttgagagggagttaaatgtctgtttttaatctascatctttaaaccanaattcsagctatktaatttcagcatgaagaattgcattawaaacagagcagtgaatcattttatgaataatartgctggattttatttttaaaaattatcctagcctaaaatgtttaggatcatcatagcattaagagagakttatatttggtaaggaatcataaacatcgtcagttttcatgcttaaagtatttaggatcatawtagcattaagaaagatttatatttggtaaaaaatcanawacatggtcagttttctagtggagatttttcatggcactatawatctttagtaacwagattttctatgtttagtctttgtat

SEQ ID NO: 13179 - DNA, 493 bp, Homo sapiens
caaagtgaaataattcagccgtcagatggtggaattcatctcttcaaagaggttttgccttttaaatgttcagttctaagtgattaataagtggcacacctaaaatatgacatggtaaagttgaaaggaagaaagatacaaggcaaacgctaatcaaaagaaagcgggtattacatttttgtctcagacaaaccagacttgaaggcagaaagccagataagggataaaggtcagtacttaaggaaaggggaagtaatgtaccagaatgacatcatgatgctgcgtttgtaggcgcctagcaacataagcctcgaactgtttaaaggaaaaatcatcagaattgcaaggagaaacacagtcatggtgggggagtttaatgtccctgtctgatacttgtagatgacgcagatattaagttaacaaaatgcatgcagtggacatatataaactttagcccagtcattaggaaagcttacgttcatttcaagccacg

SEQ ID NO: 13180 - DNA, 667 bp, Homo sapiens
aacgataggatacaaagtgtgatttgttggaaacatgtcccaaatttctaaaattctgcttctctgccaaaagcaatgtctttcttggttgatatttgagttttaaaagggtcaaatctttctaattttttgtatctttagagggcagcactagaagaaatcagcaggtctaatcccaccagtaagaaaactaccacttcttgatttttacagatttaaaaaaatcttttcagtgacctttctttttaatgtaaatacaaatttaaacctaggcttaatataggcgtttcccctttcacccaagtgatgtcacagttcgatgcaaaatcaatgatccagaatgatcgtgggtaaaaataactcaaagtgtttcttaagggtgagttggcatgcaaaaaattacattgattacagtgtgttttggagctggctctgtttgtgtgcatatgataatgcagagttgagccagagcctggaaatgtcattctagatctcactaactactggaatcagtgttttaatctcttggtggaaactttcagttgcttaactctctattggaagatttttttaatgttctacatcatttatgttgtattacaatgtatgtagaaatagtaacctgtgaactatgcttttccataactttttaaaaatatatatatct

SEQ ID NO: 13181 - DNA, 197 bp, Homo sapiens
  misc_feature 80,84: n=a, g, c or t
ttttaatctgatagttcaagttctttcattgtggatttttttcttttttcttttcctttcttttttttttttttwawttncmanacagggtcacttgagcctgggaggttgagactgcagttagccctctttgcacmactgsactcmagccttggtgacagagtgggaccctgtctcaaaaaaaaaaaaaaaaaaaa

SEQ ID NO: 13182 - DNA, 457 bp, Homo sapiens
aacccctgccctggtgaaagggctcccgcaccgcccggystccccatctgcctggcgttgtgcgcagagctggaaagcatggctgttgtatgtattcttgcgcccgtgtgacaacatttaaacttctaaaaacggaacctccttccgtgttaggattgcaagttaacctaggaaaaacagcattctgcaaattatttgctggaaaatctcggtgacttaaggcccatgtattactttgcaggggtctctcactctagtttactggtgtagattttttaaaaaatccatcttatcaaaaaataccgtttaaggtggaaaatttcaaatgcaagtcgcagttgatgagattgcaattaatatatttdagatagaattagagaaaaactacagtcagtgcatattaagtatttttttcatattttggggggattagatttttaacgataactttgaagtt

SEQ ID NO: 13183 - DNA, 441 bp, Homo sapiens
tttttcctcctgtgaagacatagctgcgggtggctgtgctggtggcgttcaagatgtcgaccaagaatttccgagtcagtgacggggactggatttgccctgacaaaaaatgtggaaatgtaaactttgctagaagaaccagctgtaatcgatgtggtcgggagaaaacaactgaggccaagatgatgaaagctggggggcactgaaataggaaagacacttgcagaaaagagccgaggcctatttagtgctaatgactggcaatgtaaaacttgcagcaatgtgaattgggccagaagatcagagtgtaatatgtgtaatactccaaagtatgctaaattagaagaaagaacaggatatggtggtggttttaatgaaagagaaaatgttgaatatatagaaagagaagaatctgatggtgaatatgatgagtttggacgc

SEQ ID NO: 13184 - DNA, 325 bp, Homo sapiens
  misc_feature 198,234,264: n=a, g, c or t
akaggggcctagtgttgtccagggctgggggcactgctccaggccgtgtggaggggccctgcaggcctggtgacgcagctgctgcggcaaggtgccagcgtggaggagaggacattgaggtgctgctgggccacggggcagacccaggcatcagggacaggcatcggccgctctgcgctgcacagggctgccgccgwnggacacctgcttgccgtccagttgctggtcacccanggggccgaggtsgatrctcgggacaccctnggcctcacacccctgcatcacgcctctcgggaaggccacgtggatgttgccggytgcctgc

SEQ ID NO: 13185 - DNA, 448 bp, Homo sapiens
ttcatagccacggtaacggcggggtggaaagctaaggcctttgaagacctgggaccccgtagtttcgggagagggtgaggggtgaatggtgctgaggtgcgaggagagggaaggacagtaaagagcaggtgggcaggagggtctccgactccagagacctgagcttttggggcgcgggtgggagcgcgggggaacctcaagacggctttcttttggcgactgagggtttttctgccacaggaagctgggccgggctgctgtgcctgggaggagggaaggaggaatgagaaagcggtgacggtccctgcccccccctcgccaggtgactgtcccacccatttagttgaatgtagcggccagagaggcactcgcggcagcccgtacggtgggacctctcggtgtccttcgggaaacaggaggagcaagttcgactccagcgagggaaaac

SEQ ID NO: 13186 - DNA, 454 bp, Homo sapiens
ataaaagcagtcctgcttctcaaaggagacacccatcctggaagacctgggacaaggtagagaagaggtcttctcccctcatgccttcatggagaggctcatgctgctagacatagcaacctctgtcaggaaatgtcgcgtcttcagcccttcacgtaggcaggtttgattcagcgtcctcgtggcatttcctgttcctgcccacttgtgctcgcgcacgcgcgattggggtcggcctttctgacatcagctgtctaaccgttcttctgaagcttggtcctcgggcagggggcagggaatcgaagacctgcgtggtcacaggggaagagaagagaaaggtcccggcaagacagtgtacatctagggtcggcttccaaaggaccggcaagtgacaacacggaaaatgtgaagacaagcccagggtcgtcttctgactctccatgtgttcgtgatg

SEQ ID NO: 13187 - DNA, 197 bp, Homo sapiens
atgattctcacctggcagatctatggaaagattagctgactctttggatccctgaatatagttaatagaaatttggaaggaccatgtcaaaattaactaatgtgaactgacaaagatttggtgttcaaagcaaaaattaaactttggaaaagtgagcaagtacttaatcagaaacaaaaaaaaaaargaagggaaaa

SEQ ID NO: 13188 - DNA, 317 bp, Homo sapiens
  misc_feature 90: n=a, g, c or t
caattattaaaatcaggaacttaatactgagtaagatctgtagataatagtatatcaaatgttgccaattgagccaataatatatatrvntwgtacattatttttatgaattttaaatatattattatwttagaaattgtttctggttcaggttttcagtctaggatcaggcattccattagttgttgagtctctttagtctccttttaaaatagagccgtttttcagtgtttgtctttcttgagcttgacctttttggaagactaaaagccattcattctattgacggtccctccamttgggcttgttggaagtcc

SEQ ID NO: 13189 - DNA, 457 bp, Homo sapiens
tataaataaggggaacacagtgtgcaaagggctatgataaaacatggggggtggggggcaacaactaattctgtcaggaaggaggagggaagtctgggaaggctgggatcgtctgcactaaattttcttaccctggcaagcggaaggactgaaaggagatgagcagggagcactctataaatatgagtcgactgatggagctttgtttttaactcaggaatgaaggggtacagggacacactcaagccctttgtttcaaagtgttacgttggaccatgatgtagtcaatgtaaagatgtgtttacacaactttacaatcctgaagttgcagccattcccagcctgggattcttgagggattaggagggggctatagaatgcgtgagtgctccacaatatatccctttcagttggggctgaaggctcgtctaagctcgtagtgcctgcctcaactgtg

SEQ ID NO: 13190 - DNA, 346 bp, Homo sapiens
tttgcctaattgtcttcttcaagtgtgtcaatgctgtttagttcccaggacttgctaactacatttggtaaagagcaagcaagagagctagaagttccttcatgtggtgtgggcctgggagccgtgatggagtgttctaacaagaaagagctgtagaagatttcagcagctatcagtatgttagcccctcagttgcctcaccaccagcaccctcttttcagcaggcatttactgggcctcaagtgtgtgtgattagaaatttggttaacaggctgggcgcagtggttcgtgcctgcggtcccagcactttgggaggccgaggcgggcggatcacgaggtcaggagt

SEQ ID NO: 13191 - DNA, 455 bp, Homo sapiens
tttacttcttaagtggtgctaacaaggtgtcccagggtgctctgtgccagttaagatttttaactttcaaggggcagggcatactgggaaatgtagtttcccaaactgccttatcacttgggtggacatatgtctccttttatgccttttggtcttgagtaattaacagcatcctcttccacgctcagaagtgttctggttggggccaggcatggtggctcacgcctgtagtcccaacacttagggaggccgaggcgggcggatcacctgagatcaggagttcaagaccagcctggccaacatggcgaattcccgttctctactaaaaatacaaaadatgtgtggggtgtggtggcaggagcctgtaatcctagctactcaggaggctgaggcaggagaatcgcttgagcccaggaggcggagattkcagtgagccgagatcgtgtcactgcact

SEQ ID NO: 13192 - DNA, 486 bp, Homo sapiens
aaagtggaaggcaacgacacacggcccgtggcgccttcagctagggagaaagagaggacgggggctggcgggcgggattagctgccggaggctgagtttccgcagcctgagtctccatctgtcgctagactggagtgcagtggcgcgatcttggctcacttcaacctccacatcctgggttcaagcgactctcctgcctcagcctcccaagtagctgggactacaggtgcgcaccaccatgttcaactaatttttgtaattttagtggagacgaggtttcaccatgttggccaagatggtctcgatctcttgaccttgtgatccacccaccttggcctcccaaaggtactgagattahagatgtgagccactgcgsctagccagaaaaatatttattgatcctaaagtgggagtcagcgccactgttgmtgctagtgttgaatccagaamcatagctggacatgggatcagaggatgaacaagaga

SEQ ID NO: 13193 - DNA, 66 bp, Homo sapiens
ctgaaattaaatcgcacacccccaccatttcctctccctgggatctggaggaacatcatacatagt

SEQ ID NO: 13194 - DNA, 160 bp, Homo sapiens
gaataactcagttttaggtaagcctcccctatatcctagaataacctgcctcttcggctgggaagcggagggaaccttctcttccttaaagacagggtctcgcactgtcacccaggctggagtgcagtggtgcaacccacctcccgggttcaagcaattc

SEQ ID NO: 13195 - DNA, 372 bp, Homo sapiens
atatacaaaaagtttaggaacatggagcaaaatgtctgattcaaaacaatctaggctgggcgcagtggctcacgcctagcactttgggagttggaggcgggaggatggcttgagctcaggagtttgagaccagcctgggcaatgtagtgagaatccatctctataaaaaaatttttaaaaattacctgggcatgatggtgcgcatctctcgtcccagctacttggaaggctgaggtgggaggatagcttgagcctaggagttcaaggctgctgtgagctgtgatcaggccactacactcagcatgggaggtagagcaaaaccttgtcttaaaaaaaaaaaawtctggccgcgtacggtggcycatgcctata

SEQ ID NO: 13196 - DNA, 252 bp, Homo sapiens
ctatcgagccctggctctccgggcagctggaggggtcgcgctgcgcctgttggggctgcacctcggaccagggcttctgctgcatctgcascatgtcgggccgctcagtgccacatgcccacccggccaccgccgagtacgaatttgccaacccgagccgcctgggtgagcagcgcttcggagaaggcctcctgccagaagagatcctgacccccacactctaccatggctactatgtccggcctcgggcgc

SEQ ID NO: 13197 - DNA, 498 bp, Homo sapiens
aacaaaatgtcatttcagatatgttatagttggtttaaactggcttcaagcagtcattaaaaggtggtggtcagaactatcatccaaaacaaaattataaatgatgggtgagtatacctttaaagataaactcatgctgaaattttcttcaggaaagcagcttgattaaactaggtaataattttatcccattatcatcagtgtatggtatttattctttttatattcagagagatactaacttaagagactgttcatttgtgaaaaccacacctggaaattgaattccagagcctactaacctcctgtatctcttcttctggcacaaccctacccttcattttagaagaaaaacacaatagtggtttaattctcatattcattatgagtaagggaggaaaaagagatgcccacagtgtaataaggaatggaggcaccctgcgggtcctttacctagacattaacctgagagtccggtgttgatgtttacagttctaa

SEQ ID NO: 13198 - DNA, 479 bp, Homo sapiens
caggctttagggagaatgggatgggaagacctaacgtttatagagtcaatgtaaaatcaggtttctatggatgaagggggagaagaatgtaaagtattataagagaattattcttatttttctgcaagtctcaaattcatgttttcagttcatagatttcctcacaaatgtagcaagctagccactcattaataaatcagctacctctctagctagctagctataatactgttgatttagcattttaaaattttgatctgtataaaatatacaacataaagttctaactacggccgggtgcggtggctcacacctgtattcctagcactttgagaggccaaggcgggtggattgcctgagctcaggagttcaagaccagcctgggcaacacggtgaaacctgtctctactaaaatacaaaaarttagccgggcatggcagcgtgcgcctgtagtcccagccactcagggggctgagaca

SEQ ID NO: 13199 - DNA, 227 bp, Homo sapiens
aatctcaatagaagcctgctgtttaccctcagggaacaagtagttttcaaaattgagctcctccaaggtcattggccaatgctgtgtgcaggcattggtcatctttgtaaactcatggcattatttcctcatatgcattatgatactaagaaattcaaccccaacctgtatgaaaagcacagcccagggccctaattgaggctagcatgaatgcctttgaggggcca

SEQ ID NO: 13200 - DNA, 420 bp, Homo sapiens
cattaaatcttaaagatccaaaataattcttgactccatgtctcacgtccttggcacactgctgtgaggrgtgggctcccaatcccttgggcagccctgcccttgtggctttgcaggctgctctcctgggttggagttgagtgcctgtgactctgtgatttttccaggtgcagggtgtgagctgccagtggatctaccactctgggccgggaaggtgggggccctattcccacagcttcactaggcagtgccccagtggggactctgtgtgggagtttgtattaggccattcccacatttttataaagaaatacctggccaggtgcagtggctcatgtctgtaatcccagcactttgggaggctgaggcaggcggatcacaaggtcaggagtttgaaaccagactggtcagtatggtgaa

SEQ ID NO: 13201 - DNA, 73 bp, Homo sapiens
cttttggamaaacttggagasagtgtccaggaccttagttcatttgatgaatacagttcagaacttaaatctg

SEQ ID NO: 13202 - DNA, 339 bp, Homo sapiens
agatttttgtatttttagtacagatggggtttcaccatgttggcaaggatggttttgatctcttgacctcatgatctgascgcstcggcctcccagggtgctgggattacagatgtgagscaccgtgcccggsstactttattatattaagtacatataaaagtatatataaaatataggccggatgtggtggctcacgcctgtaggcccagcactttgggasgccaaggcgggcagattacttgaggtcaggagttcgagaccagcctggctgacagtgaaaccscgtctctgctaagaatacaaaaattagctgggtgcagtggsgggtamctgtgg

SEQ ID NO: 13203 - DNA, 230 bp, Homo sapiens
ggscgaggcaggtggatcacctgaggtcaggagttcgagaccagcctggccaacatggtgaaacctgtctctactaaaaatacaaaaattggccggacgtggtggtgcacgtctgtgatcccggctacttgagaggctgaggtacaagaatcgcttgaacctgtggggcggagattgcagtgagccgagatcgcgccattgcactccagtctgggcaatagagcgagact

SEQ ID NO: 13204 - DNA, 442 bp, Homo sapiens
aggcgattactgggcaggctcagtctttcgcctcagtctcgagctctcgctggccttcgggtgtacgtgctccgggatcttcagcacccgcgccgccatcgccgtcgcttggcttcttctggactcatctgcgccacttgtccgcttcacactccgccgccatcatggtgaagctcgcgaaggcaggtaaaaatcaaggtgaccccaagaaaatggctcctcctccaaaggagtagaagaagatagtgaagatgaggaaatgtcagaagatgaagaagatgatagcagtggagaagaggtcgtcatacctcagaagaaaggcaagaaggctgctgcaacctcagcaaagaaggtggtcgtttccccaacaaaaaaggttgcagttgccacaccagccaagaaagcagctgtcactccaggcaaaaaggcagcagcaacacct

SEQ ID NO: 13205 - DNA, 374 bp, Homo sapiens
  misc_feature 318: n=a, g, c or t
ctatcccgtcatcagccggtggcagctccatcttccattcctggttttagggcagaatccatggagactgcttccagaaggcatctggctctgagttataaattacttccctggtcctgacagtcacctggggtcccccctctccctggttccacctttctgaggaggagcctggagtcagggctgggttttggattaacccatccttcctagttaacatctttttgtttttattttattttatttttgtttgttttctccgtgtgtgtgttttcctaatttatttacctctgtttcccctttttccttttttttttnaattaaagagcaaagctttttattactttgtaatttaaaaaactgaaaaaaaaaaa

SEQ ID NO: 13206 - DNA, 431 bp, Homo sapiens
cttctgatgttcggatgtgttcggagtttcttccttctggtgggttcgtggtctcgctggctcgggagtgaagctgcagacgtttgcggagattcacaagcctccctcccagattcagggaaggagatgcagcccccaccccttgactggaggaggaccaaggtcaccttgcagagcaccgtgagatgtggaagatgccagaactgtctgtgggaaatgggatttgtacttggcttgtctgcctcttgcaaccagagtcctggttctcagggcctcacctgtgcatctcttgttgagcacagaggaggcactcggcataaatgaagaggatgcttgctgagctggctggcccatcctctcttctttcccttgtttttctattttatstttcaaagcagtgtttcaagtgtttataaactaatctatgtata

SEQ ID NO: 13207 - DNA, 450 bp, Homo sapiens
aggaacagaaatgttgagaagggtagactgatgactacccctcagtggaaacagaccagatctcagcttatctggctggaaggaaagcaaaaaaacaaagcaaaaccaaccaaaaaatcctaagaaacaaaagacagattcaagccaatctgtgatttgtaaaataagccaggtgcaggcttgtgtgccttcagctgaatgtaagaagtccagctatcatgaagtctccatgtggacagacaattcagaggaatgagagagagagagacctgagcagctagcagtgccagcacctagatgtttgaatcttcccagcccagatacatgatggaaaaaacttcaagatgcccattggacagcaaccacatgaaagacctggagtgagaactcctaagctgagatctcactctttcagactccagagccaaataaataattattaatgtttaa

SEQ ID NO: 13208 - DNA, 404 bp, Homo sapiens
gagttttattatggacaatgtccagtgtcattgccaatactctccaaaatgatttgaccatgaagtacagggaggagaagagtattttttgaacacttgtaaatgattgcttttcttccataatagcacacatctaggtattttgcccaatttgcagatgaggcaaaaatttggagatgaatttcaaagaagtcgaacagctagatgagtgcagagatggagatttaatcaaagggagtctgctgtaaaactcctccacatgtgcaaattggccaatatgaaagcaatgaatatttgaaaattgaagttttctgctacttcaccaattttctcaagggctttgattcagttttctatatcagaaggtaaaaggcgagaggsttccatggmtgcctgtcaacagg

SEQ ID NO: 13209 - DNA, 490 bp, Homo sapiens
acagatgttaaataggaaattattacttgttaacttcttacagcagtagtaccttctttaaaaaaaaaaaagawtctgsggtattttttttaaaaaaaagtttactgctgtagtgtgaaatattgtctggaaagggatggtttaaatattaccatgatgtagttgaaatataaaataggatttggaaccttattgtgataaatatttatatatgatgtatgtttgtctcccctctccaaagtaaggaacccagctgggcgtggtggctcactcctgtaatcccagcattttgggaggccgaggtgggtggaccgcttgagtccacgagtttaagaccagcctgggcaacatggtgaagccccatctctacaaaaawtacaaaaaaattagcvgggtatgatggtgtgtgcctctagtcccagctacttgggaggctgaggtcagaggatggcttgagcccaagaggcagaggttacagggtcaagatcgc

SEQ ID NO: 13210 - DNA, 171 bp, Homo sapiens
attagaacctgtttagatttaaatattcttttaaaaataggagaaataatttgtgtcagataatgctttaaatttaagatattttccctcttttttttttttttttttttgagaccgagtcttgctttggcacccgggctggagtgcagtcagtggcatgatctctgctca

SEQ ID NO: 13211 - DNA, 443 bp, Homo sapiens
cagatgtattatgtatgaactttgtactatgtatagccagagttttatttattttttaaaaaagaaactttttcttgataaaggaataatggtggtctagctagttcttgtaaaagtgatgcctcttgaaaaaaaacagtcctattcactagcttttagtaaaagaatcagatcttttctttcttgttaccttggagtcttaaaaactgattgctaaggtgaaacaattcaatgcataagtatggagctaagtgccttttggaggatttcttggaagagcatttatggagatacttaagggaggtagcaaagatttgaaccgtctgtctttttaagtaagggcagaaagcaaggttgtccaggttgtactggacacttctctccccacccctttcctgattgttttatgtgattgattttaaattctcacactgccacttctt

SEQ ID NO: 13212 - DNA, 447 bp, Homo sapiens
  misc_feature 355: n=a, g, c or t
cacttgagtacagaagtaacaacattagctgcttcgtaaacaagatggcatgggagatattctgttttgagtaaatgacaagtcctacagtctagataggaagatttctcctccatatggattttgtgatttcgtcttgtgttgagtaaggaaggggagcttggattccaagatcaatttaatgtctatattccttggcattgtcatgttagagcagcacatctcagatggctttcaatagttattttagcattgattttcctctactagagtaaatcaaaagatggtttagaaaatcaaagtcagttttccttggagttttctcagaataaagggagctgtggtgttgaagggnttttttggctcctatttacatatgatgcaartcaatctgtgtgaatctctttcctctgttgagctctactataggctctactatatgcagag

SEQ ID NO: 13213 - DNA, 454 bp, Homo sapiens
  misc_feature 439: n=a, g, c or t
tttatcagtggacaaacttcctaaaaaaattcacacactcatatctgcatataaaccaacatcataaaagtactaaaatgacactgttctgaatcatgcagtctttgcaaataacaagctggctgaaaaatatctaaatataattttratttttgaactttttcttctaattggaaaattagctcatacctgtaatcccagcactttgggaggctgaggcaggcagattgcttgaggtcaggagttcgagaccagcctggccaacatggtgaaaccccatctctgctaaaaatacaaaaattagccggacgtggtggcgggcgcctgtaatcccagatactcaggaggctgaagaaggagaatctgttgagcctgggaggcagaggttgccatgagctgagatcacggcactgtactccagcctgggcgacaagagcangaactctgtctcaaa

SEQ ID NO: 13214 - DNA, 349 bp, Homo sapiens
agaaagggaacagcagctgagctgagcagcacatgcttggagcgttcctgccatcgacttcggattatttctgctttcttgagacgcagccatcagcatgggactcgatgcagcccggagagcaccgcccgcgcasacgcgcacagaccctcccttggagacgcgctccccggcgcgtgcggccgagcccgcgtgaaatgcacagaccctccggtgaggctctgccacgtgtgaccctgagcactgcgamsccttcccttccatcctcgcgtggccacccaaagtcttgcctacacctcgtacgtgcagatgccaatkccatagaaataaatgatgtaaggacagaaaa

SEQ ID NO: 13215 - DNA, 59 bp, Homo sapiens
acacttsgssccawactaattttaattggcgtagtctagaaaactcataattacaatat

SEQ ID NO: 13216 - DNA, 491 bp, Homo sapiens
taaatgaaaaattggccaatctgaatagaaagtatgaggaagtatgtgaggaagttttgcatgccaaaaagaaggaaatatctgcaaaagatgagaaggaattactgcatttcagcattgagcaagaaattaaggatcagaaggaacgatgtgataagtccttaacaacaatcacagagttacaaagaagaatacaagaatctgctaaacaaatagaagcaaaagataataagataactgaactgcttaatgatgtggaaagattaaaacaggcactcaatggcctttcccaactcacctacacaagtgggaaccccaccaagaggcagagccagctgattgacactctgcagcaccaagtgaaatctctggagcaacagctggccgatgctgacagacagcaccaagaagtaattgcaatttatcggacacaccttcttagtgctgcacagggtcacatggatgaagatgttcaggaggctctgctccag

SEQ ID NO: 13217 - DNA, 433 bp, Homo sapiens
taatgatgtgttgttatcctttcatttctagaaatggatccctggaattagatggagtattgtgaaagtataattttaaacaaatgtttttgtagagacggggtctcactatattgcccaggctgatctctaactcccaggctcaagtgatcctattactttggcctcctgaagtgctaggattgcaagtgtgaaccaccatgcccatcctgaaggtataattattaaratgctatccagtgttcataatctgcttatctaataattcaaatgctttgtttgccctgctgaggtcagactttggcctactctgtgaatgaatcagtttttgctgttgttacggatggtagagttgagtcaagatgttaatggcccttgtccaatatggggagctagttaagaatgtcttctgattctatcctgtggagtgaga

SEQ ID NO: 13218 - DNA, 469 bp, Homo sapiens
ttttaaataagatggttagggaaggcctcacagggagggtgacatttgaacagagccttgaaggacatgaggaagcaggccagatggatcacctgggggcacagcattgcacgcagaagaaacagcaagtgcgaagaccctgagtgggacagtccctagtttgtgctggtaacagcaaggagtccagtatggctggagctgagggagagggagagtagtaggtaagatcaaagagaaagggcaggggagattgtatagggcctcatgcagtttttaggcttttaactctgagatgggactattggaaggttttgagcagagtaatgacaagatctgatgtgccttctaaaatgactgttgtggctgccatgttgggtagactatatcaggccaggggtagaggcaagagaccagttaggggagctctttcagtatttgaggtgagaggctggatgctgtggctcacgcc

SEQ ID NO: 13219 - DNA, 128 bp, Homo sapiens
caaaaatccaatttctgttcttttttgtgactagtctgctggtaacattgccagtgacagactcaggagtcaaaacatggtgactggagaaaaatacacatgctaggttgtttatttaaaaaaaaaat

SEQ ID NO: 13220 - DNA, 351 bp, Homo sapiens
acgaaacctgcttcggcggcccgaggtgggggttttgagtcggttagtggaggcagtgggagcaggatgggcggasttctgttccaaaaatttcccctaagtgcggttgacagtgtgcaggcaggcgggggtgcgcggggcggtcagcgatctgcagcttcgcgggacagagatgtaacccaactcgttcacggatgttccgcgcgccgtgtcaccggctgcgggccaggggtactcggaaggcgcgggcaggagcctggcgaggatgcaccttcccctgccttggaaaggtagaactggggagtgcgggagggtggaggtggcccggaaaagaacacctcttcgcaacca

SEQ ID NO: 13221 - DNA, 459 bp, Homo sapiens
  misc_feature 384: n=a, g, c or t
aggcgtgasaccgcgcccggctggcctgttctttattgtggccatttgtatacttgtctttaaccccttgcttgactgtaagcctcttgggaatagggactatgacttagcactttatacgcctaaccctcagcgtgtagtatgtagtcatgcttattgaatgaactgataagtctctgtatacccatacctagacttgtgtgtaaggagtggagtaagaagattaagatgaagtgagcttaagctggaaatgtgagacagcatattgtagtgattgggagcaggattctggagccaggctatcctgactccacctcttactagttgcgtggccttgggcaagttcatgcctgtaacccccgtactttgggaggccgaggccgncagatcacctgagttcaggggttcaagaccagcttggccaacatggtgaaaccggtctctactaaaaatacaaaa

SEQ ID NO: 13222 - DNA, 477 bp, Homo sapiens
  misc_feature 161..162: n=a, g, c or t
actaaattggattcaaagacagttgagcagatctacagccctgttgggtccatccgaaaatcaaggtggccagtaaggtgacagctcttttaggagccttttacctgctataatctgtctgattattggattctttactcaggtcatagcacgtatcctcnntcccagcacatagcctgcacccagcacatctgagtgtgtgttctgaccacatcactattatgtgacctcccacgctcaggtcacgaaaggatcagcaaagaagggcaagaaggcccagcatttggtgcataccaggggcaaatcagacatcacagtattctatgtactattgtgtacctctgctctgggagccaaatccctggatttagttttattcttaaccattgagggatttggttaaatgatttctcactccagctgggtgtggtggctcgtgcctgtaatcccagcactttgggaggctgaggccagcgg

SEQ ID NO: 13223 - DNA, 56 bp, Homo sapiens
ctcactcgcrcrttargargctcggrtcgttrtrgtgcgctgtcttcccgcttgcr

SEQ ID NO: 13224 - DNA, 318 bp, Homo sapiens
gcgcttgactgacaggcggcggcggcgcagttgcgagtgcaggctccttgccagaggcctccactcactccagacccctatagcccgtcgctgtcagctgtcaacaaaggatgcgaatgctggccgcttcctgtgggcttcgtgtcacccagaggtgagcccaggccaggatgggggactccagggacctttgccctcaccttgactccataggagaggtgaccaaagaggacttgctgctcaaatctaagggaacctgtcagtcgtgtggggtcaccggaccaaacctatgggcctgtctgcaggttgcctgcccct

SEQ ID NO: 13225 - DNA, 499 bp, Homo sapiens
ctctggcccagagcgctcgggctgtcggtctagcaggggggactcccctgaggggccgctgcgggtcgccgtcttcggaggcaccggcgagggcagagcaacagcctcttcacggtctgtaaggtcattgtttgccagtcgtgggcagcgcggcaaacctgctgggaaaaggttttctggttggaataggatgagtaccgcaccagctttgccttccagctgagatgtaaatttcaggcctccatcctgtggaacgtgggaaaactatcttgagtgttggcatgttctaagtatgacataatagtttaatgtatgataaatcatgggtgtttagacgaaagatttacacatataaattggaggctttagcggtcttagtgtaactaacttttcgtcsccttaacccttgatgcstgttctatgggtctctagagcggaaggagcattatactcrggaaacatttgctggaaggggttatgagaattcctctctgtatgc

SEQ ID NO: 13226 - DNA, 478 bp, Homo sapiens
ataataataacaatgagattgaaaatgagggcacatggtgtgtttagggacggctgaggccagtgaatgtcaaggcagactgcatctttgacagcctcgcctcactggctcctgaaatcctcacacacaaaacagcattcttcttgtgttcttaaagtgaaaggcactgtttccctgtcacactagcaatgttgcgaagtaaatgtcatcctttcctcctccttggccctgccttctacagctagtgcccctgccagttgtttcctcagcacgtctccagcgttcctcttctcttccccctcggcacggccttacttctggtctcatcatcctatgcctgggctgatgcctttgcttcccagctgcagtcggctggggatgaatgtggggttaaggcaggcattccagatatttatagaattgttcatggttcttttcccattagccatgagttacttgagggtgaagatagtgtctt

SEQ ID NO: 13227 - DNA, 86 bp, Homo sapiens
ctktctttgctttaaattcctggcacttctttttactgtctataagakaaaacctatcataagcccaattttttttttccacttag

SEQ ID NO: 13228 - DNA, 419 bp, Homo sapiens
  misc_feature 3: n=a, g, c or t
ttntttstgtgvtattgscatccasttctccttctacccatgccatttctcatacctggaccctgaatttaacagcaacccagctgcaaacagcagccactgatgatgcagggatgcagagcagcaggagaaaagaagctgggtctctgagtgactgtgtggagcagagctgccttgccatcctgaacaacatactccttgactttagcattgcggtggactcctgaagggtattggaccggaaaaagtcattcgagatgagaccaacgtgcttagaaccaaaggtttgtttgggctgaacacaggtcttgccaggcactcaggataatagaatttggagaagagagaagaaatgtaagcccaggcaccaagabgatcagtgaatgagaaggaatgattaagaggstggaagacaacac

SEQ ID NO: 13229 - DNA, 446 bp, Homo sapiens
ttagacggacatggtggtgggcacctgtagtcccagctacttgggaggctgaggcaggagaatggcgtgaacccgggaggcggasttgcagtgagcagagatcgcgccactgcactctagcctgggtgacagagtgagactccgtctcaaaaacaaacaaacaaacaaaataggtaaaawagaaaattgaagtcatatataagctcaccttcagaaatagccacagtcagccaagcgtgttggctcatgcctgtaatcccagcactttgggaggccaaggcaggcagattacttgaggtcaggagtttgagaacagcccggccaaagctgacaaaaccccatctctactaaaaatacaaaaattagccggccatggtagcatgtgcstgtaatctcaactacttaggaggytgaggtacgagaattgatggaacctgggaggtgga

SEQ ID NO: 13230 - DNA, 517 bp, Homo sapiens
taaaaatgtgaaacttgggtttggtgttttcttctaagtgcctaaataagcaagccaggctgttgatattttagccagagaaatcggcaagccaagattaacccggatctgaagtttagaatcttgagtttgcatctgcatcatatcatgctgttttgatgaggaaacatttgccactgaggagttggagggagggcaagacgacagtgttaagtcagatcatttaatggtttcccctaagccctggaaaaatatttgaaagaatggcagcaaaaaggttaagaaagcaagccagatttactgcacaatatgcagtacccagtactactttaaatcccaagagaacagtgtgatgtctaatatatacaggtctatgaaaatactgtggaataagcccaggaaggttagatgtgtttgcaaataagtttgcccaaagggtccccctctaagtaaaacaaatattcagaccacaggctttaatgtaaactgtcaaaaagtgggatgtggaggatttttg

SEQ ID NO: 13231 - DNA, 444 bp, Homo sapiens
cttcattcctacttagaaaaaggtatttagtaaaaagtattaagtaaaaagttgtgaattgcctggtggtggctataactctagttttctgttttcacccagggcatgtgagtgctgtctattaaaatgttaggtatctaacaaagccaagatatctttgagagagactttaaatcttctgtagaaggttaacaaacttctatagaaagttattctcctgcctaggcctcccacagtgctgactactgtgtgttcattaagaacaaaattcacggctgggtgcagtgccttatgcctgtaatcccagcactttgagaggccaaggcaggctgattgcttcatctcaggagtttgagacctgcctggacaacatggcgagactctgttctaccaaaaatatcaaaaaagagcctggtgtgtgcctgttgcctcaactgcttggga

SEQ ID NO: 13232 - DNA, 443 bp, Homo sapiens
taaaatctgattaaaactaaaattgagttttttgaagtctgattatcccatgaaatggaattttaaacctaattacagatggatttgcatatacttttcagcaccattgaaaagaaacttggtataaatttattaatgacatccttttctctcgtttccttggggcatgacgttagtttaggagcatgagggaggtggggagaaacaccacccttctccccgcccttccttagaattttttaaaaaactttactctgtggagaatcagttccctaggagcctggggcatagtcacactttcattctcatctttgctgctttaccggcttaggtggctgatagttttcctgaattgtttttcaatactcagagctcttgtctttcggaagatggaagaggagcatgcacgatcatagctgctggtgtgtcttccctgtcagctt

SEQ ID NO: 13233 - DNA, 455 bp, Homo sapiens
taaatagtaaatggtagctgctggtgatgattttttaaaaaattactaatagtgttgccagcatggtcattattataaagctacttagagtaatagatatattataaataacaaagggcacaagtgattaatagggatgttaataacctttttgcactaaatctgcatttagaaaaggaccaaaaagctatttgttgcaggcctgcagtgactctgagattcaaaagtaagctgctttttggcctggcgtggtggcccatgcctgtgatcccagcactttgggaggccgaggtgggtggatcacctgagatcaggggctcgagatgagcctggccggcatggtgaaacccgtctctactaaaaatacaaagattggctgggcgtggtggcggggacctgtggtctcagctactcgggaggctgaggcaggagaatcacatgaacccaggaggcgg

SEQ ID NO: 13234 - DNA, 444 bp, Homo sapiens
  misc_feature 62,369..370: n=a, g, c or t
cakaagaaggagaatgagaccagggtggtgcwgtrtgavmtgggcaaccccatgaagaagancgcccagataggaatcgcgatgttggtragcgtggggaatctggaagaggctggggaktctgtgtccttccagctgcagatacggaggtactgacctggcgagcgtgcctacccaccacccttcccccgtctgacccccgtgcagagcccctcaggtccyttccatacagaagggtctttcgaggccaggcgcggtggctcacacctgtaatcccagcacattgcgaggccaaggcagaaggatcactggaggtcaggagttggagaccagcctggccaacatggtgaaaccccatctctactaaannataaaaattagctgggcatggtggtgcgcacctacaatcccagctactcgggagcytgaggcaggagaatagct

SEQ ID NO: 13235 - DNA, 446 bp, Homo sapiens
  misc_feature 39: n=a, g, c or t
gcttcatcttctggttttcctaatagaagatggtttccnatgacttcaaccagaaggttctcaaagtgtggtctctggactggcagcatcagcatcacccaggaacatgtagaaatgcaaatttatgcaaatatgtgacccagtcctgtaatcctagcactttggtaggccaagagtggtggctcatccctgtaatcctagcactttgggaggctgaggcaggcagatcacttgatgccaggagtttgagaccagcttggttaacatggtgaaacttgcctctactaaaagtacaaaaattacccaggcatggtggtgggcacctgtaatctcagctacttgggtggctgagacaggagaaccacttgaacctgggaagcagcgtttgcagtgagccgtgattgtaccactgcactacagcctgggtgacagagtgagactgtcta

SEQ ID NO: 13236 - DNA, 454 bp, Homo sapiens
  misc_feature 200: n=a, g, c or t
catagtggaatgagccagatggaggaagaatgtggctgggaaaacaggatgcttaaacttgtagtttctggaggtggagcaatttcaggtttgacggtvcagggaatgagtggctgtactgggttgagaacaagagtcactggacatgagaagtaagcgggaagccagggtatttaaaaagggacctgtgacttctgaanccttcctagcgaggcagggaatggcttggagaggaaggtccagccagtggcaaaggcctcagtgaacgaaggggagaggaaacgaagtcatggccggttgcagtggctcacgcctgtaatcccagcactttgggaggccgaggagggcggatcagctggggtcagtagctcagaccagcctggccagcatggtaaaaccccatctctactggaaatacaaaaattagccaagcgtggtggccgcacttctgtaa

SEQ ID NO: 13237 - DNA, 452 bp, Homo sapiens
atattatactaagtgaaataagccagtcacaaagggataaatattgtatgattctagttatatgtggtacctagaatagtcaaattcataaagacagaaagtagaatggcggttgccaagagtttggtgagggggtaggagtggggagttattgtttaatgggtacagtttcagctttgcaagatcaaaagaattttggagattgcgtgcacaacaagtgaatgtactaaaactacttgatatggtttggctgtttccccacccaaatctcatcttgaattgcgattcccataatccccacatgtcgttgggggtactggtgggagggaattgaatcatgggagcagttaccctcatgctgttttcatgatagtgaatgagttctcacaagatccaatggttttataaggggcttttccccctacccttcattctcattcttctctctccta

SEQ ID NO: 13238 - DNA, 473 bp, Homo sapiens
ttcaaatgtgttttatctctaaatttgaatgtccaatctgtatttcacattgttcggtctaagctctccatttgcttgtgtttaaaactaagatattaggccgggtgcagtggcttgtgcctgtgatcccagcactttgggaggccaaggcaggcggatcacctgaggtcaggagtttgagaccatcctggccaacatggtgagacctcatctctactaaaaatacaaaaatcatctgggtgtggctgaagatgatgtggaatgagaaacaaatgtcaacataataaaatctcagttaaagtattttaaaaattcttagttgagcagctctgggggaataagggcaaatatgcttgttatgaactgcactgaaatctaccaaagttaatgtttactttgtgtagatccatttgtctattttatttatttttcccagtgaaaagtgtgttttgatagagaacttttcattctat

SEQ ID NO: 13239 - DNA, 433 bp, Homo sapiens
gatagatgtatagtacagatgtatggtacaaattaaaaccatctcattgtggttttaatttgcatttctctgatggctaatgctattgaacatttttttcatgtatttatttgctatctgtatatccttttcagtcaactatctatatttcttacgcattttgaaattggattgttcttttgactgttgaattttagttctttatagcttctaaatactagtcctttgttagatatgtggcttgtaaatatcttttcccagtctacagcttgtcgtttcattaccttaataggtcttttgcagagcaagttttacattttgatgaagtacaatttatcaacattttcttttacggatcatgcttttggtgtcaagtctaataactcttaaaagagttctgggcatkgtggctcacgcctataatcccagcact

SEQ ID NO: 13240 - DNA, 414 bp, Homo sapiens
atcaaatcgcagacatcatgtaattttgcctgactaactttgctatgcatttctaacttaggacttaaaaaaatcaccaccccattatcacttttaatacaattaacaataatttaaaaatattatctaatttgggctgggcgcggtggctcacgcctgtggtcccagcactttgggaggccgaggtgggcggatcgcgaggtcaggagattgggaccatcctggctaacacggtgaagccccgtctctactaaaaatacaaaaaatagccgggcatggtggcgggcacctgtggtcccagctactcaggaggctgaggcgggagaatggcgtgascagaagacggagcttgcgtgagccgggatcatgccactgcactccagcctgggcaacagagcaagactccatcacaaa

SEQ ID NO: 13241 - DNA, 437 bp, Homo sapiens
atttgcaatatcatttcattggctaagaggttgccccagtgctacaatgtaagcttccgtctcattttgcagtgaatgaaaacatttttccttacatagttgtgtatagcagaactagtatctatcccatggtgatgctagtaagcctgactcacaacttcaaaaagaactttgaaataaattatatggatcttatgaactgtaataatctttaatttcaacttcattatgaaaatttatggctgggagtcgtggaatcgtgcctatactttgggaggctgaggtgggtggatcactagagcccaggagttcgaaaccagcctgggcagcctggtgaaacctgtcttaaaaaaaaaatmcaaaaattagcygggtgtggtggtgcatgcctgcagcctcagctactcgggagctgaggtgggaggatcacctgagct

SEQ ID NO: 13242 - DNA, 432 bp, Homo sapiens
attctacttctgggtatgtgccagatttcagtgacttgtttatattgaataacatgtgccggagaaatggctcacacctgtagtctcagctacttgggagtctgaggcaggattgcttgagctcaggagttccaaggtgcagtaagctaagatcaggtccctgcattccagcctgggtgacggagcaagactctgtctctaagaaataaataaataacgtttaaaaagtgtggcagaagtgtgtaagtttcgaatcttgttcacaaaaggcattgcggcttattccttsssstttctctttcttttttctcctgctaagagaaaacagttgtttggttttgaagataatcagttacccctctagagaggtctaacgggcaaggaactgaggcctccacccaaaagtcggcttgaacttgccagatatgcgag

SEQ ID NO: 13243 - DNA, 89 bp, Homo sapiens
aaattagctgggcgtggcagcatgcgcctgtggtcccagctgctgggaaggctgaggcaggagaatggcgtgaaaccgggaggcggast

SEQ ID NO: 13244 - DNA, 418 bp, Homo sapiens
tcttttgactctccagaaaggaaacggattaagtactccagggaaacgtgacagtgatcgtaaacttgttgataaagaagatatcgacactagcagcaaaggaggctgtgtccaacaggctactggctggaggaaagggacaggcctgggatatggccatcctggattggcttcatcagaggaggctgaaggcggatgaggggccccagtgttggagcctcaggaagaaccagcaaaagacagtccaacgagacttatcgagatgctgttcgaagagtcatgtttgctcgatataaagaactcgattaagaaaggagacaagttccatgggatacaacctccctcttgttttgtttgtctctccttttcttttgttactgttcttgctgctagaacttttttaaataaactttttttc

SEQ ID NO: 13245 - DNA, 467 bp, Homo sapiens
taaaaacctgtacacagtgtttattgtggttaggaagcaatttcccaatgtacctataagaaatgtgcatcaagccagcctgaccaacatggtgaaacccatctgtactaaacataaaaaaattagcctggcatggtggtgtacgcctgtaatcccagtgacttgggaggctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccaggggtattttctaattcagatcatcaaactgattatatagaagagttggctttaaaatgtttgcaaatgtctttttttttttaatactggaagaaaaaatattctgttgtgtctcatacagtgcttaggatgtctttcacagrgcttattaaaaagatg

SEQ ID NO: 13246 - DNA, 459 bp, Homo sapiens
taaaaaaatagatttataataatagtcatcagcattcttttaaattgtgacaagttagtcttagaaggatacaaaaatgtataaaagacttgtgaatttctgacaaatttaaattaggatatgtccataaatagcaattaaaattgtttccaaagagttatttcaaagcatcacatattacaaaaaaatggtgaaaatataaatataggtcacaatttataggacttttgtatattgtgtatgtttccatagaaataggtaaaggaaataatggtttctttttgggttataggcttacagatggattttctatagcaggcgtatgttaccaaaaaaatgggaatgggctgatgcttggatattaacttaaaaatgggatacaaactggccgggcctggtggctcgtgcctgtaatcccggcactttgggaggccgaggtgggtggatcatgaggtcagg

SEQ ID NO: 13247 - DNA, 109 bp, Homo sapiens
tcgtcttctatttagagaatttcctttaaccattattttagaatgtctgcttgtgacaaatctcttggtttttcatcatctgagaatgtcttaattttttttttttttt

SEQ ID NO: 13248 - DNA, 457 bp, Homo sapiens
atttctataggatctgggtttagagtgtgtatcattaataaatatacctttgctcttttcagggaaaataacaaccacccttactgatagttgggaaaagaagattgggttattttgccatatcatttagctggaagtgacatttaaaagcaccctgcatcactagtaatagtgtattttgctattctgcccttgtaatcggtgtccctgtaaaacaatccccacagattactttcagaaatagatgtatttctctacgtaagggccaggtttattttctccttttttgagatttctagaaaaaatgctgcttgcacatgttggttcttgaaaccttagctagaagaatttcaggtcataccaacatgtggataggctatagctgttcagaggtctcctgggggagcttaaaacgggggaaacactggttttcacagatgctccacatggctgtctt

SEQ ID NO: 13249 - DNA, 485 bp, Homo sapiens
caaagaaagagatacaggataggattatcaatggcctggmtcgcagggacttatatagtatgttcctgacctctctggtggagtttaatggaaatggctttggagacaggaaatactgggttccagccttgtctctgtggcatacttactccatgaatttaggcaagttatttgtctcttcacatggtcattgagaaaatgaaataacaaatctgtatcagtaaggcacctgggacagtagcctcttgatggatattacttttctttttcccaggctgtcctgttgccatcttcacacttttgcctaaatgcagagtttgtttgtttgtttgtttgttttttaatagctagggcattatttaaacatttttgttaattgagaaatatctgaagcagtttttaaaaaaatagggagcactggccaggtgcggtggctcacacctgtaatcccagcactttaggaggctgaggcaggtggatcatga

SEQ ID NO: 13250 - DNA, 445 bp, Homo sapiens
tttacttatgaattggacagtaagtctgaattaatttcacaagattcatagcttcttttatgctgcagaaaagcccagggcaaagaataagaagaaagacattcatgtgtttattcattcaacaaacatctttgccggcatagcgtgggaggaggtcaccagacccttctcctgggagtttccctcccttctgagtgccacagatcctccctgaaatgtgtggccgtagagccgccgttgcctccatgacttagcagttctctgcttcctttgcaggggccctggcctccagtctgagtgctgacctcgaagagcccctgagtgaggaggagacagaacaccctctcctgcctctgccccgagccactaaacccagaatctccaggaaatttcgttgctgtactagtgccctcagcaggtcttcccattagtggacttctgaagc

SEQ ID NO: 13251 - DNA, 174 bp, Homo sapiens
aattgctcgcattacggsctgagstcactgcstgtsagatcagtggcaccattagattctcacaggagcatgaascctattgtgagctgcgcatgcaamggatgtagcttgcamcctccttatgataacctaatgcctgaggatctgtsactgtctcccatcacscctggatgg

SEQ ID NO: 13252 - DNA, 469 bp, Homo sapiens
  misc_feature 467: n=a, g, c or t
catcagaggcttagaggcgagtgggaagggactcagacagtgcaggacgagaaacgcccgtggcaccaaagcccctcagagcgtcgcccccgcctctagttctagaaagtcagtttcccggcactggcaccccggaacctcaggggctgccgagctgggggggcgctcaagctgcgaggatccgggctgcccgcgagacgaggagcgggcgcccaggggcaaccgctgtcatgagttacagtccttccaggatgtgcctctgaaaatggattgcatataaatgtacgcataaacaacacgtaggattgttttgtgtgctttaaaaatgctatctatgcagtggttcatgcctgtaatcccagctactcgggaggctgaggcaggagaatcgcttgaacccggggaagcagaagtcgcagtgagccgagatcgcgccattgcactccagcctggacaacaaaagcganac

SEQ ID NO: 13253 - DNA, 450 bp, Homo sapiens
agttggggcgccgcttcccctccaaacgttggggcctgcactctcaacctgctataaggaagttaaaccgcagctcaccgaggagtagggtgtctacggggcgggcccgtgtagaccagctgtgctcctcgggcacaaacccgccgtacatgccaggcctagaagcttttggctttgtggacgcaaaatctggttggagccgccttctccaccctgactctcccgcctctcctttttagaaggaaccgcactgagaaagggtatttctgaaggctcaatgcgtaggagaaggggtgggaagatgggtttgtggaatgggctgagggtggggagtggtcaggtgactgatttcatgtttattgtacagattcctaaaacatagttttactaagtgactccttaaattctgattaatgtgatttttttttttttttgagtttttgggttttt

SEQ ID NO: 13254 - DNA, 488 bp, Homo sapiens
ttaaggaaacagttggaagacaaggaaggcaacagacatagattagccatttgctgaaggttaactgggaaaagaaggatggaggaaggctataccgggggctgcagagtgcagatgtgcatgtgtaatatgggagggagctgagggtttatatgctgaggggtaaaaggtgggatggagtcaggattgaaaatgaggaagagaggccgggtgcagtggctcacgcctgtaatctcagcactttgggaggccgaggcgggcggatgacaaggtcaggagtttgagaccagcctgaccaacatggtgaggccccgtctctactaaaaatacaaaaattagccaggtgtggtggcgcacgctataatcctagctactcgggaggctgaggtaggagaatcgcttgaacctgggaggcggaggttgcggtgggccgagatcatgccattgcactccagtctgggtgacagagcgagactcccgtctcaaaa

SEQ ID NO: 13255 - DNA, 257 bp, Homo sapiens
acgttttgcgtcttgctgtgcgtgaggaagcggggatccaggtcaaggctatggaaagttccagaagcaaaaacaaaaaaagttcgggtacagcggctcacacctgtaatcccagctcttagggagatggaaactggaggatcacttgaggccaggagttcaagaccagcctgggcaacatagcaagacccagtctcttaaaagaaaattaaaaagaaagagtaaataaagttccagaagctttgctctcctcaaaa

SEQ ID NO: 13256 - DNA, 479 bp, Homo sapiens
ttgagattcagtggatcagcaatcgctacctggacttttcctccaaagaagtcaaagagtgagtggcttccagtcctggggtcagagctatgaatatawtgagggacactgaggctcaggcctctgaccagcccctctccccgcacccagtgccttttcctctccatcgggtgcacaacttattgctgcgtatgtgagggtgtatcaggtggaacatatgaaattgctaatattctacctctttgacccataaaaaatgacaacttcatagggttcaacctaacattggctaaggtggtaggaaggtatcaatttatataagctgtttggataggagccccttgggatgaagagccaggcagcaatgtgtgtccactttatacagagggatggaagtcattcatagatcacaaacactgaggtactatttggctattttgtcccatttcattcaaagtagatggattcagtcccagaag

SEQ ID NO: 13257 - DNA, 464 bp, Homo sapiens
tcaaaatataataaatttatttaatcaaaaatattaaaaagatatatagcaggaagaatggctttattggaaattcactccccaaacttaatcatattacaaattacttctataaatgcatattgtacaaaataggaatagatctgatgcagtcatgattccactgaatgagctgggtccttccaagtgctcctggtagaggtgggctgcagtttgcagaagaaagaaaatattaaggcttaagaatcctggccgggcacggtggcacatgcctgtaatctcagcatttgggaggctgaggcgggcagatcatttgaggtcaggatttcgagaccagactggccaacatggtgaaaccttgcctctaccaaaaacacaaaaattagtcaggtgcagtggtgcacacctgtagtcccagctacttgagaggctgaggtatgagaatcgcttgwaacccgggaggc

SEQ ID NO: 13258 - DNA, 469 bp, Homo sapiens
attgagggtgattaaagttaaaaagatgaatctaagagggacataacgattatttacctggtggatcctgactagtagaattattgtattggtagggagtctgtgacgtgcttttcctcagtgatctgtaggatcaaaatcaggtctggttaagccctgtttcctggaggaccctaaactgaacatgaaattgcagtaatcataggggatctcttccctccgaattttccggagctcttccccaagaggatccgtgaagactagtgaggaggaagcagctgctctattaggggaggaggggagttccttgccagctcttgacttctctgtttcatccttcagccaacagtgaagtatgagcgacascagagtacctggatgctacaggtggaacctgcacccctatcaaatggagggcctgaattggttgcgcttctcctgggctcagggcactgacaccatcttggct

SEQ ID NO: 13259 - DNA, 184 bp, Homo sapiens
actcccaagatsgcggacctactggsctccatcctgagctccatggagaagccacccagcctcggtgaccaggagactcggcgcaaggccgagaacaggccgcccgcctsaagaaactcacaagagcaagasaaacaacagaaagtcggagtyycgtaaaaggatggagaaggaggtgtcagat

SEQ ID NO: 13260 - DNA, 475 bp, Homo sapiens
taagaacgcatggacacatagaggggaataacacacactggggcctatcagagagtggaagctgggaggagagagaggagcaggaaaaatacctaatggctactaggtttggtacctgggtgacgaaatagtctgtgcaacaaacccccatgacacaagtttacctatgtaacaaacctgaacatgtatgtacccctgaacttaaaagtgaaaaaaataaaaaatatatatacacaagtcattataatataaataataataattgataatagadagtacaccgtgctatgcaaatgcaaaaggaggatgccttcatggggaagatggtaaatctcaaggggaagcattaagcacgaaaatctgttataattattggagaaccaagatattgttagtatttaatgaaaacagaatcctgaaacacatcattactgcagaaacaataaagaatttttatccagcaaaattaaacagt

SEQ ID NO: 13261 - DNA, 289 bp, Homo sapiens
acactgctggttaactgcttcggaagaggacagcccgcagtctggagtgagcagcgamsagagaaaaggagacggcctttcggacaagggactggttggtttgttcttgtgcagagaacccactcgctcactctcaaacggtagctgttcggtttatttgtccttttgcagtgtatccggagccccactgtgtgcacgcacttgcttccggcagagatcctgcccttcaggagcaactaaacttgttgcaaataaagtgctgtgaaagtgcaaaaaaaaaaaaaaaatc

SEQ ID NO: 13262 - DNA, 238 bp, Homo sapiens
gattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccaccagtgcccactcaaagtttcttacggcataggcgaggaggagcatgatcaggaaggccgggtgattgt

SEQ ID NO: 13263 - DNA, 475 bp, Homo sapiens
tacagacttgtttaattattctcatcattattagagaaaatgaagtaccttgtggttccatttttagagaatttgggggaaagcaggaaaaaatacattgtagtgataataaaaatatctaatactgtgtactattattatccacaggttttaaccacattctgccttatttctacataatttatttcaccatgttgcttgtccaccgagaagctcgtgacgagtaccactgtaagaagaaatacggcgtggcttgggaaaagtactgtcagcgtgtgccctaccgtatatttccatacatctactaatgctcttctggcttttctacaaaatactcctgcaattccagctgccatttgcaaaaacaaggaaaaaaatccgaaactttcttttgttgcactgacagggtctgtacttttttttttctttttgagtcaggactatggagccgagtagttgatcttttaatatagcc

SEQ ID NO: 13264 - DNA, 94 bp, Homo sapiens
catagctggagtttgaagctttgaagcaaaaatatctgtagaacatcttaaacgtgaccaaaatatgatgttaaaatcagcaactctttatacg

SEQ ID NO: 13265 - DNA, 467 bp, Homo sapiens
cgggttgcttttaaaattatagtccttatcaatggaaactccagatttctttatcaaagggaggtgggtgggcatgaatctagttggaaaaggggacttgaagctaagtttacatggcactttaagactgagaacatgtcaattgttcataatcaggaatatggtagagggagagcaggtgtagatgatgggacgggaaagtgctgaaaccagcccagcagacctgtgagtcgcctctggttctcacgcagcagtgtgtgtgtgctcacagggatgttccacccctggttctcatgcagtagtgtgggagagtgctgaagccggcccagcatgcctcttagttgcctctggttctcatgcagcagtgtgtgtgcttacaggagtggagatgatgggatgggagagtgctgaagctggcccagcatgcctctgagtcacccctggctctcatgcagcagtgtgtgtgc

SEQ ID NO: 13266 - DNA, 197 bp, Homo sapiens
akctgggagttgaagagcsgatgggcagcaggcagacttgagtctcctttctgtcsatgggctcgggccactgtctcaggtccacccgtggctccaaaatggtctcctaggtccgtgatagsaaagatccaggaaatactgcagaggaagatggtgcgagagttcctggccgagttcatgagcacatatgtsatgat

SEQ ID NO: 13267 - DNA, 482 bp, Homo sapiens
gcggcgtcgccaggaggagcgcgcgggcacagggtgccgctgaccgaggcgtgcaaagactccagaattggaggcatgatgaagactctgctgctgtttgtggggctgctgctgacctgggagatstgggcaggtcctgggggaccagacggtctcagacaatgagctccaggaaatgtccaatcagggaagtaagtacgtcaataaggaaattcaaaatgctgtcaacggggtgaaacagataaagaactctcatagaaaaaacaaacgaagagcgcaagacactgctcagcaacctagaagaagccaagaagaagaaagaggatgccctaaatgagaccagggaatcagagacaaagctgaaggagctcccaggagtgtgcaatgagaccatgatggccctctgggaagagtgtaagccctgcctgaaacagacctgcatgaagttctacgcacgcgtctgcagaagtggctcaggcctg

SEQ ID NO: 13268 - DNA, 399 bp, Homo sapiens
actccggcatttgcagcagagcgaaaggtggtggagtcctgaaggagggcctgatgtcttcatcattctcaaattcttgcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaaggtgatggtcctggactttgtcactcccacccctcttggaactagatggggtcttggaggaacatgtgtgaatgtgggttgcatacctaaaaaactgatgcatcaagcagctttgttaggacaagccctgcaagactctcgaaattatggatggaaagtcgaggagacagttaagcat

SEQ ID NO: 13269 - DNA, 404 bp, Homo sapiens
  misc_feature 323,400: n=a, g, c or t
gagacatcccctgagaaggccagggtcagactggctgggctgcaasagccggagtgcctgcsgtgttcctgcagtttccagtgtgagctgcagaggagagacagccactttgtcctgaccacctggccgtgggccctccctgtagagccacactgcaggaaaacaaggctgcttcagcccagcgagacccatcttgcctgggtgccacctcccagcctggatcagcactcggagctcccacctgcctcccaggggagtgggcatccaccctgagcacctggttctaggaatttcccttcctttcatttctgaggcagtgccgnccggcttggcatctcatgctgtctcacgttccgcagctggtctgggcccaagtgctgaggactcagggatccctganaccg

SEQ ID NO: 13270 - DNA, 215 bp, Homo sapiens
aaaagctctcaacttcgggagctgaggcgcaggctggccagagcgtggagaggaaagccctttccatcctcaaggccgttgcaggagatgcccgcragccaccttcgccagcaccacaccggggtgtaatggataggtaacagagaagacctcgtcccttcctagtcagggcatcagcatgactgartgcttcctgccccccaccagcagcccca

SEQ ID NO: 13271 - DNA, 367 bp, Homo sapiens
  misc_feature 177: n=a, g, c or t
tactgcaacctctgcstcccgggttcgggctgaggcaggagaatggcgtgaacccgggaggcggasttgtagtgatccgagatcgcgccactgcactccagcctgggcaacagagtgagactctgtctcaaaaaaataaaataaaataaaataaaataaaataaaataaaatadaancacttaawatcaagctaatgtgattatccttcacaatagcactgcgattagaagtttatatgatgatcatgttaagatgaacatggggattggggtgctaactttatatatatacacacacacttatatacatatacatatgtatatataaagwtctctatctatctatctatctatctatctatctata

SEQ ID NO: 13272 - DNA, 465 bp, Homo sapiens
tttagtagagattgggtttcgccatgttggctggrstggtctcgaactcctgacttcaagtgatccgccttggcctcccaaagtgctaggattacaggtgtgagccaccatgcccaaccataaaagccggtttaatttaggggagttggccaaattctttcataacctaacaccactcctgcagagttctttccaaaatattagctggtacaaaatgctccattctctcgtgaagcactaagagcttggttggaaggctggtgataccatgctaatgctgtttggcttctggttaactcctttcctcccctctccttgacagcttctacccaagcaagatcctcccacggctggataaaaaccacaaccatagcttcaaactgtgcttagtagtgtgactaggttgtggatctcttggtggtacaagtattcagagtcccttggtcaaaagcagtggtagggact

SEQ ID NO: 13273 - DNA, 199 bp, Homo sapiens
gttttagggagggagagcggcctgggtcctgggtgttgtgtgcggasgtgtggcgtcgcgtgtgaggcgcgtgcagggtgagtgtgagtggacgcgtgagtgtgtgagtgtgcgcgcttggagcgtgttaggcgagtgcgtgcgcccacccctgcgcccctcctcccgcttacactttgatcttatttgatcggatcgt

SEQ ID NO: 13274 - DNA, 322 bp, Homo sapiens
caacaatgtaaatttgtttaaagaatatgcaggatatggccgggtgcagtggctcacacctgtaatcccagcactttgggaggccaaggcggacggatcacctggggtcgggagttcaagaccagcctgaccaacatggagaaaccccatctctactaaaaatacaaaattagccgggcatggtggcacatgcctgtaattccagctacttgggaggctgaggcaggagaatcgcttgaatccgggaggcagaggttgcggtgagccgagatcgctccattgtattccagcctgggcaacaagaatgaaactctgtctcaaa

SEQ ID NO: 13275 - DNA, 419 bp, Homo sapiens
aasaaattcctagaaacattaactatcaaaatggactcaagaagcaagaacatctggagagacaaataacaactaatgagattgagttagtaatcaaaatacttccagcaaagagaagcccaggaccagattactttactggttaattcttccaaattttaaaagaggaattaatagcaatacttctcaaactcttccaaaaatcaaagaaaatattacttcctaactcattctgtgaggccatcattactctcataccaaaaacggaaaaagatattacaaaaaaagaaaactgtaaaagcccttgacaaaataatgacaatatccagcagtatattaaagaggattatacaccctgaccaagtgttctttatcccagcaatgcaaggttggttcaacatatgaaaatgaattaatac

SEQ ID NO: 13276 - DNA, 432 bp, Homo sapiens
  misc_feature 412: n=a, g, c or t
ataggaaatgtgtaagttcgtctaaaagctgatggttatgtaagttgctcaggcactcagatgacagcagattctgggttctgggagtgttctgtgcctcttacatgccctggaggcctcatggtctcagtgctgaggcggcacacctgtagcacacctgcgtaatgtgcggtctgggccagtcacaaggaattgtgttgtctaagccaaagggggaagctgactgtgatttaccaaaaaaaattctgtaattcaaaccaaaatgtctgcggaatcaccagtttgatactctctgtaatcagaacagtgggcagtgcctgggtgaacgtgtctagcagccactgtgcgggatcgctgtaacaggagtggaatgtacatatttatttacttttctaactgctccaacagccanatgccyttttttatgaccca

SEQ ID NO: 13277 - DNA, 466 bp, Homo sapiens
aggccccggcttgctcaccacccaactcatacccgcctcatcggctgttcacacgtgcacttcctgaactaccacattctacagtgataataatgactgagttctgtcttattcggtaaagctcttgggtacagtggtgatcatgttacacacatatcaagtggtgtgggaaaaaagcatccagaaggcaatttcaagcatgcaaaatgggatcactgacatggaaaatcagtgacatctgattcccattgtgccagccttctgtaaatatgtaagtaagtggaattttgtcaraaggttcttagctattatgaattaccattgcattttaaagatcaaaatttctaagagagttttaggaaagccttgcacattcatagttgtgttttttagctcatactgcttcttgaaacccaagcattttgaaacttttgggatgctcctgggtatgtagcttaaaattgtt

SEQ ID NO: 13278 - DNA, 351 bp, Homo sapiens
agacccgctcccgaaaccttgtcgaaggaccaaaggcgaccggtgcaggtgcacgacgccagctcccttctggggggccggggctgggggttgccatggcscccagccacctgtcagtgcgggagatgagggaagatgagaagcccctggtgctggagatgctgaagtgagtcctcaaccaccctgggcccagaaacagaggcctgccgaggggaggagcctggcctctgtccacccgtcagcagtgtgaagtctgttgtgtttgagcttctcagagtggaatgactccttttccttcctggccctcgggggctctcgaggtcagcctctccaacccctacctcagctcct

SEQ ID NO: 13279 - DNA, 465 bp, Homo sapiens
gacattttgatttcagatctaaataactggtctcaacacaagacagacatccccccaggtagtgtataagagaagtcgctcatagtttggtagaaatgccctctcagcacctccacctccctttgctctaatttgtcatgatgaggcatgggcagcactcacacagaacaggtcattcctcctttcaacgagggtttgcagggccaggccctgtggggtgctgaggatgccagggaaggtagggtatgagccctgtttccggaacttcctgaggagtggctggctccagatcgggctggccaggcaaggagacaggcagttccggtgctgggcacacacagcccatgtcaggatgtaaccaaagcatgggaccgggaactagggcaggaaggcaggaccaggaactctggtttgtaggatctggagcaagtcaaaggtgagggcaggaggtgagcagctctgaga

SEQ ID NO: 13280 - DNA, 434 bp, Homo sapiens
atcgcattaggttcttttttttaaatttgttcttggtttggttagtttttggccagtgttgggggtgggagggttggcagcaatgcagttggtcttgcttttttaacttttatccttatttttgttatggaaaagtttaaacataagaaaatcctgtggccaggcacggtgggtcaagcctgtaatcccagcactttgggaggccaaggcgggcagatcatctgaggtcaggagatcgagaccagcctggccaacatggtgaaacccgtctctagtaaaaatacaaaaattagctagggcatggtggcaggcacctataatcccagctactcgggaggctgaggsgggagaatcacttgaacccaggaggcggagattgcagtgagctgagatcgtgccaccacactccagcctggacaacagagcgagactct

SEQ ID NO: 13281 - DNA, 202 bp, Homo sapiens
ctatgctggataatggattctcaggaatggagtggcacctgaccttgaagtcatatagaagctcgtatgaggccaggcacagtggctcactcctgtaatcccagcactttgggaggccgaggcaggtggatcatctgaggtcaggagttcgagaccaggctggccaacatggggaaaccctgtctctactaaaaatgcaaaa

SEQ ID NO: 13282 - DNA, 72 bp, Homo sapiens
acctaacttgcgcagaaaacaagatgagattggcatggctttatttgttttttttgttttgttttggttttt

SEQ ID NO: 13283 - DNA, 341 bp, Homo sapiens
tgattatttttttaagttgaatggtgtttagtgtgcccatgttcataacagcatattattcacaacagccatacaggctgggtgtggtggctcatgtctataatcccagcactttgggaagccaatgtgggcagattgagtccaggagtgtaagggcaatatggtgaaacctgtctatacaaaaaattggccgggcttggtggtgggcacctgtagtcccaattactgggaaggctgagatgggagaatcgcctgagcccaggaggtcaaagctgcagtgtgccttcattgtgccactgcactttagcctggacgacagagtgagaccctgtgtcaaaaaa

SEQ ID NO: 13284 - DNA, 442 bp, Homo sapiens
gttgtagagatgggttttggaaatgatagttgggtcttgaaactactattggagtgcaaatgcctcctccctcatttggcggagaaacgtcaaaaatcctcagaacggaagaatccattctctttattttgggacacagcctggtaaaacttgtaagaaattatgacagctctgtgggaagcaagtgcaagtgtgggagaagcaagttgatgtgtgaagcagacatcagtgtgtgaaccagagtttatttgaacagtagtagttgctggtggcagaatgttaaaaatgtgagtattaagagtattaatgatgtgactattaagacttggattagtgttgaagaaatgtgaacttgaatagatttgctatgaaagtcttcggattttttttcctgtaatggattttatttcaatttcagttcactttatatgagtctccctgg

SEQ ID NO: 13285 - DNA, 441 bp, Homo sapiens
atttccgtagaaggcgccggccttggaggcgcacgtcccttgcggcggcgggagagaaatcgcttggacttcggggcggcctcggactgccatggcctttaccctgtactcactgctgcaggcarccctgctctgcgtcaacgccatcgcagtgctgcacgaggagcgattcctcaagaacattggctggggaacagaccagggaattggtggatttggagaagagccgggaattaaatcacagctaatgaaccttattcgatctgtaagaaccgtgatgagagtgccattgataatagtaaactcaattgcaattgtgttacttttattatttggatgaatatcagtggagaaaatggagactcagaagaggacatgccagtagaagttattactttggtcattattggaatatttatatcttagctggctgaccttgca

SEQ ID NO: 13286 - DNA, 303 bp, Homo sapiens
atctttccctcttcggtgttcttcttctcttctctgcaatgcttctgtagcttctaatgttccccgtggctaggcctttcctgccgagtgctctgatgcaatagtggaaatcgcttatatgtccttgggttgctggttggattaatctttaataacaatatatagaattgtagactgatgttttagcatttttccaacacacacaacgtaaaaataaaagcagtcgaccgcacttatggtaatcagttttgtataacttaaaataattaaataaatgaataaatccaaaaaaaaaaaaaaaaa

SEQ ID NO: 13287 - DNA, 305 bp, Homo sapiens
acactcaattttccagcccccagtcctgtagacatcctgggtgtgcggcacacatcggctcactcacactgaccctctgagccggtgagaactccacaagaagagggcsagsgcctcacaagatcaaggcggaacaacgcgtttgtgggatgatgaagacctcataacagacgtgccagtgggttgattactgtgaaattctcaactgtggtttctgtaacttaaaaaaaaaaatttcsactttgggaggctaggcgggcagatcacgaggtcagaagatcgagaccatcctggstaacacagtg

SEQ ID NO: 13288 - DNA, 455 bp, Homo sapiens
accgtgggtcggaccctgtggctggatgaaagcgcgctcgttcgtgccacaccctaggagtctgaagcctcagttatatcagtgaacgtgtccctgaaacaagatcgaagaggggatcgtctgccttattgaaaccatctaattggagatccgcagattaggctaccaagacacagctgcctccagcagaatttgtgtagtggacacttgtacgtgcactttggagacagcaagcatgaggcctgcagctgacagctttgagtggctgtgaacctgactatggaaaagatgtgactcccaacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaa

SEQ ID NO: 13289 - DNA, 455 bp, Homo sapiens
  misc_feature 373: n=a, g, c or t
taatttacttttaagtaagtacttaaaaattaataaaactggagactgcagggaattaaacagatctgagttttcttatatctttttttatataaagaaatggattttcagtagagtcacaccatagcagtttcactgctttttgattaatgaaactattaagtgagtccccacaggccacaaagcctgaactttaaaggtagaaaaaatcataaatgttagtggtttttagtcatggactggcctggggttaatggttttctgcaaggttgctctcagtgccaacttataattgaagttttgttcagagccatttttctttcaaaaagcagttgataaatgcggtttttattttccttaggtaacaaaagangaaagaacttttcaagaaattatgaaaagttataggaatcagccccaagctaatagtcacgtgagttacattatttttccta

SEQ ID NO: 13290 - DNA, 487 bp, Homo sapiens
aaatctgtgagcacaaggctggagaaaagttacagattaacagcatctcaaggcaaaaccgttgttcagggtacagatcaaaatggagtttcttaagtcttccttttctaaatagacacacttgtgataccctaacttgtattaacctgattgactctctcttagctgagaaacctgaacggactccatttggctccttcatttgcaagacatcaagggctccttacccacccccttcctcaaggaattaacttgtgcaagctgactcccagcacatcaaagaatgcaattaactgataacatgctgtggcaagctatgtccgcagttcccaggaatttgtccagttgatattaccctaagcccctgtgtttttgtctggttgatagcacccaaagcccagcgtctatcaccttgtgatggatttaaagcccctgcacctggaactgtttgctttcctgtaaccatttgtctttttaacttcttttg

SEQ ID NO: 13291 - DNA, 269 bp, Homo sapiens
  misc_feature 88,206: n=a, g, c or t
acagagcaaaaatctgtctaaaaaaaaaaaagaagagastggcacatccatacaatggatgagccaactkttaaaaaaaaaagawtgnggggctgggcgtggtggctcacacctgtaatcccaggactttgggaggcckaggcgggcggatcatgaggtcaggagatcgaraaccttcctggctaacacggtgaaacctgtstctnctaaraatacacacgcacacaaaawtyagctgggtgtggtggcaagmacctgtattcccagct

SEQ ID NO: 13292 - DNA, 313 bp, Homo sapiens
acatgaaaaacagcagttagggccaggcatggtggctcacgcctgtaatctcagcactttgggaggctgaggcaggcagatcatttgaggtcaggagtttgagtccaccctggccaacatggtgagacctcgtctctactaaaaatacaaaaattagctgggcatagtggtgcgtgcctgtagtcccagctacttgggaggctgaggcaggagaattgcttgaacccaggaggcagaggctgcagtgagctgagatcatgccactgcactgcagcctgggtgacagagtgagactctgtctcaaaaaaaaaaa

SEQ ID NO: 13293 - DNA, 200 bp, Homo sapiens; identical to SEQ ID NO: 11569

SEQ ID NO: 13294 - DNA, 433 bp, Homo sapiens
gccggtagccatcttcgtgcatagcttgcaacaccatgaaaaaattactgagacactaggaatgctgtgaactgagaaagtttgggacctttggcataactaaatccttcatttaacagatggagtctcagtctgtcactaaggctggagtgcagtggcgcgatctcggctcactgcaacctccacctcccgggttcacgcgattctccagcctcagccgtccacgtagctgggactacaggtgcatgccaccacacccagtgttgtgaaccacttgtcatgggataaccaaaattaaacctggaatcgcagaagaaacaaattttttgaagaaattggatgtacttttttaaaatttttcattcaactaaaactttgttaactgtttcttggttgtggtcttctctaaattgtaatctttggcattcacttc

SEQ ID NO: 13295 - DNA, 171 bp, Homo sapiens; identical to SEQ ID NO: 11926

SEQ ID NO: 13296 - DNA, 269 bp, Homo sapiens
agttcccagtcgcggccaaatcacgcctcagccacctcccgcaagcctctsactgcctcagcsrcgctttcsaggctggtttctggtccccatccgsggmwggtscggccctgggaccgaatcacttcccagcgagaggaaggtcaaatttmtcgaccggctacggaaggtcgsggccgsagcmctgtcagccgcstcgggsccccaggacccctcgggtctstttaaccggaagcggaagtgcgtgtcggsgggatcatggcgacttt

SEQ ID NO: 13297 - DNA, 192 bp, Homo sapiens
aatacagaaagttggccgggcgtggtggtaggcacctgtggtcccagctactcgggaggctgaggcgggagaatcgcttkggctcgggaggtggaggttgcagtgacctkagatcataccactgcattccagcttgggtgacacagcaaggctccgtctcaaaaaaaaaaaatgttgatagcmcttattatt

SEQ ID NO: 13298 - DNA, 474 bp, Homo sapiens
ttcataaaacttcttgaaagttgcctcatccccgtaagctaaaactgttaaacaaaatgaaaatatttagagcatataacagcctcttttgctggaaggttttatagaaataaagttgccagcatatttttagaagagtaactgctccctgacaccagaatggcttattttgaaaaataagccaaaacaaatatacccttagataggtgtctataatattccagcaaagggattgggataggaaattcctacccatccctgtttttgctttggatgaaaacagtcttaagaggtttcaattgatggaaaagattagtatacatcatttcattggccagacgtggtggcgtctgactgaaatcccagaactttgagagccccaggcaggcggatcatgaggtcaagagatcaagaccagcctggccaacatggtgaaaactcgtctctactaaaagtacagaaattagctgaatg

SEQ ID NO: 13299 - DNA, 87 bp, Homo sapiens
tsaagaaaaaaaatttttttttttttggaagaatttgaaagskgctgatccagagtcattacctttaagaaaatgggmcgggcatgg

SEQ ID NO: 13300 - DNA, 75 bp, Homo sapiens
tatacatatataatattatatatatttbgtctgtttgtagttttattactagatgatttttccsgttgtccttaa

SEQ ID NO: 13301 - DNA, 449 bp, Homo sapiens
gcactgacatgsccgtcgcccgggtccgcgcgtccgccgcgcccggccgttaataggcttgctccctgagcgccccgcaccgacatggcggccgtcttcgctgtggtgactttaactctcggttttcggttatagccggccggcgctcacttgtcttcaggaagctcggagcctttggtggagccggggagaggaagggtgggtgcaagagtgaaaggcgagaggggmctgcaagcatccgggtcggctcctggccggagcaagatggctgagggcgagcggcagccgcgccagattcttcagaggaggcccctccagccactcagaacttcatcattccaaaaaaggagatccacacagttccagacatgggcaaatggaagcgttctcaggcatacgctgactacatcggattcatccttaccctcaacgaaggtgtgaasgggaag

SEQ ID NO: 13302 - DNA, 300 bp, Homo sapiens
caaacagatataacactagggccgagtgaggtggctcatgcctgtaatcccaacactttgggaggctgaggacggtgtattgcttgagcccaggagttcgtgccaggtttggcaacatggccatctctataaaaaatacaaacattgaccaggtgtggtggcatgggcctgtggtcccagatacttgggaagctgaggtaggaagatcgcttgggcccaggagatgtaggttgcagtgagttgttatcacaccactgcactcctgcctgggtgacagagcaagagcctgtcgccaaaaaa

SEQ ID NO: 13303 - DNA, 338 bp, Homo sapiens
  misc_feature 132: n=a, g, c or t
taattaaatttcttttaaaagtcttcgattttgggtagaggccccccagtttttttctctttttttttttgagatggagtctcactctgtcgcccaggctggagtgcagtggcacgawtctcagctcactgnaatctccgcctcccaggttcacgcsattctcctgsctsagcctcctgagtagctgggactacaggcacccaccacsatgcctggctaattttttggwattttaagtagaagcggagtttsacsatgttagcsaggcatggtctcgatctcctgaccttgtgatccgcctgcttcggcstcccaaaggsctgggattacaggcgtga

SEQ ID NO: 13304 - DNA, 423 bp, Homo sapiens
  misc_feature 193,206,316: n=a, g, c or t
tttgcctgtgacgtcacaggatcgcgcccgcttttctctcgggtgatccggccgagtggcctgggttagcagctgctgcatttccccggctggctgcggtcactggtggcagtgctcaggcgcccgccgcccttgaccttcggccccgcgagctstaaccctacagcgcaggaagatcggscgccgcggccangctctgatgctgnbtgtctggtagaagaaggttactcacagttctgctgcaggctcagaagtggccctttcaaccctccagagacatgagactagtgcagttccgggcacccacctggtgggnmctcacttgggcctggagacagggaatgctggaggggttatcaacctcaatgcctttgaccccacactcccgaagacgatgacgcattcctagagcagggagaggcc

SEQ ID NO: 13305 - DNA, 250 bp, Homo sapiens
aaagacacaatccatgaaagaaataagaagtaacctggacctcacctattagaatggccaaaacccagagcactaacaccagcatatgctgaggaggatgtggagcaacaggagctcccattcactgcaggtgggaatgcaaaatggcacaggcacttcagaagacagcctggcggtttcttacaaagctaaacatactcttaccatatggtcaagcaattgcaaccttgttgatttaccaaaaggagtt

SEQ ID NO: 13306 - DNA, 200 bp, Homo sapiens; identical to SEQ ID NO: 11569

SEQ ID NO: 13307 - DNA, 461 bp, Homo sapiens
aataaatatttgtgcacaagtatttgtgtagacatgtttgcatttctcttgggtatatacctagaagtgaaattgctggataatatgtttaactatttgaggactgatagactactttgtaaagtggccaacatgagtaagttttcatcacatttataaaatgttagtgtacttacattagcttgcaaagcatttaataagcagcaagagttaaaccacgttggtccaagtgaactgaaagcagacttctgtgttacatgtgtatgagttactgaacatgttccataatacaggagtgtgagcacactaacaggtaagtgcaggaaaacaagaagaaatattttcagagtatagtcaaaagtacactgagcatgggagaattgttttgacattttgctcaaaactatttctgaagaaaaattcaacatttctttcacggaaagttttaggaacaggtaaat

SEQ ID NO: 13308 - DNA, 304 bp, Homo sapiens
aaaaagtccctgggaagcggccgggcgcggtggctcacccctgtaatcccagcagtttgggaggccgaggcgggtgcatcatctaaggtcaagagttcgagacaagtctggccaagatggtgaaaccccgtctctacgaaaaatacaaaaattagccgggcgtggtggctcatgcctgtaatctcagctactcgggaggctgagacaggagaattgcttgaacccgggaggcggaggttgcagtgacccgagatctcgccaccgcactccagcctgggcgacagagcgggactccaccccaaaa

SEQ ID NO: 13309 - DNA, 140 bp, Homo sapiens
tgaatataattagtctcatttgaaatttagtagctgaacatatactgtattaattaacaatactggtcaggcacgttggctcatgcctgtcatcccagcactttgggaggccggggcaggaggatcagtcaagaccggga

SEQ ID NO: 13310 - DNA, 236 bp, Homo sapiens
tcaaagataaagaaaagatcctaaaagcagcaagagaaaagaaacaacatacaatggagctctaatatgtctggcagcagacttttcagtggaaaccctacaggccacgagagcggcacagcatagtcaaagtgctgaagggggctgggcgcggtgactcacacctgtaatcccagcactttgggaggccgaggtggacggatcacaaggtcaagagatggagaccatcctagcca

SEQ ID NO: 13311 - DNA, 325 bp, Homo sapiens
  misc_feature 199: n=a, g, c or t
catataacctttaaaaaataccatacatatttatgaatgcaatgattaaaaccagctataggagtackgctggcgtggtggctcatgcctgcaatctcagcactttgggaggcagaggcgggcggatcactcgaggtcaggagttcaggaccagcctggccaacatggtgaawsctgtctctactggggatacaaaaantagctgggcatggtggccgcacgcctgtaatcccagctacttgggaggctgaggcaggagaatcgcttgaaccccggaggcggaggttgcggtgagcggagattgcgccactgcactccggcctgt

SEQ ID NO: 13312 - DNA, 415 bp, Homo sapiens
caaagggaaaaatgcaaaamttggctgggtgtggtggctcacacctgtggtcccagctacttgggaggctgaggtgggaggatcgcctgggcctggggaggttgaggctgcagtgtgccatgatcgcgccactgcactccagcctgggcaacagagtgagacccccctatctcaagaaaaaaaaacccaaattttgtttcataattatgtaaattaggcctgggcatggtggcttatgcctgtagtcccaacactttgggaggccgaggcgggcggatcacttgaggtcaggagttcgagaccagcctgagcaatgtggtggaaccccatctctaccaaaaatagaaaaaattagccatgcacgcctgtggtcccagctacttgggaggctgaggcaggaggatcgcttgatcct

SEQ ID NO: 13313 - DNA, 370 bp, Homo sapiens
caaactctcttatgccctggcaagccaatgaggataccctttgacaaaccctgtggataaaatgataatatcaaggtcaggcatggtggctcacacctgtaatcccagcactttgggaggctgaggcgggtggatctgctgaagtcagaagtttgagaccagccttgccaacacaatgaaaccctgtctctactaaaaataaaaaaattagcsggscgcasagtgcacgcctgtaatccctgctactcgggaggstgaaacaggagaatcacttgaacccaggagacggaggttgcggtgagttgagattatgccamtgtactccagcstgggtgacagagcgagactcagtctcaaaaaaaaaaaaaaa

SEQ ID NO: 13314 - DNA, 83 bp, Homo sapiens
gttttttatgcgggattaagcttgctgctgcgtgacagcggagggctaggaaaaggcgcagtggggcccggagctgtcacccc

SEQ ID NO: 13315 - DNA, 386 bp, Homo sapiens
  misc_feature 366: n=a, g, c or t
attaatcatcaagaagacgtaacaggccaggcgtggtggttcacacctgtattcccagcattttgggaggctgaggcaggagaatcgcttgaactcaggaggcagaggttgcagtgagccaaagttgcaccattgcactccatcctgggcaatgagagtgaaactccgtctcaaaaaaaagagaagacataacaatcaaatatgtgtcaacataataaaagaaattcagggccgggcgcggtcgttcacgcctgtaatcccagcactttgggaggccgaggcggacagatcacgaggtcaggagttcaagaccagcctgactaacatggtaaaaccccatctctactaaaaatacaaaaattagcnggvcgtggtggcacacgctt

SEQ ID NO: 13316 - DNA, 208 bp, Homo sapiens
ctttctacatatggccagccagttttcccagcaccatttattaaacagggaatcctctccccattgcttgtttttctcaggtttgtcaaagatcagatagttgtagatatgcggcgttatttctgagggctctgttctcttccattgacctatacctctgttttggtaccagtaccatgctgttttggttactgtagctttgtagtat

SEQ ID NO: 13317 - DNA, 142 bp, Homo sapiens
caggaaaacaaacaaacaaacaaaaaaacagaaaacgaggccgggcaaggtgtctcacacctgtaatcccagcactttcgaagactgagacaggcggatcacctgaggtctggagttcaagaccagcctggccaacatggtg

SEQ ID NO: 13318 - DNA, 314 bp, Homo sapiens
  misc_feature 241: n=a, g, c or t
tgtcaattttgtttatcttttcaagaaactaacttcttggccaggcacagtggctcacgcctgtagtcccagcactttgggaggctgaggtgggtggatcacttgagggcgggagtttgagaccagcctggccaacacagtggaaccctgtctctactaaaactacaaaaattagccaggtgtggtggcacatgcctatagtcctggctactcctagctactcaggagactgaggcacaanaattgcttgaacctgggaggcggaggttgcagtgagccgggatcgcaccactgcactccagcctgggcgacag

SEQ ID NO: 13319 - DNA, 355 bp, Homo sapiens
  misc_feature 213: n=a, g, c or t
caaactctcttatgccctggcaagccaatgaggataccctttgasaaaccctgtggataaaatgataatatcaaggtcaggcatggtggctcacacctgtaatcccagcactttgggaggctgaggcgggtggatctgctgaagtcagaagtttgagaccagccttgccaacacaatgaaaccctgtctctactaaaaataaaaaaattagcngggcgcagagtgcacgcctgtaatccctgctactcgggaggctgaaacaggagaatcacttgaacccaggagacggaggttgcggtgagttgagattatgccactgtactccagcctgggtgacagagcgagactcagtctc

SEQ ID NO: 13320 - DNA, 319 bp, Homo sapiens
ttgaaaaaataggacaagaacttatttttaaaaagaggccaggtgcggtggcccatgcctgtaataccagtactttgggaggccgaggtgggcggatcacctgagatggggagttcgagaccagcctggccaacatggtgaagccccgtctctactaagaatacaaaggttggccgggcttggtggcgggcacttgtaatcccaactactcaggagtctgaggcatgagtgtcgcttgaacctgggaggcagaggttgcagtgagctgaggtcacaccgttgcactctagcctgggagacaagagggaaactctgtctc

SEQ ID NO: 13321 - DNA, 382 bp, Homo sapiens
ttggagttttgctcttgttgcccaggctggagtgcagtggtgtgatcttggctctctgcagcctccgcctcctgggttcaggcgattctcctgcctcagcctcccaagtggctgggattacaggtatgcgccaccatgcctggctaattttgtgtttttagtggagatggggtttctccatgttggtcgggagtttgagaccaccctggccatgatggtgaaccccgtctctactgaaaatacaaaaattggctgggtgtggtggtgcacacctgtaatcccagctacgtgggaggctgaggcatgagaatggcttgaggtcagcagatggaggttgcagtgggccgagattgtgccactgcaatccagcctagatgacaga

SEQ ID NO: 13322 - DNA, 375 bp, Homo sapiens
caattttggatctttcctgctttctcttgtgggcatttagtgctgtaaatttccctctacacactgctttgaatgcgtcccagagattctggtatgttgtgtctttgttctctttggttttaaagaacatctttatttctgcgttcatttcattatgtaactagtagtcattcaggagcaggktgttcagtttccatgtagttgagtggttttgagtgagattcttaatcctgagttctagtttgattgcactgtggtctgagagacagtttgktataatttctggtcttttacatttgctggaggagagctttacttccaagtatgtggtcaattttkgaataagtgtgatgkggtgstgaaaaaaatgtatat

SEQ ID NO: 13323 - DNA, 85 bp, Homo sapiens
cctttcttccttttggtgcgagcttgctgtggtttttgctctgggtcctctgggaatggcgcctggmtgtggccgcgtggtctct

SEQ ID NO: 13324 - DNA, 467 bp, Homo sapiens
  misc_feature 430: n=a, g, c or t
gcgggcagatcatgaggtaaggagatcgagaccatcctggctaagacggtgaaaccctgtctctactaaaaacacaaaaaattagctgggtgtggtggcagtcgcctgtggtcccagctactcgggaggctgaggcaggagaatggcgggaacctgggaggtggagcttgcagtgagccaaaatcacgccactgcactccagcctgggtgacagagtgagactctgtcccagaaaaaaaaaattgtggaacactttctgctgctcagtatgatgtgaaatctcaacaagcaaaaagattggctaggctgggagcagtggctcaggcctgtaatcccagcactttgggaggccaaggtgggtagattgcttcagctcaggagctctagaacagcctgggcaacatggcaaaacccagtctctaaaaaaatncaaaaattagttgggcgtggtggcacatgcctatggt

SEQ ID NO: 13325 - DNA, 380 bp, Homo sapiens; identical to SEQ ID NO: 12238

SEQ ID NO: 13326 - DNA, 432 bp, Homo sapiens
caatcatcatttgtatgtgactttatggttttagatcatgttcctttaatctagggtttctcaaccttggcactgactgttgacatcaattcttggttgtgagggccatcctgtgccttgcaggatacttaaataatctctgscctctacctactagataccagtaacaccttcagacagtgacaatcaaaaatgtctccagatattgccaaacgttccctagcaggcaaaatcacccccagttgagagccagtgctttagtccttasttatcacatttccctaaaagaaatatcattggtattctcaaggtcttgcaatatgaagaacttgaactctaatctcccgtctcctagtttcccaggmtctttctgctagctgtgctttcatccagttgtttggcagatgtttattgagcatctccctggggtca

SEQ ID NO: 13327 - DNA, 298 bp, Homo sapiens
taaaaggaagttcttggccgggcgcggtggctcatgcctgtaatcccagcactttgggaggccgaggtgggtggatcacgagatcaggagatcgagaccatcttggctaacacggtgaaaccccatctctactaaaaatacaacaaattggctgggcgcggtggcgggtgcctgtagtcccagctgctcgggaggctgaggcaggagaatggcctgaacccaggaggcggasttgcagtgagctgagatagtgccactgcactccggcctggtgaaagagcgagactccgtctcaaaa

SEQ ID NO: 13328 - DNA, 213 bp, Homo sapiens
gacaaccctggcgggggttcgctggctgcggcmccggctccggaccccgcagagcagcaccccccggggaaagacattttctgctcccaccgagttggcaggggcctgcttcctgaatctcctgggtgtgtcttaactgccagtcccagcacctcctggaaagccccactctcctccagtggtcacagtggaaggatcatgggagaaacagaa

SEQ ID NO: 13329 - DNA, 129 bp, Homo sapiens
gttaaatattgtctaatcaggccgggcgcggtggctcacgtctgtggtcccggcactttgggagcctgaggcaggcggatcatgaggtcaggagatcaagaccatcgtggcttacacggtgaaacccac

SEQ ID NO: 13330 - DNA, 160 bp, Homo sapiens
attcatttctacagtgtttgtatgttgataaggtcttcccttggctaaatcgtctctgctctctgaagcagtgcctgactccaatgctgggagcaccacaacccacaaatctccaggatgaccagacaaggtcaccttctgttcaaggtcaggggccagg

SEQ ID NO: 13331 - DNA, 485 bp, Homo sapiens
gactgacaactcacacggctgggtactcttctgagacaaaacttccagaggagcgatcaggcagcaacatttgctgttcaccaatatccattgttctgcagcctctgctgctgatacccaggcaaacagggtctggagtggacctccaaactccaacccacctgcagctgagggtcctgactgttagaaggaaaactaacaaacagaaaggacatccacaccaaaaccccatctgtacatcaccatcatcaaagaccaaaggtagataaaaccacaaacatggggaaaaaacagagcagaaaaactgaaaattctaaaaatcagagcgcctctcttcctccgaagaatgcacctcctcaccagcaatggaacaaagctggagggagaatgactttgacgagttgagagaagaagccttcagaagatcaaactactccgagctaaaggaggaagttcaaacccatggcaaagaagttaaaaacctt

SEQ ID NO: 13332 - DNA, 111 bp, Homo sapiens
gtgtgttaagaaatgagctgtaggctcagtgcagtggctcatgcctgtaatcccagcactttgggaggctgaggtgggcggatcatgaggtaaggagttcgagagcagcct

SEQ ID NO: 13333 - DNA, 187 bp, Homo sapiens; identical to SEQ ID NO: 11697

SEQ ID NO: 13334 - DNA, 176 bp, Homo sapiens
attaggctgggcgcggtggctcacaactgtgatcccagcactctgagaggccgaggcgggcggatcacctgaggtcgggagttcgagaccagactgaccaacatggagaaaccgcgtcgctgcaaaaatacaaaaaaaattagccgggcgtggtggcacatgcctgtaatcccagc

SEQ ID NO: 13335 - DNA, 481 bp, Homo sapiens
ctgtagctctttctttcatctgaaacttgtgctgtttttactaggaagaaagaaaagattatggttgttgtttttggaaaatgataatctatatcaacttttctttcatttttcaactgagtaatcttagcacagaatataccctgaaggcccaaagtcctaaagtgtcaagaccatctgtttatagtaaatctataaatacatttacttataggactaagatcatctagactagcagatgatttgctatcagaaccactgaagaataaaacctacaggcaataagcaagagagctgaagatgacctggccaactatgagtcaactctgagactacctctgacatgaaaagctcaaaacatctaggttcttcatctttatatattgaaatccacatattgcactatacttggaattaacaagagccaggagttttaacacaattctcacagtaatcatagagcagatgggcattctgtacc

SEQ ID NO: 13336 - DNA, 500 bp, Homo sapiens
agtgggattagtgaactggctagttagttaatctatgaaccagaaccaggtcttcatgacactaaatatgcttgtgccttgatcctggacttccagcctctagaactatgagaaagaagtttctgctgtttataagataccctaatttatggtgttttgttattcagatcgaacagactaggaaatagtatggaaaacaaaagctgccagacttcagttttcatttaattggtcagacctatacaacatatctagcttctccctaactgcagggaaggctctgaaaatcagtgtttaactttttcattgtggctgcttcaggagtcccatttcgtggtatgctgtttggaggagattttcacaagtgatgataacctgtttttcttccaactctgactttggaaaacatcgtaaaagataaagaagttgtaatacaacatggatgaaccctgaaaacattatgccaaatgaaagaagcattcacaaaagatcatatattg

SEQ ID NO: 13337 - DNA, 422 bp, Homo sapiens
aatacagaaagttggccgggcgtggtggtaggcacctgtggtcccagctactcgggaggctgaggcgggagaatcgcttgggctcgggaggtggaggttgcagtgacctgagatcataccactgcattccagcttgggtgacacagcaaggctccgtctcaaaaaaaaaaaatkttgatagcactattatttcttgtagccaaaaagtggaaacaactcaaatacacaacagstgaagaagggataawtaaaaaaataaaatgtggtatatccaaacgatggactgttctgcaataaagaggagtgagatactgataatgctacaatatggatgagccttgaaaacattatgctgagagaaagakgcaggccacaaaggccacatatttaatggtttcaactgamatgtccaaaacaggcaa

SEQ ID NO: 13338 - DNA, 446 bp, Homo sapiens
tcaaagataaagaaaagatcctaaaagcagcaagagaaaagaaacaacatacaatggagctctaatatgtctggcagcagacttttcagtggaaaccctacaggccacgagagcggcacagcatagtcaaagtgctgaagggggctgggcgsggtgactcacacctagtaatcccagcactttgggaggccgaggtggacggatcacaaggtcaagagatggagaccatcctagccaacatggtgaaactccgtctctactaaaaatacaaaaattagctgggtgtggtggtgtgtgcctgtagtcccagctactcgggaggctgaggcaggagaattgcttaaacctgggaggcagaggctgcagtgagctgagattgtgccatcgcactcctgcccgatgacagagcgactccatcgagaaagagaagaaagaaaagrcaaaag

SEQ ID NO: 13339 - DNA, 130 bp, Homo sapiens
tattttsagtagggacggggttacaccatgttggccaggctggtctcgaactcctgacctcaagtgatccacccgcctcagtctcccaaagtgctgagattacaggcatgagtcactacgcccggcccat

SEQ ID NO: 13340 - DNA, 348 bp, Homo sapiens
caaactctcttatgccctggcaagccaatgaggataccctttgacaaaccctgtggataaaatgataatatcaaggtcaggcatggtggctcacacctgtaatcccagcactttgggaggctgaggcgggtggatctgctgaagtcagaagtttgagaccagccttgccaacacaatgaaaccctgtctctactaaaaataaaaaaattagccgggcgcasagtgcacgcctgtaatccctgctactcgggaggctgaaacaggagaatcacttgaacccaggagacggaggttgcggtgagttgagattatgccactgtactccagcctgggtgacagagcgagact

SEQ ID NO: 13341 - DNA, 200 bp, Homo sapiens; identical to SEQ ID NO: 11569

SEQ ID NO: 13342 - DNA, 290 bp, Homo sapiens
ctttaattgccctacatttggcaataaaagcatgactacagcctcccagagacagtgaagttcctgtgtctattgcagaaagaaaattaacctggttcccaatgatgttactcaagggggctcagaatcaaaaccattatttgtgctttaaccactaatattcacttttttgacactcagtttagagtggcctttggaaataagtcacatatattctyttatgaacccaatcatgcatttaacttgttttccaaatgtttattgaacactgactatatatatatagatat

SEQ ID NO: 13343 - DNA, 328 bp, Homo sapiens
cctcccgagtagctgggattacaggtgcctgccaccacacccagctaatgttttgtatttttagtagagatggggtttcaccatgttggccaggcagatctcaaactcctgacctcgtgatgcacccacctcggcctcccaaagtgctgggattacatgcgtgascactgcgccctgcctgtttgtagtaatttttaggcaccaaatctccctcatcttctagtgccattctcctctctgttcaggtaaatgtcacactgtgcccagaatggatgaccaggaaccttaaagagtggctgaaaagattgcagagttatcataataaatt

SEQ ID NO: 13344 - DNA, 87 bp, Homo sapiens
cctaactaaaggagcaatttctttggaattacttctctgtaatagaaattcttggctggtggagtggctcatgcatgtaattccagc

SEQ ID NO: 13345 - DNA, 376 bp, Homo sapiens
gttcccttcctattctcagtgaacagcggggcccgagtggttatctgcgacaaggatgagtctgggggccgggccctggagcaggagctccctggagctgtctttatcctctgtgatgtgactcaggaagatgatgtgaagaccctggtttctgagaccatccgccgatttggccgcctggattgtgttgtcaacaacgctggccaccacccacccccacagaggcctgaggagacctctgcccagggattccgccagctgctggagctgaacctactggggacgtacaccttgaccaagctcgccctcccctacctgcggaagagtcaagggaatgtcatcaacatctccagcctggtgggggcaatcggccagg

SEQ ID NO: 13346 - DNA, 476 bp, Homo sapiens
  misc_feature 40: n=a, g, c or t
catctttaaacttctcagagggtcagagtacatcgttttngattagggaaaattataaattgaaattatgtggaatattaatttattcattaaggattttgttaaaagtttgatagccattatgctcggctctggggtgtaagtgtaataaagatggtgccttattacatagcaggtactcaatatataatatcctgcttttaagagacccactatcttaaaaggagatatatcacatgtaaatagttaaagtgtgtaatagtgatttgtttgactgactttggaagcacaatggagaataatcatttaactgccaataaaatcttttaagttttagtacgatatttgaaaaatgatttggcatttaataaaaaattactttttagggatggtgttgtgggtgaatgcagtatatacacagtaaggaactgtggaatagcctggcttgttctgaggaatgaaagtgatttggtgtt

SEQ ID NO: 13347 - DNA, 429 bp, Homo sapiens
acacctcctcctggcttcggatggggaggagctccaaggagatccgttgctagggaggaagttaggttgctaagggttctatggggttcttactccagccaggaccaggtttcagggccacaggcgtaasttataaaactggagtttggctgagcgtggtggctcatgcctgtaatcccaatactttgggaggctgaggcgggtggatcatttgaggtcaggagtttgagaccagcctgatcaccagggtgaaacccgtctctactaaaataaaaaaattagctgggcttggtggcgcgcgcctgtaatcccaactactcgggaggatgaggcacaagaatcacttgaactcgggaggcggagtttgcagtgagccgagatcacgcctcggcactccagcctggacaacagagtaagactgtctcaaaa

SEQ ID NO: 13348 - DNA, 179 bp, Homo sapiens
  misc_feature 9: n=a, g, c or t
aaaaastgntgaggtttgaggccccgttttgctgctcactagctacatgatcttgggcaagttatttaagstctctgagcttcagtttcttcctctgsagaatggggatgaaagtggastactacctcatggcatgttttgaggatgaaatgagctaataaacacagtcttcagcccta

SEQ ID NO: 13349 - DNA, 339 bp, Homo sapiens
gtgagccgagatcttgccactgcactccagccagggtgatggagtgagactctcagaaaaaaattagtgccaggcacaggggctcacacctataatccccgcactttggcaggccaggtgggcaaattgcttgagcccaggagttcgagaccagcctgggcaacatggcgaaaccctgtctaacaaaaaaaatacaaaagttagccaggagtggtggcacaagcctgtagtccctgctgctagggagactgtagtgggaggatcacttcagcctgggagaccaaggctgcagtgagtcatdagtgtgccattgcaccccagtgtgggccacagagcgag

SEQ ID NO: 13350 - DNA, 300 bp, Homo sapiens
tgtctaggctgagcgtggtggctcacgcctgtactcctaccactttgggaggccaaggcaggcggatcatttgaggtcagaagttcgataccagcctgaccaacatgatgaaaccccgtctctactaaaatacaaaaattaatcgggcatggtggcgggcacctgtgatctcagctactcgggaggctgaggcaggagaatcacttgaacccaggaggcagaggttgcagtgagccaagatcacaccactgcactccagcctgggcgacaaagcaagactccatctcaaaaraaaaaaaa

SEQ ID NO: 13351 - DNA, 439 bp, Homo sapiens
  misc_feature 386: n=a, g, c or t
ttaaaataatacttagaggctgggtgaggtgctcacgcctgtaaccccagcactttgggaggccagggcgggtggatcacctgaggtcaggagttcaagaccagcctgaccagcatggtgaaacccgtctttactaaaagtaccgagattaggccaggcgtggtgggtcacgcctgtaatctcagcactttcggaggccgaggtgggcggatcatctgaggtcaggagttcgagaccatcctgaccggcatggcsggaaccctgcctctactaaaaatacaaaaaaaattagtcmgttgtggtggcagatgcctgtagtcccggctactcgggaagctaaggcaggagaatcgcttgaaccgaggaggcggaggttgcagtgagcngaaatcacgssactasactccagcctgggcgacaagagsaaaactccgtctca

SEQ ID NO: 13352 - DNA, 267 bp, Homo sapiens
attaggctgggcgcggtggctcacaactgtgatcccagcactctgagaggccgaggcgggcggatcacctgaggtcgggagttcgagaccagactgaccaacatggagaaaccgcgtcgctgcaaaaatacaaaaaaaattagccgggcgtggtggcacatgcctgtaatcccagctactcgggaggctgaggttaggaggatcgcttgaatctgggaggtggaggttgcggtgagccgagatcatgccattgcactccagcctggg

SEQ ID NO: 13353 - DNA, 339 bp, Homo sapiens
tttaaaaaataaataagtaaataaaattgagcctcattttttaacctaattgaaaatgggtgataaaaatgtatacattgcgaccaggtgcggtggctcacacttgtaatcccagcactttgggaggccaaggcaggtggatcacctgaggtcaggagttcaagaccagcctggccaacatggtgaaacttcgtctctattaaaaatacaaaaatcagccaagtgtggtggcacatgcctgtagtcccagctacccgggaggctgaggcaggagaatcgcttgaacttgggatgctgcagttgcagtgagctgagatcgcaccattgcactcctgcctg

SEQ ID NO: 13354 - DNA, 156 bp, Homo sapiens
agaccgagcgcttgaggtgccgcarccgccgccgccgccrccgccgcgatgtgaccttcagggccgccaggacgggatgaccggagcctccgcccmgcggcgcccgcggctcgcctmggcctcccgggcgctctgaccgcgcgtmcccggcccgcm

SEQ ID NO: 13355 - DNA, 377 bp, Homo sapiens
agtgcggtgttttagccggtggctgctgtctctgggcgggccgtgggaggctcccgaggtgggggccggggcgggatggctgcagcggcggccggggccgggagcgggccctgggcggcccaggagargcagttcccgccggcgctgctgagtttcttcatctacaacccgcgcttcrggccgcgcggaaggacaggaggaaaataagattttattttatcatccaaatgatgtagaaaagaatgagaagattagaaatgtcggattgtgrtgaagctattgtacagtttacaaggacatttagcccatcaaaacctggcaaaatctttacatacacagaagaacagacagtkcttcaatgaaccagaagaaaattt

SEQ ID NO: 13356 - DNA, 342 bp, Homo sapiens
gaaaatgagtacgaaatgtaaagtttcactagaaagtttaaagtaggtacaaggttgacagagcaagtagtttcaagggaaggatctcttctgggaagtggtggtggcctgcgtaggcaggcagttgatacagccttaagatgtaggtcagagagactgtggtatagaaaagtaggtttggaaggtgggagagtggctgagcacactggttcactgggaaaaagtagtcagtctgggatrgagcttggaggatggccatgtggcaggtcagacaggaggaggagcagtcttcaaaatagaaacggrdggaacattaggaagttcagtgatatccaaggaaag

SEQ ID NO: 13357 - DNA, 352 bp, Homo sapiens
cctagatatcgcgagagggcgggtccgcttggcttcggcgtcgcgtcgctcctgcgctggagctctaggccggcgtctmtccgcgagccgcgggtcaagtgccagtggctaagggtgcgcgagtagccgccacccgttcggcgttggctctggcgtcggggtcgttgtgtcgtgacaaccgctgcggtagccgtttccgaggcagcagttgcggccgctwtagccctgagcgggatctgcggctgcctgcgagtctctgctgtgccgacccttctcttcgcggaccccacgccaagcagcgaccctgagccgacagccggagcgcccggcaatggcggcctcgacggcctcg

SEQ ID NO: 13358 - DNA, 171 bp, Homo sapiens
aaattagccaggtgtggtggtgcatgcctgttatcccagctacttgggaggctgaggcaggagaatcgcttgaacctgggaggtagaggttgcggtgagctgagattgcatcattgcactccagcctgggcaacaagagtgaaactccgtatcaaaaaaaaaaaaaaaagg

SEQ ID NO: 13359 - DNA, 293 bp, Homo sapiens
acacctggccttctccatgctcggaataacttcctgcagcgaccaacaggctaaagagggggaagggatccagcaccggctcctcctccggcaaccacggtgggagcggcggaggaaatggacataaacccgggaattttaaatccaagctgggtttcatcaactgggatgccataaacaaggaccagagaagctctcgcatcccgtgacctccagacaaggagccaccagattggatgggagcccccacactccctccttaaaacaccaccctctcatcactaatctcagcc

SEQ ID NO: 13360 - DNA, 513 bp, Homo sapiens
gttttcctgagtctctgctctgagctggatggtcgagtccggcccctcgtgtacaccctccgctgctgggctcagggtcgggggctgtcagggagtggcccccttctcagtaactacgccctgaccttgctggtgatctattttcttcagaccagggaccctcctgtgttgcccactgtgtcccagctcacccagaaagcaggagagggggaacaggtggaagtcgatggctgggactgcagtttccccagggatgcctcaagactggagcccagcataaatgtggagcccctcagtgagtttggggagcctggtagaggactagtaatgatgttcatcaacagtaggtaacatatatcacactaactgtgtgccaggcatggttctcacagaaagcctgtgagatacctaatattattactgccattttacagatgaagaaaccatgtttgggagcaattaaggtgacttgcccaaggttacacttgctagcaaggagcagcagcatctggg

SEQ ID NO: 13361 - DNA, 411 bp, Homo sapiens
aaggtttgtagcttgcaagacgtgcactaataatattttatatgatctttcctggttggcaggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgattgccacagtgtcctatgaagacccacccactgccaaggctgccgtggaatggtttgatgggaaagattttcaagggagcaaacttaaagtctcccttgctcggaagaagcctccaatgaacagta

SEQ ID NO: 13362 - DNA, 291 bp, Homo sapiens
tgttcttttcacttttacatatctgatatgcaaaacgttatttcattttaatttactttgattatgatttaggttaacattttaataagcttattagcatcttatgtttcttttatgtctttgccsatttttstgttgaggtatttatctttttsatattgttacaaggttccttatatatctagggtattaatctttattttgataaatgctgtatagagtttttcagcttattgtttgsstttagtagttttgtgcsattcttttttggagacagagtctcgstctgtc

SEQ ID NO: 13363 - DNA, 342 bp, Homo sapiens
ccttcagccgcctcctttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaagaattgcatcttgtcttgttcttgcagcccggcatgccagtgcttcctccacgaatttgaaagacatattggctgacctgatacctaaggagcaggccagaattaagactttcaggcagcaacatggcaagacggtggtgggcaaatcactgtggacatgatgtatggtggc

SEQ ID NO: 13364 - DNA, 225 bp, Homo sapiens
agatttcgaggtcagcgccttcctctgctcctctaggtctgggcttcagggcacgaagagaagttagggtagaacggagccctaaggagaggtgccgtgggcgccgaaaccagctttgaccactcgatgagggccttcctgtttacggatccttcaatttatagatgaggaagctcgggctcagagaagttgagtaactcctcaggcctcacagcctgtaagtgc

SEQ ID NO: 13365 - DNA, 76 bp, Homo sapiens
ttatcattttcttagttttgtaataccttttttatttgtgaataaaattatcacctggaaaaaaaaaaaaaaaaaa

SEQ ID NO: 13366 - DNA, 328 bp, Homo sapiens
aaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgataggacttattaactatattgaacattttttcctttgcctttgaccctatgtatagttacgatgccagattagatttatagcagcctcaagttgtattaaatgatattttgcttcctgtaatactattataaaataaagtttgtttattctctcaaaaaaaaaaaaaaaaag

SEQ ID NO: 13367 - DNA, 342 bp, Homo sapiens
  misc_feature 229: n=a, g, c or t
acacctggccttctccatgctcggaataacttcctgcagcgaccaacaggctaaagagggggaagggatccagcaccggctcctcctccggcaaccacggtgggagcggcggaggaaatggacataaacccgggaattttaaatccaagctgggtttcatcaactgggatgccataaacaaggaccagagaagctctcgcatcccgtgacctccagacaaggagccacnagattggatgggagcccccacactccctccttaaaacaccaccctctcatcactaatctcagcccttgcccttgaaataaaccttagctgccccacaaaaaaaaaaaaaaaaa

SEQ ID NO: 13368 - DNA, 438 bp, Homo sapiens
tttagaaatgagatctagagaacacgtcttctaaaaggggcatattttatattagtgaagaggtattactgacacaatttcttctatatatgaacctatttttaatgaaacttcaaatagcaataagttccgttatatactgtggcctgaaataatttgagaaaaaaggttactttgttattcagcttttcataatatctatgctgagtattttcacgtatcttccaagtactcagctttttcgtatttcaaataaggtcagaccttttatacttttgaccaaatagttattttctatgttggacacttagttatttaccaaagcctccgatttgtgatgcagtgtttgtagtccttgtaaacaatatatacagactatacaagaattaattttattgggctttcaaaaaccatatttgcattccagaaccaaatctt

SEQ ID NO: 13369 - DNA, 464 bp, Homo sapiens
cctcaaaggaggggcagagctgcgcagggcaggagcagctggcccactggcggcccgcaacactccgtctcaccctctggcccactgcatctagaggagggccgtctgtgaggccactacccctccagcaactgggaggtgggactgtcagaagctggcccagggtggtggtcagctgggtcagggacctacggcacctgctggaccacctcgccttctccatcgaagcagggaagtgggagcctcgagccctcgggtggaagctgaccccaagccacccttcacctggacaggatgagagtgtcaggtgtgcttcgcctcctggccctcatctttgccatagtcacgacatggatgtttattcgaagctacatgagcttcagcatgaaaaccatccgtctgccacgctggctggcctcgccaccaaggagatccaggttaaaaagtacaagtgtggcctcatc

SEQ ID NO: 13370 - DNA, 335 bp, Homo sapiens
ctaagatggctgctgggcgaccacttcctgacagaagaaaagatgtggagtgggctgctacctcctggcctaaatgaaagtgacgctgagtcagactcggaaggtgaagctacgttggagaactctggacttaacttacaggaagataaagaggatgagagcatcagaaaaacagaaatcatagatttctcaacagatgaaccaaaaactgaaacagagtcaaatgtaaatgcctatgaagagtgtccttctggaattcccatagatatgtggaataaatttcaagaattgcataaaaaacattctgaacaaaaagcacaacctcaagattcaga

SEQ ID NO: 13371 - DNA, 294 bp, Homo sapiens
  misc_feature 272: n=a, g, c or t
tttatttataggaagctactactaaaaaaagtcactaactttgtgtacctataatccctaaattaaaattaaattttaattggctggctgtaatttgcattgagagaccttttactagtagctagtgttaggaagtgaacctaaaataagaaaatataatgatctgtgtttatcattagccttgtacaaatgtaaattactaatagtgatgttcttttgcaaggcatagaacatttgtatgaaaagacattttagtatgctttgaaaaaaanctcagcttttagttttttttcc

SEQ ID NO: 13372 - DNA, 229 bp, Homo sapiens
cagcgatattgggctttttttcatatgcttgtkggccgcatgtgtgtcttcttttgaagtgtctgtttatgtcctttgcccactttctaatgagatttttttttcttgtaaatttgtttaagttcattatcagtgttggacattagatctttgtcacatgcatcttgcaacagttttctcctattctgtaggttgtctgttcactctgttgacagtttcttctgctgtg

SEQ ID NO: 13373 - DNA, 311 bp, Homo sapiens
ccttttctgggaacgtgagtatcaaccaaggctggagtgcagtggcaccatctcggctcactgcaacctctggctcccaggttcaagcgattctcctgcctcagccccctgagtagctgggattacaggcacgcgccaccactcccagggtcttactctgtgacccacgctggagtgcaatggcaccatcacgacttactgaggcctccacttcccgggctcaagtgattctcacacctcagcctcctgagtagctgagaccacagatggagttttgctcttgttgcccaggctggaaaaaaaaaaaaaaa

SEQ ID NO: 13374 - DNA, 448 bp, Homo sapiens
ggctctctgttcagtagacttagggactgtttccatcagggttaggcctgatccacctgaacgcacagtgaatatccctcctggctgtgtcacaccacacttggagaagtcgcaattgagacaggggacatgaaaagagatgcagttttcagtttaaaagttgaatgcccaatttaatttctacccaagtagatgaggtctcacttgagctgtgccccaggctccgcagaccaaagggtcgcaagggacccagactgatccagacacctctcttttccaggaacccctgtttgctgctagagttatttatgacctcttgttcttcttcatggtcatcatcattgttcttaacctgatttttggggttatcattgacacttttgctgacctgaggagtgagaagcagaagaaggaagagatcttgaagaccacgtgctttatctgtggc

SEQ ID NO: 13375 - DNA, 349 bp, Homo sapiens
attgcgtagttccgaataccctcggccacacctggcttctccatgctcggaataacttcctgcagcgaccaacaggctaaagagggggaagggatccagcaccggctcctcctccggcaaccacggtgggagcggcggagaaaatgacataaacccgggaactctgagacgtctcctgggatgtttaactttgacactttctggaaggaccagagaagctctcgtatcccgtgacctccagacaaggagccacmagattggatgggagcccccacactccctccttaaaactccaccctctcatcactaatctcagcccttgcccttgaaataaaccttagctgcscca

SEQ ID NO: 13376 - DNA, 76 bp, Homo sapiens; identical to SEQ ID NO: 13365

SEQ ID NO: 13377 - DNA, 434 bp, Homo sapiens
  misc_feature 286: n=a, g, c or t
accggcggcggcgtaggacggaggcgtcgctaggcagcttcgaaccagtgcaatgacgatgccagtcaacggggcccacaaggatgctgacctgtggtcctcacatgacaagatgctggcacaacccctcaaagacagtgatgttgaggtttacaacatcattaagaaggagagtaaccggcagagggttggattggagctgattgcctcggagaatttcgccagccgagcagttttggaggccctaggctcttgcttaaataacaaatactctgaggggtaccgngccagagatactatggcgggactgagtttattgatgaacttgagaccctctgtcagaagcgagccctgcaggcctataagctggacccacagtgctggggggtcaacgtccagccctactcaggctcccctgcaaactttgctgtgta

SEQ ID NO: 13378 - DNA, 303 bp, Homo sapiens
  misc_feature 295: n=a, g, c or t
cttggctggccggtgtatgtccgctggattgtgaggcccgggatctgggctccgcgtggtgcagaaatgctgtgccggctcggggtcggtggctgcggcgctccctgccctgcagctttgggctagggacctgcsgcttgcgccggttcctacgagcggcgccaagcgcccactctcccagtgtgggcagtggcaccagtctctgcagtacatgcgaacggctggtacgaggccctggccgcgtcttcgccggtgcggggttgcgggaggaagtactgctcggcgtgcacgcccnacgggcct

SEQ ID NO: 13379 - DNA, 437 bp, Homo sapiens
aattttcgattccactctcttccgtttctgtcgctgcagtcgtccgcgggtaaggccctccctagaccctttatacctactttacctttcggaggtcaagacacctcctgttgccgcctcctcgcccaacacacaggcgccccccgcacggtaccaagcttgactaacggcctctaggggtgtgtggtgggacttgaaatcctcccttaatgaagtcacaccttctccgtccgcttccacccggtcggcccatggcagagccccatgtagcccaggaatcggcttggccttcggggaggtcagcgtccttactatccccactctccagtgcggcacattcgttcccctaggactccggccggttgccggcccaggcgggtgcttctccccaccaccgcccagctcagctcagcccagcccagcccactctgccctta

SEQ ID NO: 13380 - DNA, 287 bp, Homo sapiens
gacattgtttgccaaaatcccaggcagcatggacctcagtcttctctgggtacttctgcccctagtcaccatggcctggggcagtatggcgattatggatacccataccagcagtatcatgactacagcgatgatgggtgggtgaatttgaaccggcaaggcttcagctaccagtgtccccaggggcaggtgatagtggccgtgaggagcatcttcagcaagaaggaaggttctgacagacaatggaactacgcctgcatgcccacaccacagagcctcggggaacc

SEQ ID NO: 13381 - DNA, 416 bp, Homo sapiens
aaggaggaacccaccgcacctacagggcggtcgagtgagggagctgctggcgggtgggtctggcaactctttgggaggccgacgcgggcggaccggcgggtgctgggaacgagcctcggcttgcggccggcagtttccgtgggtctgtgaagaggtcggcggcccctgcggcgccagtcagctttaagaaaaagtagagatcacttctgactgtactgaacagcaaaaattaagtgacttgctgccctgcacatcatggcactgccattccgtaagacttagaaaagtacaaagaccttgatgaagatgagctccttgggaatctgtcagaaacagaactgaaacaactggaaactgkttttggatgatcttgaccccgagaatgcccttctgcctgcagggttccggcagaagaa

SEQ ID NO: 13382 - DNA, 460 bp, Homo sapiens
  misc_feature 329,358,382,425: n=a, g, c or t
agattgatgagaggaaatgtgttctgcccaactgtataatgcatttgaagcttaaaacaatgaatcagtattgatctggccacaaaatattaatgatttgaattaaaaagaaaattttagaaaatgatagctttgacaaattaaggtagcatttcatccacacgatggagtgtgttttattcagtaattgatttaaaaatggaatcaacctaagtgtctaacaggagggagttttataaattgttcacagaacatctgttccaaggagaccttgatgttcatagatttgtaaagaatgctgcttactagcacactgactgctctgcaanatgtctgagggttcctccacttggggcangttgggggtttgatcgcagagtanataaatggtgcattttataatgtaatatattctagcagatgcngcccacgactgtatagatactcttatgtaccacat

SEQ ID NO: 13383 - DNA, 473 bp, Homo sapiens
agcaacctgctctggttcccttccacgctgtgaagctttgttcttttggtcttcatgataaatcttgctgctgctcactcgttgggtccgtgccacctttaagagctgtaacactcaccgcgaaggtctgcaacttcactcctggggccagcaagaccacgaatgcaccgagaggaatgaacaactctggacacaccatctttaagaaccgtaatactcaccgcaaggtctgcaacttcattcttgaagtcagtgaggccaagaacccatcaattccgtacacattttggtgactttgaagagactgtcacctatcaccaagtggtgagactattgccaagcagtgagactattgccaagtggtgagaccatcaccaagcggtgagactatcacctatcgccaagtggcctgattcagcaggaagcatctcagacaccaaccactatgctgtcagcagttgcccggggctacc

SEQ ID NO: 13384 - DNA, 337 bp, Homo sapiens
acacctggccttctccatgctcggaataacttcctgcagcgaccaacaggctaaagagggggaagggatccagcaccggctcctcctccggcaaccacggtgggagcggcggaggaaatggacataaacccgggaattttaaatccaagctgggtttcatcaactgggatgccataaacaaggaccagagaagctctcgcatcccgtgacctccagacaaggagccaccagattggatgggagcccccacactccctccttaaaacaccaccctctcatcactaatctcagcccttgcccttgaaataaaccttagctgccccacaaaaaaaaaaaa

SEQ ID NO: 13385 - DNA, 335 bp, Homo sapiens
actcctgcttcctctctgcctctgtttctagttctcactctgacgtcccgcgtcctttttcatttgtctgcttctcgctcccttccgtgttctgttccctcttcctccctcttccctgggcctgtttctcgstgtccctgtcttttatccttctcatctgcctcttttttgctcaccctgtttctcactgccctcccctccgcctttctcacccctctgtccttttgagctcttbtttgctctgtctcttcatttgccttttgcactctcaaactctttcatcttcccattcgctgtctgtatttctccataactatatctttcttcctctgtct

SEQ ID NO: 13386 - DNA, 453 bp, Homo sapiens
aaacgggaagtgctatggtggagagaaagattactctggccgggctgtaaaggacggctacaatgggaggctgaaggcagaaccaagaaaatgggagtgagtatggaaaaggtacgattcagacggcataatggacgggacttggagactgaattgtagtgggccgaccacaaaatgataaggcatggaaggaagtagagtttggggggaaggatccctagtcccttaatggctaccttcttccccaggagttgttaggccatccgatcccctggcctgggaaagaaacactgatttcgttgctggcttgttcactcaccagaagctacagctactaacagttctaaaaactgtttcatgtgatgaggaacagacgaaaatagttttgagccctaagtccgccgattccagtgctttcttgaacccgcatttactaaaatattttcatgactg

SEQ ID NO: 13387 - DNA, 473 bp, Homo sapiens
tcctttccctcagctattccatggcttttcgtgtggacaaatcgggaggtggtgtaaactggtttttggtgaaattcggctcggcctcatgcgaacctatctaggtccgtctctggagtggcctgtcatcgatcgcgccctccatcgctgagcgacacaagtggaaccccccaggactgcattctgcgaaactaccctgcttttcccccagttttggtctgtgaacacatttgggaaattcttctgatcctaccgctactctcttgagatgaagaaacagctcagatttgaccaagatcacacaagtaggagttgaggaattggaacccactatgactgactccaaattaatatagtgtttatagccacttacataataatgagggtgttgctatgctttcctctgtacaagctggtggtgtatcaattcgttcttscttaactttgggactgtcacagggttcctgcaattc

SEQ ID NO: 13388 - DNA, 469 bp, Homo sapiens
ttctgattagctgtatctggtattaattgcatgttaaaacactggaatttttaaaattgaaattagatcagtcattcttttcttttctcaagatgtctcatggctgacactgaagaagaaatgtaattcataacttgcactaaatgtatattttttttcttaaaaatttaccattcttatttatatttttatggattaaratttataaaatacagatcagttaatattgcacttaagtaattttacctttttaatgtgatttttatagaataattcagacttacaaatacagagatatgaacaaagtttacagtgggaacaaaggtttaaaaaaaggttgtggttctctctctgtgatccagtgtgcacataaacctttctctgatctttcactgccatcctctggattatgtcttctgacctgtccattttgacccattaactggaaagttgaaaactacattaactg

SEQ ID NO: 13389 - DNA, 83 bp, Homo sapiens
gtcccgggcacctgcctagagggtagggtggaaactccatccccaatgagcacgggctcatctctgctggttcccgtctaggc

SEQ ID NO: 13390 - DNA, 378 bp, Homo sapiens
attatttataacggaggggacacagggatatggtttattccacagttaagtggtctgacggagccgagtctccaattgtaggctctacggaaatgaacttgctggtcctgcccaggcaaatgggcttagttccctatttatttatcctccagcaacagaactgagttcactcggtatctgaaattgacttttccagcagaaagtttttgtgggtatgggcactggccttggstttgagcaagcttgatgaatgttggatatttctggatttcagggtggccggtggaaatcctgccctttctgtacctgggcagtgcgcatcacgcttcccgcaagacatgctggatgccttgggcatcactgccttgatcaacgtct

SEQ ID NO: 13391 - DNA, 390 bp, Homo sapiens
cttttttgattagccttctgaccatgattaaaatggtgtacctcaaagtagctgctaaccttatgtgtatctgcaacaccctgaaaaattatctaatgaaaaggcacaaagaaaaagcttgtcaatgttgtggataattagaaagtgaataattttatttaatattagataaacaagcacataacagagatacatatattcaaatggaaggagtaaaattaccaccacatgcagatctgtttttctgtccagaaaataacaagagattctactcaggtaaaaaaggaaaggaaggaaaaccattgtaattaaaataaaatttaatacaatagccgtttattaattcaacttctaaagaatctttgtgattacacaatgaccagctagtaa

SEQ ID NO: 13392 - DNA, 361 bp, Homo sapiens
attgcgtagttccgaataccctcggccacacctggccttctccatgctcggaataacttcctgcagcgaccaacaggctaaagagggggaagggatccagcaccggctcctcctccggcaaccacggtgggagcggcggagaaaatgacataaacccgggaactctgagacgtctcctgggatgtttaactttgacactttctggaaggaccagagaagctctcgcatcccgtgacctccagacaaggagccaccagattggatgggagcccccacactccctccttaaaacaccaccctctcatcactaatctcagcccttgcccttgaaataaaccttagctgccccacaaaagaaaaa

SEQ ID NO: 13393 - DNA, 172 bp, Homo sapiens
gtcaggagttctagaccatgcctggccaacatggtgaaacccgtttctactaaaaatacaaaaattagctgggcatggtggcgagcgcatgtagtcccagctactcgggaggctgaggcaggagaatcgcttgaatccgtgagcggagtttcaccatgttggccaggctggt

SEQ ID NO: 13394 - DNA, 461 bp, Homo sapiens
taccgtaatattatatcttgccctgcttatttacaaaataatatgtttctgttatggtccttagtaataattgaagaggcttagaaatacatctgcttgtttattgagaaaacgatgcaaataattctgcttttagagccttgttattttatttcacaaaacaggcatatgtctaggagtgtaatttgtggatggttgagtttgtaagaacaatcataaaaggacttgttagtctccagaacatctgctaaaatgcaagtatatgtataaggtaatagcatattacagctgaaaattttgagaaggtaaaagtttcttaattaaaatatgaacatatttagcttgctttagtgtctggggcaagtcctctcaatggctaaaattaactttagagatccatgtgttcaggtttagatcatatgacactcgagcacagaagaataatttcaaggaggtcatct

SEQ ID NO: 13395 - DNA, 85 bp, Homo sapiens
aaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 13396 - DNA, 117 bp, Homo sapiens
  misc_feature 35: n=a, g, c or t
acataagaaaattgaggtttggaagagtgaagcknttttctttttcttttttttttttgagasggatctcccactgtsgcccaggctggagtgcagtggcgcaatctcggctcactg

SEQ ID NO: 13397 - DNA, 469 bp, Homo sapiens
ataagacccaggctgacgtggtctccgatggagctgaggaacttactgggaactggagcaaaggtgactcttgttatgttttagcaaagcgactggcagcattttgcccctgccctagagatgtgtggaactttgaacttgagagagatgatttagggtatctggcagaagaaatttctaagcagcaaagcattcaagaggtgacttgggtgctgttgaaagcattcagttttaaaaggaaaacagaggatagaagtttgaaaaatttgcagcctggcaatgcgatagaaaattccattttctgaatagaaattcaagccagctgcagaaatttgcataaggaaggaggagccaaatgttaatccccaagacaatggggaaaatgtctccaggccatgtcagaggccttcacggcagtccctcccatcacaggcccagaagcctaggaggaaaagtggtttcatgggct

SEQ ID NO: 13398 - DNA, 326 bp, Homo sapiens
acacctggccttctccatgctcggaataasttcctgsagcgaccaacaggctaaagagggggaagggatccagcaccggctcctcctccggcaaccacggtgggagcggcggaggaaatggacataaacccgggaattttaaatccaagctgggtttcatcaactgggatgccataaacaaggaccagagaagctctcgcatcscgtgasctccagataaggagccaccagattggatgggagcccccacactccctccttaaaacascascctctcatcactaatctcagcccttgcccttgaaataaaccttagctgccccaca

SEQ ID NO: 13399 - DNA, 378 bp, Homo sapiens
  misc_feature 82: n=a, g, c or t
agatttgtaagggaccagcctggaagcagggaatcggtcaggatccgagtsaccctggagcccaggcagagatcagcgaaanyctcgctgatgcataggtctggaaggcgtggggctccgggaggctgagcagctggactcggcatgaccagaggtcgtgaggccgttccgcagcttgggacgctcctgaccctcagaatcaagcgcgggccactgcattagcatgggagaaatggcagagatagggcttgarggagggatgcccgagattaaaggtattaaaggtaaattggtgtcgccgcaaaaccagcgtgggagccaggaaacgagagtttcagtctttcttcgctaattccagagatagctgcatatcacagg

SEQ ID NO: 13400 - DNA, 269 bp, Homo sapiens
  misc_feature 160: n=a, g, c or t
ctcacctctgtaatcctagcactttgggagaccgctgaggcaggtgtatcacctgaggtcaggagtgagaccagcctggccaacatggggaacctgtctctgctaaacatacaaaaattagccgggtgtggtggcgggcactataatcctagctacgcgngagggtcaggcaggaggattgcttgaacscgggagtggaggttgcagtgagccgagatcacactattgcactccagcctgagcaacaagagcaaactccgcctcaaaaa

SEQ ID NO: 13401 - DNA, 225 bp, Homo sapiens
aaaattaacagtgcgtatttgcctgaagaaggtcagtgtgcttgcttggagatcaggacgcaaaggtcaccatcagaaaagctaagtttgctgtatagtgaggatcaggagatctgatcctgattgcagaaccttccctgattacagaatcttggatgatttcacaaaagttcatsttcattgcagatacctgcctttctttctagggtgtatctcccacttcac

SEQ ID NO: 13402 - DNA, 446 bp, Homo sapiens
aaaaagattcgggcgtggtggcttatacctgtggtcccaacattttggaaggctgaggtgggaggattgcttgaggataggagtttgagaccagcctggtcaacatggcgagactcctgtctctacaaaattttttttaaaaattggctgggcatggtggcttgtgcctgcagttccagcttcttgggaggctgaggtgggaggatcccttgagcacaggagtttgaggctgcagtgagctataattgtgcactgcactgcagcctgggtgacagagcaagagcttgtctcaaaacacaagaaaacaaaacaaggctgggcacagtggctcatggcctgtaatcccgctttgggaggcggaggtgggtggatcgcttgaggtcaggagttcgagaccagcctggtgaacatggcgggacccccctatstactgagagtacagaaaa

SEQ ID NO: 13403 - DNA, 421 bp, Homo sapiens
atatacagaaaactgaaactggaccccttccttacaccttatacaaaaattaactcaagatggattgaaaattaaatgaaaaacccaaaaccaaaaaaagaccctagaagaaaacctaggtgatatcattcgggacataggcatggacaaagacttcatgaagaaaatgccaaaagcaatggcaacaaaagccaaaattcacaaatgggatctaattaaactaaagagcttctgcacaacaaaagaaactatcatcagagtgaacaggtaacttagagattgggagaaaatttttgcagtctacccatctgacaaaggtgtagtgtccagagtctacaaggaacttaaacaaatttacaagacaaaaacaaaaaacccgtctaaaagtgggcaaaggwtatgaacagacacttctcagaag

SEQ ID NO: 13404 - DNA, 263 bp, Homo sapiens
cacaaagaataggatgggataaagaaagtggacacttaaataagctataaattatatggtccttgtctagcaggagacamctgcacaggtatactaccagcgtttggatattgatatatacatggcaaatctgaatattgttttatgagaggcctggcaatgggtaaaacaccaaacttgaaatcagaacataggtgcaaatggccactcctgtagtttcttttctgtaaaatgggatctggacgaatgataccaaacgtttc

SEQ ID NO: 13405 - DNA, 76 bp, Homo sapiens; identical to SEQ ID NO: 13365

SEQ ID NO: 13406 - DNA, 481 bp, Homo sapiens
tcagtcgcctcagccgcggtgtgagggagccggagtcttccttagcttctccgccatgggtgtcgcttcgtagccgggctgctccgggaaaggcctcgtacagcacgcattcaccagaatcctgtcagctttcctcttctcatccagacgcctggccaggatcctcgataagactgtgacccccaacttggacaccccataaggttcccagatgatgtgacagctactggtctccagccacaccttgagaacacttggctttgactaccacttcttaaacttaaaggaaaactagacaatccaccagcccaggaggggacaagcaggcttattcctcstcctcgtcatctctggctccagccccaccctggcccttgctggsattcttcstcttcacgtggctggggttggccaccccaatagggaagcagagggagaagtcaatgtgcttctgggaatccaggcggacagtgaagaacag

SEQ ID NO: 13407 - DNA, 357 bp, Homo sapiens
  misc_feature 254..256: n=a, g, c or t
attgcgtagttccgaataccctcggccacacctggccttctccatgctcggaataacttcctgcagcgaccaacaggctaaagagggggaagggatccagcaccggctcctcctccggcaaccacggtgggagcggcggagaaaatgacataaacccgggaactctgagacgtctcctgggatgtttaactttgacactttctggaaggaccagagaagctctcgcatcccgtgacctccagacaaggagccannngattggatgggagcccccacactccctccttaaaacaccaccctctcatcactaatctcagcccttgcccttgaaataaaccttagctgccccacaaaaga

SEQ ID NO: 13408 - DNA, 226 bp, Homo sapiens
gagaaagagraacgggagcaagagagaaggaggcccagacagtgagggcaggagggagagaagagacgcagaaggagagcgagcgagagagaaagggttctggattggaggggagagcaagggagggaggaaggcggtgagagaggcgggggcctcgggagggtgaaaggagggaggagaagggcggggcacggaggcccgagcgagggacaagactccgactcca

SEQ ID NO: 13409 - DNA, 366 bp, Homo sapiens
tttacaaatcctgattagttaagtgcatacattatgaaacttacagaataaaacttattatacatctctttcttaaattaatatctttacacattttcaactggctccccaagtctgataaggaaggattaaaagaaaaaagaaatgtattagttgggtggccaaggagtttcctttgtaatgttgagagacttccgctttctgaatttcgctggttctctaaggtaaaagagttaaatagtacccttgttcaccaaggaaagtgatccaaactatatatctagtgcagatatttcctttgcattatttagtcttctctggagagaaaatacagtttccccttcctctttctcttcacatttactc

SEQ ID NO: 13410 - DNA, 438 bp, Homo sapiens
ataaaccctgagatatgagggttgggcgagacatccgagcctgtttcgttccgtgttgggaccaggaataaccctgacttctgagctttcataaccccaggatcctccagaaaatttgcggcgcgctgagggaaaaccttgctgaagctgtacattggaatgcgtttacagtcattgtaatggaagcaaaatacatgaaggaaaaactgttatttgtatccctgcttattgcacctgacgactagttgcagatggttttgtttacctaagaaaacttgtgatataaatgaaaaaracacctgttttcctagagtcattggttacaaatatgcttcgtctaagagctatttgtccattctcctggagagtgtttcaatttcgacccatcagttgtgaaccactaattattcagatgaataagtgtacagatgaggaggc

SEQ ID NO: 13411 - DNA, 310 bp, Homo sapiens
ccttttctgggaacgtgagtatcaaccaaggctggagtgcagtggcaccatctcggctcactgcaacctctggctcccaggttcaagcgattctcctgcctcagccccctgagtagctgggattacaggcacgcgccaccactcccagggtcttactctgtgacccacgctggagtgcaatggcaccatcacgacttactgaggcctccacttcccgggctcaagtgattctcacacctcagcctcctgagtagctgagaccacagatggagttttgctcttgttgcccaggctggaaaaaaaaaaaaaa

SEQ ID NO: 13412 - DNA, 366 bp, Homo sapiens
attgcgtagttccgaataccctcggccacacctggccttctccatgctcggaataacttcctgcagcgaccaacaggctaaagagggggaagggatccagcaccggctcctcctccggcaaccacggtgggagcggcggaggaaatggacataaacccgggaattttaaatccaagctgggtttcatcaactgggatgccataaacaagaaccaggtcccgccccccagcacccgagccctcctctacttyagccgactctgggaggatttcaaacagaacactcctttyctcaactggaaagcaattattgagggtgcggacgcgtcatccactgcagaaacgtgcargcagagccgatcagccs

SEQ ID NO: 13413 - DNA, 419 bp, Homo sapiens
caagtaaaggtgacgcgtgggccaagtacatggcagaagtgaaaaagtacaaagctcaccagtgcggtgacgatgataaaactcggcccctggtgaaatgacgcccctcccccacctgcccatggcctgggactctctgcgatgtacataactatttaatgcagcggcasggcgacascttccctgagaggacttaaaagcagaaggaaaccgagatgcttcccgcagccgtggacgattctccaggactctttttttaccttgagcacttgcctcgtgagacttcatagaacagtggtttactgtcccccccttctcacctcctcattctctctggctctttctgtcttcctcttctcaccctcctccctccccttagccatcacttctgggaagtaaagaacttgacttagtgccgg

SEQ ID NO: 13414 - DNA, 358 bp, Homo sapiens
gccagagttctttctgctatcccttactttagtaatatcctttaaaaatgtaccgcggccaggtgctgtggctcacgcctgtaatcccagcactgtgggaggctgaggtgggtggataacctgaggttaggagttccagaccagcctggccaacatggtgaaaccccatctctactaaaaatacaaaaattagctggaccctatggtacatacctgtaatcctagctacttgggaggctgagccaggagaattgcttgaacctaggaggcggaggttgcagtgagccgagatcatgccattgcactccagcctgggcaacaagagtgaaactccatcagaaaaaaaaaaaaaaaaagg

SEQ ID NO: 13415 - DNA, 268 bp, Homo sapiens
cttgctgaggctggggcaaccaccgcagkcgagacagcaggcggctcaagtggacagccgggatggcagagcgtgcggrcgctggaggagctggtgaaacttcagggagagcgcgtgcgaggcctcaagcagcagaaggccagcgccgagctgatcgaggaggaggtggcgaaactcctgaaactgaaggcacagctgggtcctgatgaaagcaaacagaaatttgtgctcaaaacccccaagggcacaagagactatagtccccggc

SEQ ID NO: 13416 - DNA, 68 bp, Homo sapiens
  misc_feature 46: n=a, g, c or t
taccatttcacacataagaaaattgaggtttggaagagtgaagcknttttctttttcttttttttttt

SEQ ID NO: 13417 - DNA, 313 bp, Homo sapiens
tcttaaacaccggttctcaccttgggtggcacactggaattatttggggagctttgtaaatcatcattgctttattctcactcccagagattgggatttgattgatctggagtaggattgaaatttttaaaaaattctcccgggtgattctaatgttcaaccaggggctctcagctatatctgcaccagagtcacccagagaagctttaaaaactgtcaatacctgagccccactcctggaaattctaatttaagtgttcttcggggggtggggtggggttcaggctttttttttttttttggaaggcttctc

SEQ ID NO: 13418 - DNA, 187 bp, Homo sapiens
accagttgggttgcacattgtgtggtcgtccaaataactcaatcttgcgagtgccaggagatagtctttcaatcatgccatagatttcatctggtttatgactggtggaacgaacctaggaaataaaaactagctgctttttaagttaaaaaaaaaaaaaaaaaaaaaaaaaaaaaaaaaaaaaaaa

SEQ ID NO: 13419 - DNA, 311 bp, Homo sapiens
cctttgtgctgcggcggcggcttctsgagtcctccccgasgcgtcctctaggccagcgagccccgygstctccggtgacgaccatgtcggcggcgggacggrcgcggcgtagaggcgggcttctccagcgaggagctgstctcgctccgtttcccgctgcaccgcgcctgscgsgacggggacctggccasgctctgctcgctgctgcagcagacaccccacgcccacctggcctctgaggactccttctatggctggacgcccgtgcactgggccgcgcatttcggcaagggtcttgctctgttgcccac

SEQ ID NO: 13420 - DNA, 351 bp, Homo sapiens
  misc_feature 255: n=a, g, c or t
attgcgtagttccgaataccctcggccacacctggccttctccatgctcggaataacttcctgcagcgaccaacaggctaaagagggggaagggatccagcaccggctcctcctccggcaaccacggtgggagcggcggagaaaatgacataaacccgggaactctgagacgtctcctgggatgtttaactttgacactttctggaaggaccagagaagctctcgcatcccgtgacctccagacaaggagccaynagattggatgggagcccccacactccctccttaaaacaccaccctctcatcactaatctcagcccttgcccttgaaataaaccttagctgccccac

SEQ ID NO: 13421 - DNA, 457 bp, Homo sapiens
actagggtgttcactattgtgaatttataatcttaaaagttggggatgctaaaagtaccagactaaaatactacgaggttttctcatcttttaattccattttgttagaaaaaaataatcacaaccggggttcttttacctttccccagccatctagactgctttactgcaatgttgggaagattgcatacaataaaaactgtagctagttgattgggatttgggaaaattgaatcaagcatttgcattcatccagaatggtcttaaactgctgactgtggggtgcccacaggatgagcactggtggcatgggtgggaggaatttccttggatactgcaattgcatttgaaagatctattttccaaaacctgagcagagagaggctaggaggaatgcagacaggacattgaaaatgcgaattccctttactagtagaacatgaaatatctgataatg

SEQ ID NO: 13422 - DNA, 466 bp, Homo sapiens
gtgttggtctatatgacagggaggagagtaaaggagagcaggagcaattggctgcctgcaaagccagctggaggtgaagtgcaggaaaggaaaggtcaccccattctactccatggcctctctgctcccagctgtggtaggctcacatagccagtgtgatcggtttttaagaggcagtgcttttcagcttttctccctgatatatccattttgcttcccagcactttttaggagtagtgagagcgcttcctgcccttgttggaagccccagggtggactctcagcacgaaggtctctcccttaactgctgcccttccaagacttgctcccgagatggagtgggcgtggtcttccaggctggcccttccttctcctcaccgccaccttccctgccccagccccagcagccatgggtacatggggtccccagctcacctatggattcccgccagtctgcccagctgca

SEQ ID NO: 13423 - DNA, 440 bp, Homo sapiens
taatttagatgccagctttaaatagttaactatatgcttactgtggagtgcaccaatgaaacaactcattttgttcttttggcttctcaatacttctttgtgacaaagcatcaactgtataagataaatagtagcttattttgtgagtatggttgctctatgtagcaagcagttgtgacctaaagcaacccataaattacagatttagtgggagaactggacagttaacaacgtcacttttgctttggactactacttaggtcccttaaagtggtgccagtgccacagaactgaagattcctgactgtagggaatataccatctaattttgagtttcaatagagtaactttgattttagtgagttgttgggaaatcctttagatcattagttatgcagcaaaattgcttggctttaataatcatatgtactggcttattc

SEQ ID NO: 13424 - DNA, 447 bp, Homo sapiens
catgttttaatacattgattaaaaaatttgcaagccaaattatacataaattatgttctaaacaaaaggggtaataagcataggtattctctcttggacacttgtaagttactgttagtgaattgttttttacgtttcatttaataattgctgctaaaggtgatgtttactgataaatcattttaaaatttttttgttttgaaaagtaaatttatcccccatgatgttagatacatttaaattattaagtcttttcagagatgagatggggacaggaagttattttgagccttacaatattatttagcccaataaaagatgcattgaagctcttatatattatgagtttgaaaaattttgaaggtagcatattgaagtgatctataaatatcttcagtcctctctgaagtgtgggtatttcttctatctaaaaawtacatacagtga

SEQ ID NO: 13425 - DNA, 369 bp, Homo sapiens
atttctagttattacccagagtttttatgtagcagggaaaatatatatctaaatttagaaatcatttgggttaatatggctcttcataattctaagactaatgctctctagaaacctaaccacctaccttacagtgagggctatacatggtagccagttgaatttatggaatctaccaactgtttagggccctgatttgctgggcagtttttctgtattttataagtatcttcatgtatccctgttactgatagggatacatgctcttagaaaattcactattggctgggagtggtggctcatgctgtaatcccagcacttggagaggctgaggttgcgccactacactccagcctgggtgacagagtg

SEQ ID NO: 13426 - DNA, 99 bp, Homo sapiens
  misc_feature 47: n=a, g, c or t
aacagcccggaagccgctggctgggttaacctgtggcgcgctccsgntttccggcgcctgaagttttagctgcggtggtggcggcagtcgggaccgacy

SEQ ID NO: 13427 - DNA, 480 bp, Homo sapiens
agaatcactaggcgccggcgctcccgaggcagtgtgtttccgcccagagctggagtctcccagctgccagccgaccccgaacccgcactcccgccaaccgcgctttttgtgggcggtcggaaaccacagcctccgttggatatgttcgtgcatgttataaacaaccacttaaaccctccggatctgagcctcccgcagaggaatgcagaatgacgccacggcacgcaggatgtgatgtcaccgagatgcagaggatactcagtcaaccaacatttactgagcatctacttcgtgccgtatgtcttgtcaacggaaaggggtccctatccagaccccaagagagcattcttggatctcttgcaagaaagaatttgaggcgaatccatagagtaagcttagtgatgtgtgtcagacctctgagcccaagcaaagccatcatatcccctgtgacctgcatgtatacatccagatggcctgaag

SEQ ID NO: 13428 - DNA, 365 bp, Homo sapiens
attgcgtagttccgaataccctcggccacacctggcttctccatgctcggaataacttcctgcagcgaccaacaggctaaagagggggaagggatccagcaccggctcctcctccggcaaccacggtgggagcggcggagaaaatgacataaacccgggaactctgagacgtctcctgggatgtttaactttgacactttctggaaggaccagagaagctctcgcatcccgtgacctccagacaaggagccaccagattggatgggagcccccacactccctccttaaaacaccaccctctcatcactaatctcagcccttgcccttgaaataaaccttagctgccccacaaaagaaaaaaaaaa

SEQ ID NO: 13429 - DNA, 169 bp, Homo sapiens
aaattagccaggtgtggtggtgcatgcctgttatcccagctacttgggaggctgaggcaggagaatcgcttgaacctgggaggtagaggttgcggtgagctgagattgcatcattgcactccagcctgggcaacaagagtgaaactccgtatcaaaaaaaaaaaaaaaa

SEQ ID NO: 13430 - DNA, 459 bp, Homo sapiens
aaactcctgctaagctaactagctcttttttatgggtccatgcacacgaccgaactcctctttcactgaccagagattatttctgacaacccaggatatcccgaaagcttggaggcatatggctggaaaatgaaacgacccaggacatcgtttctggctgcatcattattttgtgtcgcgtagtaccagatgggcagtcagtgagcggcgcagggatgtgaacggacggttttataatgtgaaaattttcccttggtaaagctaaaacagatttaatttccctctcttttctttcactacttccccctctttattccccctctgtctgcaatatcagtgaactcaactttgcagtgaggtggccaaaaaagagagagaatgaggagatcttgatcatcttagtgtcagabgagtcgcagcggactgggaactgcagctgcgaccccccgcgtchtgtgc

SEQ ID NO: 13431 - DNA, 304 bp, Homo sapiens
taatgttgaaattggggtgcttttaggactcttcagtggtagagctgtctggttagaaattaatctttaagttgggatgccgaggtgggaggatcaggtgaggccaggagtttgagacccggtctctacaaaaaatacaaaaaattatctgggtttggtggtgcacacctttagtgccagctactcggaaggccaaggcaggaggatcacttaagtccaggagttcgaggctgcagtgaactgtgattgcaccactgcactcaagcctgggtgacagagcaagactccgtctcaaaaaaaaaaa

SEQ ID NO: 13432 - DNA, 415 bp, Homo sapiens
tactgcagcctcttttaagacaaactagaaataagttaaccataggctgagcatggtggctcatgcctgtaatcccagctttgggaggccgaggtgggaggatcacttcagatgaggagttggagaccagttgggccaacatgatgaaaccccatctaaaaatacagaaattaaccgggtatggtgttgggcacctttaatcccagctacttgggaggctgaggcgggaggattgcttgaacccaggaggtggaggttgcagtgagctgaaatcatgccactgcacttcaggctgggtgacagagtgagactccatctcaaaaaaaaattaaraagtaaaaataaataaattaaccatagttctttgaaaatagtgtctatgtgtctaaattttttttctttctttctttctttt

SEQ ID NO: 13433 - DNA, 426 bp, Homo sapiens
agaaacccatgtttctaaattattgaactaactttcatattgtaaaaaaaatccaaaataaaaaggtcaagaaataactgaaaagatgcataaataaacaatagtcagcataataaaatataaacagacataaaacactattttacacccacggtttggcaaagatgtggggaaatgggaattatctttcactgcctatagaactgtaaattggtacgaagactttgaggagtgctaggtttaatatctgataaagttaaaattgaatgtactcggccgggtccggtggctcatgcctataatcccagcactttgggaggccaaggtggctggatcacccgagatcaggagtttaagaccaccctggccaacatggtgaaacccatctctactaaaaatattaaaaaattagctgggtgtggcggc

SEQ ID NO: 13434 - DNA, 372 bp, Homo sapiens
ctttttaaacggggtgacgtggactggggagtacctgaagcttcttgggcgtggtgggttgggatgggggactgggggtatgtgtgtgacttggggaacacaggtggggtctgccctgcaccccctcccagcccgaccatcctgtccccagtgctctggcgctgcttcagcaccgtggtcatctttctgttcctgctggacgagcagacgagcctgctggtgctggtcccggcggtgttggagccgccattcagctgtggaaagtgaagaaggcattgaagatgactattttttggagaggcctgatgcccgaatttcagtttggcacttacagcgaatctgagaggaaaaccgaggagtacgatactcagg

SEQ ID NO: 13435 - DNA, 141 bp, Homo sapiens
cttctccatgctcggaataacttcctgcagcgaccaacaggctaaagagggggaagggatccagcaccggctcctcctccggcaaccacggtgggagcggcggaggaaatggacataaacccgggtgtgaaaagccaggga

SEQ ID NO: 13436 - DNA, 313 bp, Homo sapiens
aaaaagattcgggcgtggtggcttatacctgtggtcccaacatyytsgaaggctgaggtgggaggattgcttgaggataggagtttgagaccagcctggtcaacatggcgagactcctgtctctacaaaattttttttaaaaattggctgggatggtggcttgtgcctgsagttccagcttcttgggaggctgaggtgggaggatcccttgagcacaggagtytgaggctgcagtgagctataattstgcactgcamtgcagcctgggtgacagagcaagagcttgtctcaaaacacaagaaaacaaaacaag

SEQ ID NO: 13437 - DNA, 406 bp, Homo sapiens
caacttattttctgagataccactaggcctactgtctttcatgccattttatataaacattttgatagatactctgtcttttgttttttatctcttctcttttcaagagtcacttgactttttcaaatattcttaaaagatagatttagttattgtattttggtctacaattttggacttggcagtttgttttactaatgcagaattattctttttgtttcaaacatagtttgccatcatctggctactacctaatcatgttgtactagttattgtggaaagaaaattgtacatacatttccttgtcctttgggagatgtctttgagtcaaacccacaagcatgaactctcacctgaaagaaaactggaaaaggagaaactttaaatcagtatgttttgaaaggaa

SEQ ID NO: 13438 - DNA, 464 bp, Homo sapiens
caaataccaagcaaaatagtgtgcctccttcacagaccaagtctgaaactagctgggaatctcccaaacaaataaaaaagaagaaaaaagccagacgagaaacgtgaaattttttttcctgaattggacatgtgtttgcaaacacttgtcttgaagattatgctgtttatgcaataatttgtgaacatgtacagagttttatataaatttaaaccaatttttaaaacaaaactgcggacaccaccataaaaatggaatcaaaagaaagttaatttatgaaattaagaggtcagcagaatatactcasygctggaagacacttgggaaagtctttttaatagaacaagaacgatcttaatttaagaatattatcctggtttaacaacagtgccctgtttacaacagattgtgccctatctcatctgcagccgaggaataaaggattctgattagaaagagggttg

SEQ ID NO: 13439 - DNA, 464 bp, Homo sapiens
aaataatattgttcacttttgcctatttttgagctttttatagaaaaatgctactgcgaaattattttgagtcatatcttttgatcgatattaagatacatttgcagagttttgtatgtgtgtttatatccatcttacataattctttactgtatagcgttccctttagccactggaaaatgatataatgtcattgcttacagaaggtgactgattcttattcagtgctactttctacagacaggtaactattcgcatttacgattaagaaatgttcacaccttcacactggtatcaactgcaacaaccactatacttctccagtgattgccagatggcccactatacatcctttcttctatttctttcttttgtggccagaaagtcaggacctcaaagaggtataagtttgtgtgtataattccctggcttttttctaaaattttagtatgcatttatgtggc

SEQ ID NO: 13440 - DNA, 147 bp, Homo sapiens
tttcactgagaggggaagattcatgatccttgtatgatacttaaaattcatgacccaaaataaatgcatgtgggctgcactagtaactgataacttgctmwggtcmtgctgtgtgcccaacttaagcagggcattatatgtatatta

SEQ ID NO: 13441 - DNA, 293 bp, Homo sapiens
  misc_feature 234: n=a, g, c or t
cgtcatcatgctggtgggcaacaagagtgacctgcgccacctgcgggctgtgcactgacgaggcccgcgccttcgcagaaaagaacaacttgtccttcatcgagacctcagccttggattccactaacgtagaggaagcattcaagaacatcctcacagagatctaccgcatcgtgtcacagaaacagatcgcagaccgcgctgcccacgacgagtccccggggaacaacgtgntggacatcagcgtgcsgcccaccacggacggacagaagcccaacaagctgcagtgctgc

SEQ ID NO: 13442 - DNA, 511 bp, Homo sapiens
aaaaagattcgggcgtggtggcttatacctgtggtcccaacattttggaaggctgaggtgggaggattgcttgaggataggagtttgagaccagcctggtcaacatggcgagactcctgtctctacaaaattttttttaaaaattggctgggcatggtggcttgtgcctgcagttccagcttcttgggaggctgaggtgggaggatcccttgagcacaggagtttgaggctgcagtgagctataattgtgcactgcactgcagcctgggtgacagagcaagagcttgtctcaaaacacaagaaaacaaaacaaggctgggcacagtggctcatggcctgtaatcccgctttgggaggcggaggtgggtggatcgcttgaggtcaggagttcgagaccagcctggtgaacatggcgggacccccctatctactgagagtacagaaaattggccgggggtggtggcgtgcgctgtggtcccagctgcttgggaggctgaggcaggagaattgc

SEQ ID NO: 13443 - DNA, 346 bp, Homo sapiens
  misc_feature 254..255: n=a, g, c or t
attgcgtagttccgaataccctcggccacacctggccttctccatgctcggaataacttcctgcagcgaccaacaggctaaagagggggaagggatccagcaccggctcctcctccggcaaccacggtgggagcggcggagaaaatgacataaacccgggaactctgagacgtctcctgggatgtttaactttgacactttctggaaggaccagagaagctctcgcatcccgtgacctccagacaaggagccanngattggatgggagcccccacactccctccttaaaacaccaccctctcatcactaatctcagcccttgcccttgaaataaaccttagctgcc

SEQ ID NO: 13444 - DNA, 120 bp, Homo sapiens
agtaagattagcttgactaagggagcgaagggcgtcacactgcttttggaaacaggtggtgaggctggcgtcgccatgttttctaagggactttctcaggatcagatccaagagtggtcc

SEQ ID NO: 13445 - DNA, 441 bp, Homo sapiens
taggtcaaaaagggaaatgtatcaatgcatagccctgtggttggtaattgtgtatgctcagctttataactgcagtcatttgaaatactttaagaacaaccagtgtcttccactggcttcactcagatgctaatctctggaaacacttgcacagacacactcaaaacactaataagttctaggtgttccttaatccaatcaacttgacacctaaaattaagtcccaaagaacacctcttatcaactcagcacccatacatacctccttaaaccgtacttaatttccaaataaagacaatgagaaagttgtagttctacctatcatgatgccagtatcctctgattgtgatttttgggattttagacattatggattttagattaggcattttgatcttttgggatttcaccattcaggattaaggtgttcgagattgtgtc

SEQ ID NO: 13446 - DNA, 300 bp, Homo sapiens
  misc_feature 125: n=a, g, c or t
atcacagttcattacagcctcaacgtctcggactcagatgatcctgccacctcaatctcccaagtagttgggaacacagaagtgattcagcactcaggattattgcccacrcccctacgattgcncccccaagcaatcaccagcaagcacccaatgcctagccakvcccaccccttcccccaaactacctttgaaaaacccctaacctaccagccttcaatgagattgatttgagtaataactccatctccagtgtggagtggccagcctcacatcaattaaactctttctttactacaa

SEQ ID NO: 13447 - DNA, 388 bp, Homo sapiens
  misc_feature 380: n=a, g, c or t
aaaatctgcaagctgaaccaactcaactgtggctgccttgcccacctgaagacctcaggatccaccagcagcccaagacacctcggaagctgtttcaaggtcagtaccagaagtcgtgtttttgagtgatttgcaatgtaatgcaaaactcaatggaatgaggagtttttttgtggccttgtattttctttcacaccactgaatgccagtgtttatgctggggcatgcttagagatggaaatttggaaggaaagtccatcacagcatttgtgcsaattggggatccagcaataatatctgtttaacaacaccaatagtaagcagatgaatgtatattgaccacgttagaagtaaaacgagaaagatgttagaatgacatngaggaaaa

SEQ ID NO: 13448 - DNA, 54 bp, Homo sapiens
ctctgcgtgcgccggastgccgtggcgggtgggccgctgacttctcstcccggc

SEQ ID NO: 13449 - DNA, 269 bp, Homo sapiens
  misc_feature 185: n=a, g, c or t
atcatcaagccatttaccaggcttcggaggaagctgtttatgtgatccccgcactaattaggctcatgaactaacaaatcgtttgcacaacttgtgaagaagcgaacacttccatggattgtccttggacttagggcgccctgcccgccttttgcagaggagaaaaaacttttttttttttttsntccccccgaaaactttccccccttctcctccctgcctctaactccgatccccctacgccatctcgtcaaaaaaaaaaaaaaaaa

SEQ ID NO: 13450 - DNA, 403 bp, Homo sapiens
  misc_feature 237..238,373: n=a, g, c or t
ctttctctcttgaaccatttgaaagttgtgcatgttatgacattttgcctggatgtgctaagcatacgtctcctaagaataagtatattctcttatataaccacaatatttactctttaaaaactgtagaaattctataacatcacattccatattcagatgttccaagtgtaccaaaaatacctttactttttttttttttaagagmcaaggtcttggtcggtcacccaggctggnntacagtagcatggtcatagttcactgcagccgttaaacttttgggctgaagtgatccttctgcctcagtctcccttctggagtagctaggactacaggagtggaccaccatgccaggctaatttttaattttttnccttttgtagaggtagagtcttgctatatt

SEQ ID NO: 13451 - DNA, 303 bp, Homo sapiens
tttaatggctgggcacggtggctcacacgtgtaatcccagcactttgggaggctaaggtgggcggatcacaaggtcaggagatagagaccatcctggcgaacacggtgaaaccccgtctctactaaaaatacaaaatttagccgggcgtggtggcgggctcctgtagtcctagctactcgggaggctgaggcaggagaatggtgtgaacccgggaggtgcagcttgcagtgagctgagatcgggccactgcagtctagcctgggtgacagagagagactcggttccaaaaaaaaaaaaaaaaa

SEQ ID NO: 13452 - DNA, 401 bp, Homo sapiens
aatggaggtggaggccgtctgtggtggcgcgggcgaggtggaggcccaggactctgaccctgcccctgccttcagcaaggcccccggcagcgcsccactacgaactgccgtgggttgaaaaatataggccattaaagctgaatgaaattgtcgggaatgaagacaccgtgagcaggctagaggtctttgcaagggaaggaaatgtgcccaacatcatcattgcgggccctccaggaaccggcaagaccacaagcattctgtgcttggcccgggccctgctgggccagcactcaaagatgccatgttggaactcaatgcttcaaatgacaggggcattgacgttgtgaggaataaaattaaaatgtttgctcaacaaaaagtcactcttcccaaaggccgac

SEQ ID NO: 13453 - DNA, 465 bp, Homo sapiens
aatccagckgctgctctacaagcasaacaacaactgggaagccttctcagctacacttcggggcactggtccaaccccaccaaaatccctcgtttcccttagcgtggtaagacggagcctgacctgagctccaactgtcctatctttttcaaatgtttcaaacttactgcctttgttcagcagaaccacgggcacggtgatgatggtgacaagcgcagagcacccagcagtcccagaagaaccttcsacggtgtctgcaagccgagcagatcaagtccaattagagggaagcgtgtggccccagtttccgtagagggtcggggctgctccagaggcagcaggatttgcaggaaggaagactgtacacagagaataaataacttggccaagccattcagctaggaagttgtagatcctaaattaagagttcaaggtcttaatggctactctatgcggcctctcata

SEQ ID NO: 13454 - DNA, 441 bp, Homo sapiens
ttagatgatttttcctgtaaagagctaataagaatattctcgtaatttattgtacattatgattttgatatatacttagtaaagataagtaaggtacttggcccagccaggaagaggtgatacatccttagaaagctaatggtcagtcctgacaggactggggtggtgggcaggtgttgctgctccacattgccctgaactaacagtggggtctggagtgcccagcatgggggctgtttcatgtmmcctcttactgatggttttggtttgcttgtgtggaagacagttgttcggctttggtttatgttttatacaagaagagatgtgtcaattaggtaaattactggcatcttagttttcagcagttttgttttacaagaaactagcctggtaaagtataagaatgcaaaatactgggctgggcgtggtggctcatgcctg

SEQ ID NO: 13455 - DNA, 429 bp, Homo sapiens
atggctgcccacaggtctgcaggcactcggtacgccgctaacgcgaggggtagctcggtgcgtctcgcggtaccagtgcgaatcatcgggctatccaggtccgagatcctagtctcctgtcggctctgaggaggatggatccttctgcggatacatgggacctcttctcacctttaatatcattatggataaacaggttttacatttatttgggctttgctgttagcattagcctttggatttgtgtccagattgtcatcaagacgcagggcaagaacttacaggaaaaatctgttccaaaagcagctcaggatttgatgacaaatggttatgtctcccttcaagagaaagacatctttgtgtctggagtgaagattttttatggttctcagactggaacagcaaagatggagttttgttgcccagact

SEQ ID NO: 13456 - DNA, 191 bp, Homo sapiens
  misc_feature 46: n=a, g, c or t
agaccagcagaggcagcagccgagcagccgcagcctgckccctctnccgcccgcccgccctccgctctgccctccctccttccttcttgcttctaatagccctggtacatggtacacacccccccacctcctgcaattaaacagtagcatcgccaaaaaaaaaaaaaaaaaaaaaaaaaaaaaaaaaaaaa

SEQ ID NO: 13457 - DNA, 91 bp, Homo sapiens
  misc_feature 81..84: n=a, g, c or t
gaacacttccatggattgtccttggacttagggcgccctgcccgccttttgcagaggagaaaaaacttttttttttttttnnnncccccga

SEQ ID NO: 13458 - DNA, 81 bp, Homo sapiens
agaactgtctgggacagacgctgcccggatccctgcggctgcctgcactctggaccacgagctctgagagcagcaggttga

SEQ ID NO: 13459 - DNA, 341 bp, Homo sapiens
  misc_feature 265,267,269,300: n=a, g, c or t
atcttatcctctatgccaaacactgttctctttgaaaatgtcatgacctttcgttacaaaggaaacatcaacaaagaactactgctttatcacaggacttagtagccatgaaggtcctcatcctcgcctgcctggtggctcttgctcttgcaagggagaccatagaaagcctttcaagcagtgaggaatctattacagaatacaagcagaaagttgagaaggttaaacatgaggaccagcagcaaggagaggatgaacaccaggntnanatctacccctctttccagccacagcctctgntctatccattcgttgaacctatcccctatggttttcttcca

SEQ ID NO: 13460 - DNA, 433 bp, Homo sapiens
atgttgttgttctagagtttggaatatactgattatctcagacttgacatttatactgaaggatgaagtaagacctccagctttttttaaaaaaggtgttgatttggaacacctgtatgggttatggtttattaaggttatggtttagaaagttttttttccctcagagccttaacttgttaagaaggttcatttatcctgcactgaaaacaaaaactctatatactttgtttgtgtgcctcctgcactctcccattccctatgtgaatatgctctagttgatatttttaatatattgatttcttttttctcacagcaacaagtgcttactctagaggttagtgggccctgatatgtcatcagtcagatgcctgcctagccaaagctggactaagattattctgtacatttgttgatcttgatatagacttat

SEQ ID NO: 13461 - DNA, 56 bp, Homo sapiens
atraaaaaaaaaaaaaaaaaaaaaaaaaaaaaaaaaaaaaaaaaaaaaaaaaaaaa

SEQ ID NO: 13462 - DNA, 305 bp, Homo sapiens
ccttttctgggaacgtgagtatcaaccaaggctggagtgcagtggcaccatctcggctcactgcaacctctggctcccaggttcaagcgattctcctgcctcagccccctgagtagctgggattacaggcacgcgccaccactcccagggtcttactctgtgacccacgctggagtgcaatggcaccatcacgacttactgaggcctccacttcccgggctcaagtgattctcacacctcagcctcctgagtagctgagaccacagatggagttttgctcttgttgcccaggctggaaaaaaaaa

SEQ ID NO: 13463 - DNA, 370 bp, Homo sapiens
atatacagaaaactgaaactggaccccttccttacaccttatacaaaaattaactcaagatggattgaaaattaaatgaaaaacccaaaaccaaaaaaagaccctagaagaaaacctaggtgatatcattcgggacataggcatggacaaagacttcatgaagaaaatgccaaaagcaatggcaacaaaagccaaaattcacaaatgggatctaattaaactaaagagcttctgcacaacaaaagaaactatcatcagagtgaacaggtaacttagagattgggagaaaatttttgcagtctacccatctgacaaaggtgtagtgtccagagtctacaaggaacttaaacaaatttacaagacaaaaaca

SEQ ID NO: 13464 - DNA, 91 bp, Homo sapiens
  misc_feature 82..84: n=a, g, c or t
gaacacttccatggattgtccttggacttagggcgccctgcccgccttttgcagaggagaaaaaacttttttttttttttknnnyccccga

SEQ ID NO: 13465 - DNA, 263 bp, Homo sapiens
gttggmcaggmtggtctcgaactcctgacctcgtgatccgcctgcctcagctaaggagtacaagaccagcctggacaacatgataaaacccccatctttactgaaaataaaaaaaaaattagctgggggtggtggcgcacacctataatcccagccacttgggaggctgaggcatgagaatcgcttgagcctgggaggcagaggttgcagtgagctgagatcgtgtcatcgcactccagcctgggtgatagagtgagacaccc

SEQ ID NO: 13466 - DNA, 482 bp, Homo sapiens
acattctataaatttttcacgtgataattgtctttgcgtaactgggaaaaatgccgaataacttcctttattatctggaaaaattaaatttgttcatttatattttctacttactaaattgagtttttaaaaagacttagtgtgacatttgacagtgtctttcaaacgaacttctctaacaagtttatagttattttcctgtttcaacactattagaagtcttataaattatgctaattagcatggcagtcatgttacacactcttaacattgccaaagaactgttgatttcgtttgagaaaaccctgggactgtgtgtgtgtaggttttgttttgattttaacaacaaaaaatagaaataaaattagaactgcgttttaagttctaatttgcatttattaatttgtccaaaagcagaactcttggaaatcccttgaaaatataagctggaatgttttacttagccatgcaagtcatttatg

SEQ ID NO: 13467 - DNA, 459 bp, Homo sapiens
actgcacgccattagtgtattatttgattgtgtatcttcaggggttttgaaagttgttcttggagaagatatcctgtaaagttgtgctttgctttagaaaaagttaacatagaaagattttattttatttttattttgagacagagtctcgctttgttgcccaggccggaatgcagtggtgtgatctcagctcactgcaacctccacctcctgggttcaggtgattctcatgcttcagcctctccagtggctgggattacgggcgtgtgccaccatgcctggctaatttttgtatttttggtggagatgcggttttgccgtgttggccaggctggtcttgaactcctggcttcaagtgtgccgcctgcattggcctcccagggtgctgggattgcaggcgtgacactgcacccggcccaaagatttaagattgctagttgaatggccgggcatagtggc

SEQ ID NO: 13468 - DNA, 132 bp, Homo sapiens
aatagccctggtacatggtacacacccccccacctcctgcaattaaacagtagcatcgccaaaaaaaaaaaaaaaaaaaaaaaaaaaaaaataaaaaaaaaaaaaaaaaaaaaaaaaaaaaaaaaaaaaaaa

SEQ ID NO: 13469 - DNA, 69 bp, Homo sapiens
aaacaccattgcactctggcctggacaacagagagaccctgcctcaaaaaaaaaaaaaaaaaaaaaaaa

SEQ ID NO: 13470 - DNA, 428 bp, Homo sapiens
agtcgctatcggaggccgcgcgggtggctgagcagcggcctggtgcgctcgcttagcgggcgacggaatcagacggacgtggacgcccccggagtggaagccgaagcaggagttgttgttgctgaggggctgccgcagccgccgcgagcctccggacagacgccagagcgaggagggcgctacgcggtgagtgagtgtgactgagtggcccgacggggtgcggggccgctacccagaagccccagcgtgggcccggtcctcttccccgcggccaggcccctttcccgcgtccccgccacaggtcccttctgcatccctttcccggaccccgaaatctctgggcaccacgcccgcttcccacagcgccctcgtggttccctacccacaggcccttgcggtgtgtggccttttttctttttcgtttgtct

SEQ ID NO: 13471 - DNA, 426 bp, Homo sapiens
agtgactgccgggagtcctgcaggggcggggcggcgcaagcgcagggagcccggctgagtggcagcccagattgaagatggatacgtgacaatcccagggaccgctgcactgacttcatttccttagacaagacacagtgtagggcccggcccgtgttggccccaggactcctttggaatatagctgtggacaatgaatcctgcgagcgatgggggcacatcagagagcatttttgacctggactatgcatcctgggggatccgctccacgctgatggtcgctggctttgtcttctacttgggcgtctttgtggtctgccaccagctgtcctcttccctgaatgccacttaccgttctttggtggccagagagaaggtcttctgggacctggcggccacsstgcagtctttggtgttcagagcaca

SEQ ID NO: 13472 - DNA, 461 bp, Homo sapiens
tttttctcatactgccatctgtctgaatctcagcatccagaaaatattctctgctctcaaggaattatgagattagactggctcaccaagataaacacaatctgggaaacattttataatacagagggccacaccagattgaatattgcccccaggaatgaaatraaacaggaatggattctccagtaagagggtatcacagggcgtcaaactggaaaatgtggcactgcctggagtttctacctggtgaagggtggcagacttttctcttcagaggactcttgacagggtagcatccattatcttgccaatttactacaacctaggcccaatcctcagtcttataggttcagaaatttatttttatcagcatcaacagggtagctacgttgcttagaagcaaacaaaattaaccatgcttcaatagaaatcaggatatagatgtattaatacagaatgac

SEQ ID NO: 13473 - DNA, 464 bp, Homo sapiens
  misc_feature 392: n=a, g, c or t
tccgggatttctctgtaggtgaggcgggaggctggagggagctgagcccccggggaggggcccgattccgcctcgccgcgcctctggctgctgggccgtgggtttttctcttctcctgcgagtaagaaggacgacggcccctaacccctgaattagccttctatttccattagtgacttagaagctacccggcgcctcatctgggctcacctgagctaggatcaggaaggggagggggcacagtcattgcctcgcgggcgcggcgggaccccagcggacggctttgtgcggactttcggcaccgttatgcccccctagcccgacaccacctggggctggcgcgccacgttactgttcagggccagacgcaccgccctgcctgctccgggganccggacctccgatcccggggatgggggacccgagacctcagacccaacggaggggactctgatacctcagac

SEQ ID NO: 13474 - DNA, 350 bp, Homo sapiens
tttcctgcctcagccttctgctgctttgctctctgggagatccagctccttgctctgtgtcccagtagaacatgatgtggcccatgcacaccccactgctgctgctgactgggcttctttggttccatatttgcgctctttggaatgaagtgtaccaaagtcggaggctccgataaagccaaagctaaaattgcttgtttggctgggattgtattcatactgtcagggctggtgctcaatgactggatgttccctatatgcwaacaaaatcacaacggaattctttgatcctctctttgttgagcaaaagtatgaattaggagccgctctgtttattggatgggcaggag

SEQ ID NO: 13475 - DNA, 342 bp, Homo sapiens
aattatcagatagatgtctttggagcccagccttccctgtgtagtgagctggaaactcctttagattgtattcattggtgtgtatgtatatgtacatatatgtataaatagttaaatacataaacataaaacttaacatcgcattgttgtgatgacaagaagtagtaaggtgctaggtggttacattaaaaagcacagcacagtgtataatcagtcactatgactggtggttttgtaagctgggttcagtttttgaaccacccagaatacctcatgtgtaaatacagtgttcatgacttaattgaaatacagttattgtttaaaaaaaaaaaaaaagawtgt

SEQ ID NO: 13476 - DNA, 362 bp, Homo sapiens
  misc_feature 124..125: n=a, g, c or t
ctttttccctgggttccacgcgcccggtasccgaactccgaccctgaggctccgcgtcccggcccccatcgcaggggcgcctctaggaaccagaatcccgcagatgactacacagacaagatcnncccccaagttcggcgagccgggcgcccaccgcgccccagcccacgcccccggagttcctgcgccacccacagcggccctgagcttcaatctgcactttcaaaacttcccagttgcctccagagccctgcagttgaagatcttgtctagcacatggttttgctgttttcctcagcccgaactccctccttggagggccatcgttctctgtctcagattccaccctccttatcacacaa

SEQ ID NO: 13477 - DNA, 162 bp, Homo sapiens
caaacagtttgcccccaggaaatttgaggaactccctgaaaagagatgcacaaactattaaaacaattcaccagcaacgagtccttcctatagaacaatcactgagcactctataccaaagcgtcaagatacttcaacgcacagggaatgggattgtttgga

SEQ ID NO: 13478 - DNA, 447 bp, Homo sapiens
tcactataggaaagcaaggaaggagaatctacagagctaatcaaattataaaagagtgatgtgaaattcaaactggaagattttgtgcttgagtcttgcttatttatctgtattttagttcatccatgaaactaacaaagataatgtgttttaaagcaattgtaagtggctatttcaagccatcttacaagagtttttagaggataatttttatattttagatctgactatattgtgatgtcagtgcctgtttttcttttttttgtgtcagacatagcttcatgtatgttcatgatagagtttaattcaacaaatatttgttgaactctgcarwtctgtacaagaagctctgtaacaacagataaaattgggctgggcgcagtggctcacgcctgtaatcccagcactttgggaggcccgaggcaggcagatcatgaggtcaggaga

SEQ ID NO: 13479 - DNA, 202 bp, Homo sapiens
cattctttttaaacattagattcccgacttaaggtgacacagttataatatttacagtatcatgttgtattaaatgagatggcccatttgtaatatatgagataacctgatacaactcagaattaaatgtacaactgaaaggtttagcattctagtcctgagccatccaaattcgctcagtgacacaggtcagatcacttat

SEQ ID NO: 13480 - DNA, 63 bp, Homo sapiens
ataaaaaaaaaaaaaaaaaaaaaaaaaaaaaaaaaaaaaaaaaaaaaaaaaaaaaaaaaaaaa

SEQ ID NO: 13481 - DNA, 495 bp, Homo sapiens
catgagtataggtccatgtttggaccatagccacactgcttgtcagctcatcgagaaaagtcaggtttcacaaaagttgcttaacagcttggagaaatcttcgggataatagatcatgttttgatcttctgcagatccagtgaacaggggtgttaagagcagagagtattatgttccctatgattaaaccttttctgagttatcctacttgctatcctaagttactacttgtgaggcaggctatgtgcttttgtttaactgttcaaaggtttggatagtgttggcttttcatgtaaagatgtcaggaatgatatgaagatttttattgttttggtctcaaggttaaattctaaattaatgatatattttatggtagaaaaacttcatttccagcctaaaaagctaatgctgattcattcattttttcttttgaaacaatgaatgttacttaatcttttaggctgacatcagggrtagccttttgtgaacwttctc

SEQ ID NO: 13482 - DNA, 466 bp, Homo sapiens
ttgaaccaccttattttaaaatttttaacttttatataccacttgtgtgattccagtgtcatgtcttgggtttgatgtcgttggacagaaaagtgtatcaattattttaaatgaatttttccccatgtttgaggcttagtctgtaaatgtgttgctgtaacagaaaatacttgggtatgcattacttgaatacttgaaaactgaaattaataagatgtattacataatgaattagatttctctgaacagtttttacactgaaaatcttcatttctggattgcagtttgaaatggaatgaagacctgaattatttgggtagaaaaaattatgatagtgcttataagaactgtaaactgttttaaactattttgtgtttgacgcatcaaacttcaagttttttgtaagtttctctcctgaaattttctttctcttctatactttatgcacttactatactactgatgt

SEQ ID NO: 13483 - DNA, 295 bp, Homo sapiens
aatgagctctcgccagactcgaacttgcccgtgcagctcctcaccatccgtgtggccagcaccaaccctgctgtgcrcctttgacatctgaggggcccagcagctctcctccctgcaggctgaactccactgagtacggggagctctgcrgaagctccgggcacccatccgcaggcagcccatgtggtcatccaccagagcctgggcgacctgttcctggagacatttgcctccctggtagaggtcaacccggcctactcagtgcccagcagccaggagctggaggcctgcatag

SEQ ID NO: 13484 - DNA, 374 bp, Homo sapiens
aagacttgtccagatcacaggtgcgctgctatgtccacatcatgaaagaggggctctgctctcgagtggagcacactgggactctacatggaagcaaacagacaggtgcccaaattgctgtctgctctctgtccagaagaaccaccagtccattcgtcagcccagattgtcagcaaacacctggttggagttgacaggcctcattgggccagagacacagattggagagaagtcatccattaagcgstcagkcattgggctcatcctgkctcataaaagatagagkgactattaccaattgcttctcatgaactcagtcactgtggaggaaggaagcaatrtccaaggcagtgkcatctgcaacaatgctgtgr

SEQ ID NO: 13485 - DNA, 478 bp, Homo sapiens
tcattttcattgtcatgttgtatcccattctgtgaatatgctgcaatataawttatccattctactgtttgtagacatttgggttgtttgcagcttgggctattaggaattgtgttgctgtgtattggttaacatatgtatgtattcctgttaggtatgtacctaagtgtatccatatgttcagctatatgttataaaaccagttttcaagtggttgtaccaatgtacactcccaccaacccagtatgcgagttctagtgctccacatacttgccaacatttggcattttccatcttttktactatagccattagtggtgggcatatagtgatatgtcagttttagttttcggttttattttcttgtcctccaaaccattgtagtatctccccaggatagatgagtgatggctgagacctgagacctaggcctgtdcctcacatgactgcaccattttacattctatcaatgtatgag

SEQ ID NO: 13486 - DNA, 370 bp, Homo sapiens
caaactctcttatgccctggcaagccaatgaggataccctttgacaaaccctgtggataaaatgataatatcaaggtcaggcatggtggctcacacctgtaatcccagcactttgggaggctgaggcgggtggatctgctgaagtcagaagtttgagaccagccttgccaacacaatgaaaccctgtctctactaaaaataaaaaaattagccgggcgcasagtgcacgcctgtaatccctgctactcgggaggctgaaacaggagaatcacttgaacccaggagacggaggttgcggtgagttgagattatgccactgtactccagcctgggtgacagagcgagactcagtctcaaaaaaaaaaaaaaa

SEQ ID NO: 13487 - DNA, 170 bp, Homo sapiens; identical to SEQ ID NO: 11644

SEQ ID NO: 13488 - DNA, 200 bp, Homo sapiens; identical to SEQ ID NO: 11569

SEQ ID NO: 13489 - DNA, 83 bp, Homo sapiens
aaacctaacttgcgcagaaaacaagatgagattggcatggctttatttgttttttttgttttgttttggtttttttttttttt

SEQ ID NO: 13490 - DNA, 200 bp, Homo sapiens; identical to SEQ ID NO: 11569

SEQ ID NO: 13491 - DNA, 482 bp, Homo sapiens
ccttacatattttaagtttggcctaaaggtttctctgtacagtgtgaactataacctaaatgtagttgtaaacagactgtagcctcctcttgtgccaaccaccaagtcttggccaatcaaaggtggccagctgttcaaaccgtgttcaaataaagcacaagccaagccgtaaccaatctggctgtttctgtacctcacttccattttctgtactgtcactttcctttttctgtccataaatcttcttccgccacgtggctgcactggagtctctgagcctactctggctcaggaggctgccggatttgcgaatccttctttgctcagttaaactttgttaaacttaatttggctaaagtttttcttttaatgttggccatcatgaaaccaataaaatctgctgagaacctaacaactagatttctttttgcctttttctgttttgtttgtctttcttttttgatctattttgtcttttctcc

SEQ ID NO: 13492 - DNA, 66 bp, Homo sapiens
attttttagacctctcccagtccttcggdactcggtctggtttatactaggtcgcgctaggggcag

SEQ ID NO: 13493 - DNA, 87 bp, Homo sapiens; identical to SEQ ID NO: 11618

SEQ ID NO: 13494 - DNA, 313 bp, Homo sapiens
  misc_feature 312..313: n=a, g, c or t
caaacagatataacactagggccgagtgaggtggctcatgcctgtaatcccaacactttgggaggctgaggacggtgtattgcttgagcccaggagttcgtgccaggtttggcaacatggccatctctataaaaaatacaaacattgaccaggtgtggtggcatgggcctgtggtcccagatacttgggaagctgaggtaggaagatcgcttgggcccaggagatgtaggttgcagtgagttgttatcacaccactgcactcctgcctgggtgacagagcaagagcctgtcgccaaaaaaaaaaaaaaaaann

SEQ ID NO: 13495 - DNA, 254 bp, Homo sapiens
tttggggggccgaggtgggcggatcacggggtcaggagattgaccatcccggctggcacggtgagaccccatctctactaaaaatacaaaaaagttggccgggcatggtggcgggtgcctgtagtcccagctactcgggaggctgaggcaggagaatggtgtgaactggggggtggaggttgcagtgagccgagatcgtgccacagcgctccagcctgggtgaaagaccgagactccatcccaaaaagaaaaaa

SEQ ID NO: 13496 - DNA, 312 bp, Homo sapiens
tatacatatataatattatatatatttggtctgtttgtagttttattactagatgattttttcggttgtccttaacaccccttcctgaggttcccttcacccctctctcttgccttccttccctttccctttcttcctgactagccccaagtcccttcatttgcatctgctatgcaatagtccctctcctttccttcttcttccctcagatttagctgatccttcctcccaccctggccttcctttcctctttcctcctcactctccccgtcatgctccctctgcsccgcccccagaaaaaaaaaaaaaagg

SEQ ID NO: 13497 - DNA, 72 bp, Homo sapiens
tatattgtttcccaagaagttctacttggtttcatttcaaacctgcctggtttttttgtttgtttgttttta

SEQ ID NO: 13498 - DNA, 50 bp, Homo sapiens; identical to SEQ ID NO: 12165

SEQ ID NO: 13499 - DNA, 82 bp, Homo sapiens; identical to SEQ ID NO: 11689

SEQ ID NO: 13500 - DNA, 200 bp, Homo sapiens; identical to SEQ ID NO: 11569

SEQ ID NO: 13501 - DNA, 354 bp, Homo sapiens
aaggatgtcaaaatgaaaatggtaccataaatagccaacgttgattaaaattaaacatgattactttaacaaaaagaaacttaaggccaggtatggtgggtcatgcctgtaatcctascactttgggaggctgaagtggaaggatcacttgagcccaggagttcaagaccagcctggagaacacagagagacccccaccatctcttccaaaaataaaaactagccaggcatggtggctcaggcctgtagtcccagctacttgggaggctgaggtgggagaattgcttgagcccaggagtctgaaactgcggtaagccatgatctcactactgcactccagcctgggcaagagta

SEQ ID NO: 13502 - DNA, 329 bp, Homo sapiens
atttttggattttctttaaaaatgcacattccaggctgggcgcagtggctcacgtgtgtaatcccagtactttgggaggctgagggcggatcacaaagccaggagttcaagaccaacctgggcaatatggtgaaaccccatctctactaaaaatataaaaagttagccaggtatggtggcacaagcctgtagtcccagccacttgggaggctgaggcagaagaatcacttgaacccgggaggcggaggttgcagtgagccgagatcgtgccactgcactcaagcctaggcaacagagtaagactctgtctcgaaaaaaaaaaaaaaaaa

SEQ ID NO: 13503 - DNA, 321 bp, Homo sapiens
taatcatttttaggccgggtgcagtggctcatgcctgtaatcccagcactttgggaggctgagacaggtggatcacttgaggtcaggagtttgagacctgcctggccaacatgatgaaaccctgtctctactaaaaatgcaaaaaaaattagccaggcatggtggcatgtgcctgtagtcccaactactcaggaggctgaggcaggagaatcacttgaacctgggaggcagaggttgcaatgagctgagatcgcaacactgcactccagcctgggcgacagagcaagactccatctcaaagaacaaaaaaaaaaaaaaaaa

SEQ ID NO: 13504 - DNA, 201 bp, Homo sapiens
actctacccaggcgtaaatagagctccctactccagaccacctgccacccacctcccaagttgagaacacaagctccagctgggctgagagtcaggcttggtgcagggtgactttggcgaagttttgtcagatccataaagcaaactggaatttgagctttcacttaccctagtatacgttcttaaaaaaaaaaaaaaaaa

SEQ ID NO: 13505 - DNA, 481 bp, Homo sapiens
aaccttaaatagatgtaatttctatttgtcaatgatgcctcagcaaagctagggagaaaataaaaaggatccttctgtgcaacrcccgcatgtccattaccgatgactggataaagaaaacgtgctccacccatgcagtggaatactacgcagccataaaacggaatgaagctcggatccaagctagaacgtaggtgagccttggaaacgtggcgctgagtgagagaagctggacacaaaataaggccaggaatggtggctcacagccgtaatcccagcactttacgaggccaagatgggcagatcacttgagtccaggagtttgaggccagcctgggcaacatgacgaaatcctgcctctacaaaaaatacaaaagttagccaggagttcatttagaggagtcatgtgactatagtcccagctactcaggaggctgagatgggagaatcacttgagcctggggaggtggaggttacagtg

SEQ ID NO: 13506 - DNA, 154 bp, Homo sapiens
ttaagtttggaatttgcctaaggcagaagttataaggcttcataaccttttgtatgtattgccaatatttgaaacttgggagattacgtataaaaaatacctagttttctgggtggaggatggggcatgctgtcatctcaagtctgctgcggct

SEQ ID NO: 13507 - DNA, 138 bp, Homo sapiens
aggtagctgcgaggaaacttttgcagcggctgggtagcagcacgtctcttgctcctcagggccactgccaggcttgccgagtcctgggactgctctcgctccggctgccactctcccgcgctctcctagctccctgcg

SEQ ID NO: 13508 - DNA, 330 bp, Homo sapiens
atagctggtgtctctatttaaaaaaggatcttttggccaggcacagtggctcacacctgtaatcccagcactttgggaggccaaagtggatgaatcacttaatttcaggagtttgagaccagcctggccaacatagtgaagccccatctctactaaaaatgcacaaaaaattagccaggtgtggtggcggatgctgtaattccagctactccagaagctgaggcaggagaatcactggagcctgggagagtgaggttgcagtgagctgagattgcatcattgtactccaacctgggtgacaagagcaagactctatctcaaaaaaaaaaa

SEQ ID NO: 13509 - DNA, 336 bp, Homo sapiens
cctaactaaaggagcaatttctttggaattacttctctgtaatagaaattcttggctggtggagtggctcatgcatgtaattccagcactttgggaggctaaagtgggaggatcacttgagccctggagtttgagatcaccctgagcaacatagaccctgactctacaaaaaattagcctggtgtgctggtgcgtacttgtagtcccagctgctaaggaggttgaggtgggaggattgcttgagccggaaaggttaaggccataatgagccatgatggcaccactgcactccagcctgggcgtcagagcgaaactgtccacaaaaaaaaaaaaaaa

SEQ ID NO: 13510 - DNA, 383 bp, Homo sapiens
gtgagccgagatcttgccactgcactccagccagggtgatggagtgagactctcagaaaaaaattagtgccaggcacaggggctcacacctataatccccgcactttggcaggccaggtgggcaaattgcttgagcccaggagttcgagaccagcctgggcaacatggcgaaaccctgtctaacaaaaaaaatacaaaagttagccaggagtggtggcacaagcctgtagtccctgctgctagggagactgtagtgggaggatcacttcagcctgggagaccaaggctgcagtgagtcatgagtgtgccattgcaccccagtgtgggccacagagcgagaccttgtctccaaaaaaaaaaaaacccaaaaaraaaaaaaaaar

SEQ ID NO: 13511 - DNA, 112 bp, Homo sapiens
ctaaaaattagccaggcctggtggcaggtgactgtaatgccagctactcgggaggctgaggtaagagaattgcttgaacctgggtggaagaagttgcagtgagccaagattg

SEQ ID NO: 13512 - DNA, 293 bp, Homo sapiens
  misc_feature 18..19: n=a, g, c or t
catctttgggccgggcknngtggctcacgcctgtaatcccagcactttgggaggccgaggcgggcggatcacgaggtcaggagatggagaccatcctggctaacacggtgaaacccgtctctactaaaaatacaaaaaattagccgggcgtggttgcgggcgcctgtagtcccagctactcaggaggctgaggcaggagaatggcgtgaacccgggaggcggasttgcagtgagccgagatcgcgccactgcactccagcctgggccacagagcgagactccgtctcaaaaaa

SEQ ID NO: 13513 - DNA, 495 bp, Homo sapiens
aaaggtagaaacagctgatcacaatggttcactcctgtaatcccaacactttgggaggtcgaagtgggaggattgcttgagcacaggagttcaagaccagcctggacaacatagtgagacatggtctctgcaaaaaaatagaaaaatcagcagggtgtggtggcatgcacgtatactcccagctactcaggaagttgagtgagaggattgcctgagcccaggagtacaagactgctgtgagctatgatcatgccactatactccagcctgcgcaacagagagaccctgtctggaggggtggggggagaaaaaaacaccatagaaacaacccaaatgtccaataacaaattgtagtccatccatacaatggactactactcagccatgaaaaggaatacagcactcacatatgctgcatgtgaatgaaccctggaagcattatgctcagtgtaagaacccagacataaaaggtcacacattttatgattccaccta

SEQ ID NO: 13514 - DNA, 483 bp, Homo sapiens
  misc_feature 98,480: n=a, g, c or t
cataggaagtttaggtaaggcaggagaaagtgttccaggtagagggaacagcatatgcagaagccaggaaggaggtgagatcatagcgtatgtttggnaacagaaagaagtaataggcctgagtggatgggagagaggggaacgctggagaagaggacttgggcttggggggcatgaggaggtcaccatttgtactacacccagtacagatgtccactgaggggcccattgccactcccctccccaggtccctgaagacttcatctcccgagagctgtttgacacagtccaagtgtacatcatcaccaagccagagctgcagaacaagctaatcactgtcacagctatggaaaagaagctgatcggctgtcctgtgtgcatcgaacacaagaagtacagccgcaatgctctcctcttcaacctgggcttcgtgtgtgatgcccaggccaagacctgcgccctcgagcccattgttaaaangct

SEQ ID NO: 13515 - DNA, 337 bp, Homo sapiens
  misc_feature 120,129,228,276: n=a, g, c or t
tcaagaaaaaaaatttttttttttttggaagaatttgaaagctgctgatccagagtcattcctttaagaaaatgggccgggcatggtggctcacacctgtaatcctggmacttcgggarnccagggcanatggatcagttgagctcaggawtgtgagacmagcctgggcaatgtggcaaaaccccgcctctacaaaaaatacaaaaactaggtgggsatggtggcatncgcctktagtcccagstactgggraggccgaggtgggaggatggcttnagcccggaaggcaraggttgtagtgagctgagattgcagsactgsactccagcstgggcaa

SEQ ID NO: 13516 - DNA, 267 bp, Homo sapiens
atttttgtgacsagcctaggcgacatagtgagacctgtctctacaaaaaatatataattagctgggcgtggtggcgcgcgcctgtggtccaagcttctccggagctgaggtcgggggatcgcctgagccctggaggtcgttgctgcattgagccgtgaacgcaccactgcattccagcctgggcaacagagcgaactctatctcaaaacaaaacaaaacaaaacaagaaaaagaaaaaaagaagaaaattaaaaaaaaaaaaaaaaa

SEQ ID NO: 13517 - DNA, 207 bp, Homo sapiens
tgtttaatgccatttattttttaagatgggatatatattttaattagctgggcgtcgtggcgggtgcctgtggtcccagctactcaggaggctgaggcaggggaatgccgtgaacccggagcagagcttgcagtgaaccgagatcacaccactgcactccagcctgggcgaccgagtgagactccatcgcaaaaaaaaaaaaaaaaa

SEQ ID NO: 13518 - DNA, 378 bp, Homo sapiens
aaggatgtcaaaatgaaaatggtaccataaatagccaacgttgattaaaattaaacatgattactttaacaaaaagaaacttaaggccaggtatggtgggtcatgcctgtaatcctagcactttgggaggctgaagtggaaggatcacttgagcccaggagttcaagaccagcctggagaacacagagagacccccaccatctcttccaaaaataaaaactagccaggcatggtggctcaggcctgtagtcccagctacttgggaggctgaggtgggagaattgcttgagcccaggagtctgaaactgcggtaagccatgatctcactactgcactccagcctgggcaagagtaagaccctgtatcaaaaaaaaaaaa

SEQ ID NO: 13519 - DNA, 372 bp, Homo sapiens
aaggatgtcaaaatgaaaatggtaccataaatagccaacgttgattaaaattaaacatgattactttaacaaaaagaaacttaaggccaggtatggtgggtcatgcctgtaatcctagcactttgggaggctgaagtggaaggatcacttgagcccaggagttcaagaccagcctggagaacacagagagacccccaccatctcttccaaaaataaaaactagccaggcatggtggctcaggcctgtagtcccagctacttgggaggctgaggtgggagaattgcttgagcccaggagtctgaaactgcggtaagccatgatctcactactgcactccagcctgggcaagagtaagaccctgtatcaaaaaa

SEQ ID NO: 13520 - DNA, 271 bp, Homo sapiens
  misc_feature 261: n=a, g, c or t
aatgactagtgttctgttatggaaaaaataagaaacatggacatttccaggttgccctagctctgctcttcatagctgttcgggtcctattactttaccaccataagatatcacaagaggccaggcaggatgtctcacacctgtaatctcagcactttgggaggctgaggcgggcagatcacgaggtcaagatttcaggaccatcctggccaatatggtgaaacccgtctctactaaaaatacaaaaaaaaaaaaaaaaansggcacgaga

SEQ ID NO: 13521 - DNA, 144 bp, Homo sapiens
ctttaggtgtattaagatataaggccaggctgggcatggtggctcatgctgtaatcccagcactttgagtggctgaggtgggaggatcacttgagcccaggatttcaaggcgagcctgggacacatggtgaaaccctgtctctg

SEQ ID NO: 13522 - DNA, 225 bp, Homo sapiens; identical to SEQ ID NO: 11617

SEQ ID NO: 13523 - DNA, 247 bp, Homo sapiens
atacaattagccaggtgtggcggcgtaatcccagctggcctgtaatcccagctacttgggaggctgaggcagaactgcttgaacccaggaggtggaggttgcagtgagccgtcatcgcgccactgagccaagatcgcgccactgcactccagcctgggcgacagagccagactgtctcaaataaataaatatgagataatgcagtcgggagaagggagggagagaattttattaaatgtgacgaact

SEQ ID NO: 13524 - DNA, 119 bp, Homo sapiens
ctttaggtgtattaagatataaggccaggctgggcatggtggctcatgctgtaatcccagcactttgagtggctgaggtgggaggatcacttgagcccaggatttcaaggcgagcttgg

SEQ ID NO: 13525 - DNA, 243 bp, Homo sapiens; identical to SEQ ID NO: 12213

SEQ ID NO: 13526 - DNA, 82 bp, Homo sapiens; identical to SEQ ID NO: 11689

SEQ ID NO: 13527 - DNA, 310 bp, Homo sapiens
tatacatatataatattatatatatttggtctgtttgtagttttattactagatgatttttccggttgtccttaacaccccttcctgaggttcccttcacccctctctcttgccttccttccctttccctttcttcctgactagccccaagtcccttcatttgcatctgctatgcaatagtccctctcctttccttcttcttccctcagatttagctgatccttcctcccaccctggccttcctttcctctttcctcctcactctccccgtcatgctccctctgccccgcccccaaaaaaaaaaaaaaaa

SEQ ID NO: 13528 - DNA, 200 bp, Homo sapiens; identical to SEQ ID NO: 11569

SEQ ID NO: 13529 - DNA, 170 bp, Homo sapiens; identical to SEQ ID NO: 11644

SEQ ID NO: 13530 - DNA, 337 bp, Homo sapiens
cctaactaaaggagcaatttctttggaattacttctctgtaatagaaattcttggctggtggagtggctcatgcatgtaattccagcactttgggaggctaaagtgggaggatcacttgagccctggagtttgagatcaccctgagcaacatagaccctgactctacaaaaaattagcctggtgtgctggtgcgtacttgtagtcccagctgctaaggaggttgaggtgggaggattgcttgagccggaaaggttaaggccataatgagccatgatggcaccactgcactccagcctgggcgtcagagcgaaactgtccaaaaaaaaaaaaaaaaag

SEQ ID NO: 13531 - DNA, 63 bp, Homo sapiens
gcaggttcgctttccggcggttgcaccgggccggggtgccagcgcccgccttcccgtaaccac

SEQ ID NO: 13532 - DNA, 133 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacacatggtgaa

SEQ ID NO: 13533 - DNA, 97 bp, Homo sapiens
ccttctccccggcggttaagtgctgagagtgcggagtgtgtgctccgggctcggaacacacatttattattaaaaaatccaaaaaaaaaaaaaaaaa

SEQ ID NO: 13534 - DNA, 115 bp, Homo sapiens
ctttaggtgtattaagatataaggccaggctgggcatggtggctcatgcctgtaatcccagcactttgagtggctgaggtgggaggatcacttgagcccaggattccaaggcgag

SEQ ID NO: 13535 - DNA, 374 bp, Homo sapiens
gtgagccgagatcttgccactgcactccagccagggtgatggagtgagactctcagaaaaaaattagtgccaggcacaggggctcacacctataatccccgcactttggcaggccaggtgggcaaattgcttgagcccaggagttcgagascagcctgggcaacatggcgaaaccctgtctaacaaaaaaaatacaaaagttagccaggagtggtggcacaagcctgtagtccctgctgctagggagactgtagtgggaggatcacttcagcctgggagaccaaggctgcagtgagtcatgagtgtgccattgcaccccagtgtgggccacagagcgagaccttgtctccaaaaaaaaaaaarcccaaaaraaa

SEQ ID NO: 13536 - DNA, 254 bp, Homo sapiens
  misc_feature 237: n=a, g, c or t
ccgaggtgggtgtatcacctgaggtcaggagtttgagaccagcctggacaacatggtaaaaccccgtctctgctaaaaatacaagagttagctgggcgtggtggcaggcacctgtggtcccagctactcgggaggctgaggcaggagaattgcttgagcccaggaggcagaggttgcagtgagccaagatcatgcccctgcactccagcctaggcgacagagctagactctgtctcnaaaaaaaaaaaaaaaaa

SEQ ID NO: 13537 - DNA, 344 bp, Homo sapiens
taaatgatatcgtttggatgtttgtaccctccaaatctcatgttgaaatgtgatcttcaatcttggaggtggagcctaatgggaaatgtttggatcatgggggcagatcctttataaatggattggtgccttcccagcagtaaatgtgagtgagttctagctctcctacttcatgcaacagctggttgtttaaagagcttggcaccccctcttctctctcttgatcactctcttcaccttgtgacacccctgctctccttttgccttctaccaccattgtaagcttcctgaggccctcatcagaagcagatgctggtgccatgccttttttttttttttttttt

SEQ ID NO: 13538 - DNA, 200 bp, Homo sapiens; identical to SEQ ID NO: 11569

SEQ ID NO: 13539 - DNA, 112 bp, Homo sapiens; identical to SEQ ID NO: 11643

SEQ ID NO: 13540 - DNA, 354 bp, Homo sapiens
tattttattataaatcaggacctttcgtggaactgtattgaaattaattatcctgggcctggcgcggtggctcatgcctgtaatcccagcgctttgggaggccaaggtgggcggatcatgaggtcaagagatcgagaccatcctggctagcacggtgaaacccgtctctactaaaaaatacaaaaaaaattagctgggcatggtggtggtgcctgtggtcccggctactcgggaggctgaggcaggagaatggcgtgaacgtgagaggtggagcttgcagtgagctgagatcgcgctactgcattccagcctgggcaaacagcaagactctgtctccaaaaaaaaaaaaaaaaa

SEQ ID NO: 13541 - DNA, 309 bp, Homo sapiens
aatggtagagacaggktttcaccatgttggccaagctggtctcaaactcctgacctcatgcctgtaatcccagcagtttgggaggccaaggcgggtggatcacctgagatcaggagttcaagaccagcctggccaacatggcgaaaccccattctactaaaaatacaaaaaattagccgggcatggtggtgggtactgtagtcccagctacttgggaggctgaggcaggagaatagcttggacccaggaggtggaggttgcagtgagcccagatcacgcaaatgtcactgtactccagcctgggtggca

SEQ ID NO: 13542 - DNA, 348 bp, Homo sapiens
  misc_feature 331,333: n=a, g, c or t
catataacctttaaaaaataccatacatatttatgaatgcaatrttaaaaccagctataggagtacggctggcgtggtggctcatgcctgcaatctcagcactttgggaggcagaggcgggcggatcactcgaggtcaggagttcaggaccagcctggccaacatggtgaaacctgtctctactggggatacaaaaagtagctgggcatggtggccgcacgcctgtaatcccagctacttgggaggctgaggcaggagaatcgcttgaaccccggagcggaggttgcggtgagcggagattgcgccactgcactccggcctgtgtaacagnantgagactctgtctca

SEQ ID NO: 13543 - DNA, 361 bp, Homo sapiens; identical to SEQ ID NO: 11695

SEQ ID NO: 13544 - DNA, 161 bp, Homo sapiens
ctttaggtgtattaagatataaggccaggctgggcatggtggctcatgctgtaatcccagcactttgagtggctgaggtgggaggatcacttgagcccaggattccaaggcgagcctgggacacatggtgaamcctgtctctgcaaaaaaaaaaaaaaaaa

SEQ ID NO: 13545 - DNA, 200 bp, Homo sapiens; identical to SEQ ID NO: 11569

SEQ ID NO: 13546 - DNA, 449 bp, Homo sapiens
acgcaaagcccggagcgcgcgcgaccggcggctctttggcgcggattagggggtctcggcgagggagtcatcaagctttggtgtatgtgttggccggttctgaagtcttgaagaagctctgctgaggaagaccaaagcagcactcgttgccaattagggaatggaccgtttgggttcctttagcaatgatccctctgataagccaccttgccgaggctgctcctcctacctcatggagccttatatcaagtgtgctgaatgtgggccacctccttttttcctctgcttgcagacttcagattttcctgtccttgatcccagctggactgctcaagaagaaatggcccttttagaagctgatggactgtggctttggaaattggcaggatgtagccaatcaaatgtgcaccaagaccaaggaggagtgtgagaagcactatatgaagcat

SEQ ID NO: 13547 - DNA, 129 bp, Homo sapiens; identical to SEQ ID NO: 11756

SEQ ID NO: 13548 - DNA, 232 bp, Homo sapiens
gacaggaagagaaggaaaaaagagaaggcgctgtcccgctcttgctacggtggcctggaggagtggcgaaaccggaacagagaatttatcacttctgggactcacagtcgtgatgtctttcaagagggaaggagacgattggagtcaactcaatgtgctcaaaaaaagaagagtcggggacctcctagccagttacattccagaggatgaggcgctgatgcttcgggatgga

SEQ ID NO: 13549 - DNA, 134 bp, Homo sapiens; identical to SEQ ID NO: 12228

SEQ ID NO: 13550 - DNA, 170 bp, Homo sapiens; identical to SEQ ID NO: 11644

SEQ ID NO: 13551 - DNA, 225 bp, Homo sapiens; identical to SEQ ID NO: 11617

SEQ ID NO: 13552 - DNA, 97 bp, Homo sapiens
tacaaaaaattagctgggcgtggtggcaggcgcctgtggtcccagctactcgggaggctgaggcaggagaatagtgtgaacccaggaggcggasttg

SEQ ID NO: 13553 - DNA, 162 bp, Homo sapiens; identical to SEQ ID NO: 12335

SEQ ID NO: 13554 - DNA, 78 bp, Homo sapiens; identical to SEQ ID NO: 11631

SEQ ID NO: 13555 - DNA, 338 bp, Homo sapiens
  misc_feature 14,16: n=a, g, c or t
aatggtagagacangntttcaccatgttggccaagctggtctcaaactcctgacctcatgcctgtaatcccagcagtttgggaggccaaggcgggtggatcacctgagatcaggagttcaagaccagcctggccaacatggcgaaaccccattctactaaaaatacaaaaaattagccgggcatggtggtgggtacctgtagtcccagctacttgggaggctgaggcaggagaatagcttggacccaggaggtggaggttgcagtgagcccagatcacgcaaatgtcactgtactccagcctgggtggcagggtgagaatccatctcaaaaaacaaaa

SEQ ID NO: 13556 - DNA, 446 bp, Homo sapiens
ctcttcgcttgcagatacccccgagatcggtaattctaagggctcctaaagaatgaagtctgagcgtagatcgggggacgcccgctgtactgtatccagccatgccgcgtttatacaaatagcagtgaagttagaactgtgtagaacgaatctttgcaaaaggaatcggagtataaattgaggcggtgagacttggttccttaagcttgccaaactcccaaagattcgagctacagaaagacccccctggctgctgaaaggagttgggagaggcttaggtaaataacaaggcaggcttattgggaatatacaccggctgtgtctgtaagtgcacaatcacattacataattacgttagggccgggcgcggcggctcgcgctgtaaccccggcacttcgggaggcccaggggggcggatcacttgagctcggttggagaccagcctg

SEQ ID NO: 13557 - DNA, 419 bp, Homo sapiens
gttattttgcgtgaattggtgaggacattaagtccgggtagaaagaaatgtcaggagtagaggtgaagactttaaagaaatacgttgttaaatgctgaatctttgcttgtttgggtgtgttttgtwrwwgtttgtttttgtttttgagacggagtttcgctttcgatgcccaggctggagtgcagtggcgcgatctcggctcaccgcaacctcasyctcccgggttcaagcgattctgctgcctcagcccctcgagtmgctgggattacaggcatgcaccaccacgcccggctaattytgtatttytagtmsagttggggtttctccatgttggtcagggtggtctcaaactcccgacctcaggygatccacctgyttgggcctcccaaggtgctgggattacaggcgtgagccactgs

SEQ ID NO: 13558 - DNA, 125 bp, Homo sapiens; identical to SEQ ID NO: 12173

SEQ ID NO: 13559 - DNA, 129 bp, Homo sapiens
tttaaatataaataaatgaaaataatacttctccctgatcataaagaaaatcacattcttasaggccgggcatggtggctcatgcctgtggtcccagcactttggaaggtcgaagtgggtggrtcatka

SEQ ID NO: 13560 - DNA, 380 bp, Homo sapiens
aaggatgtcaaaatgaaaatggtaccataaatagccaacgttgattaaaattaaacatgattactttaacaaaaagaaacttaaggccaggtatggtgggtcatgcctgtaatcctagcactttgggaggctgaagtggaaggatcacttgagcccaggagttcaagaccagcctggagaacacagagagacccccaccatctcttccaaaaataaaaactagccaggcatggtggctcaggcctgtagtcccagctacttgggaggctgaggtgggagaattgcttgagcccaggagtctgaaactgcggtaagccatgatctcactactgcactccagcctgggcaagagtaagaccctgtatcaaaaaaaaaaaaaa

SEQ ID NO: 13561 - DNA, 285 bp, Homo sapiens
aaaaagtccctgggaagckgccgggcgcggtggstcacccctgtaatcccagsagtttrggakgccgakgcgggtgcatcatctaaggtcaagagttcgagacaagtctggccaagatggtgaaaccccgtctctacgaaaaatacaaaaattagccgggcgtggtggcccatgcctgwaatctcagttactcgggaggctgagacaggrgaattgcttgaacccgggaggcggaggttgmagtgacccgagatctcgccaccgcastccagcctgggcgacaga

SEQ ID NO: 13562 - DNA, 83 bp, Homo sapiens; identical to SEQ ID NO: 13489

SEQ ID NO: 13563 - DNA, 383 bp, Homo sapiens; identical to SEQ ID NO: 12067

SEQ ID NO: 13564 - DNA, 310 bp, Homo sapiens
tatacatatataatattatatatatttggtctgtttgtagttttattactagatgatttttccggttgtccttaacaccccttcctgaggttcccttcacccctctctcttgccttccttccctttccctttcttcctgactagccccaagtcccttcatttgcatctgctatgcaatagtccctctcctttccttcttcttccctcagatttagctgatccttcctcccatcctggccttcctttcctctttcctcctcactctccccgtcatgctcsctctgcsccgcscccaaaaaaaaaaaaaaaa

SEQ ID NO: 13565 - DNA, 203 bp, Homo sapiens; identical to SEQ ID NO: 12721

SEQ ID NO: 13566 - DNA, 93 bp, Homo sapiens
ctttaggtgtattaagatataaggccaggctgggcatggtggctcatgctgtaatcccagcactttgagtggctgaggtgggaggatcacttg

SEQ ID NO: 13567 - DNA, 119 bp, Homo sapiens
ctttaggtgtattaagatataaggccaggctgggcatggtggctcatgcctgtaatcccagcactttgagtggctgaggtgggaggatcacttgagcccaggatttcaaggcgagcctg

SEQ ID NO: 13568 - DNA, 297 bp, Homo sapiens
cagataaaagtctatgtcctggcgcagtggctcgtgcctgtaatcctggcattttgggaggctgaggtgggcggattatttgaggccaggagctggagatcaacttagccaacatggtgaaatctcatctctactaaaaacacagaagttacctgggtgtggcgacacgcatctgtaatcccagctactagggaggctaaggcaggaaaatcacttgaacctgggaggtggaggttgcagtgagccaagatcccaccactgcacttcagcctgggtgacagagcgagactctgtctc

SEQ ID NO: 13569 - DNA, 156 bp, Homo sapiens
tacaaaaaattagctgggcgtggtggcaggcgctgtggtcccagctactcgggaggctgaggcaggagaatagtgtgaacccaggaggcggasttgcagtgagccaagatagtgccactgcacttcagcctgggtgacagagtgagactctgtcac

SEQ ID NO: 13570 - DNA, 324 bp, Homo sapiens; identical to SEQ ID NO: 12122

SEQ ID NO: 13571 - DNA, 115 bp, Homo sapiens
ttaggcccaagaattacctgaacctgggacgtggaggttgcggtgagccaagatcgcaccactgtaccctagcctgggcaacagagtgactcttaaaaaaaaaaaaaaaaacaaa

SEQ ID NO: 13572 - DNA, 109 bp, Homo sapiens; identical to SEQ ID NO: 11741

SEQ ID NO: 13573 - DNA, 224 bp, Homo sapiens; identical to SEQ ID NO: 11519

SEQ ID NO: 13574 - DNA, 342 bp, Homo sapiens
tattttattataaatcaggacctttcgtggaactgtattgaaattaattatcctgggcctggcgcggtggctcatgcctgtaatcccagcgctttgggaggccaaggtgggcggatcatgaggtcaagagatcgagaccatcctggctagcacggtgaaacccgtctctactaaaaaatacaaaaaaaattagctgggcatggtggtcgtgcctgtggtcccggctactcgggaggctgaggcaggagaatggcgtgaacgtgagaggtggagcttgcagtgagctgagatcgcgctactgcattccagcctgggcaaacagcaagactctgtctccaaaaa

SEQ ID NO: 13575 - DNA, 200 bp, Homo sapiens; identical to SEQ ID NO: 11569

SEQ ID NO: 13576 - DNA, 161 bp, Homo sapiens; identical to SEQ ID NO: 12070

SEQ ID NO: 13577 - DNA, 149 bp, Homo sapiens
aatatgagttcatgtcctttgcagggacatggatgaagctagaagcaaccattctcagcaaactaacacaggagcagaaaamcaaacacctcatgttctsactcgtaagtgggagttgaacaatgagaacatatgggcacagggagggg

SEQ ID NO: 13578 - DNA, 312 bp, Homo sapiens
tatacatatataatattatatatatttggtctgtttgtagttttattactagatgatttttccggttgtccttaacaccccttcctgaggttcccttcacccctctctcttgccttccttccctttccctttcttcctgactagccccaagtcccttcatttgcatctgctatgcaatagtccctctcctttccttcttcttccctcagatttagctgatccttcctcccaccctggccttcctttcctctttcctcctcactctccccgtcatgctccctctgccccgcccccaaaaaaaaaaaaaaaagg

SEQ ID NO: 13579 - DNA, 70 bp, Homo sapiens
ataaaaaaaaaaaaaaaaaaaaaaaaaaaaaaaaaaaaaaaaaaaaaaaaaaaaaaaaaaaaaaaaaaaa

SEQ ID NO: 13580 - DNA, 51 bp, Homo sapiens
astggctgctctgaaaagcsatctttgcattgttsstcatccgcstscttg

SEQ ID NO: 13581 - DNA, 272 bp, Homo sapiens
acctgtggctgccgctcgccgctctccggggcgggaacttccactcybccctcccaggagctgtaccccacccgccctacgtccgcttccggagccatgagcagctgggtgctcgcggggggcgttttcatcgattagtggcggcgctgtcaactcacctgccaattgaccttgaccgacgccggccctgtcctcttggaaggagaaatgaagagtgaaggctttgacttcctcagcttttttttttttttttttttttaaaagggrscccc

SEQ ID NO: 13582 - DNA, 111 bp, Homo sapiens
ttaggcccaagaattacctgaacctgggacgtggaggttgcggtgagccaagatcgcaccactgtaccctagcctgggcaacagagtgactcttaaaaagaaaaaaaaaaa

SEQ ID NO: 13583 - DNA, 152 bp, Homo sapiens
atcgaaaaattagctgggsgtggtgtgtgsmtgtggttccagccacatgggaggstggcgcatccccatgsttgagsmcaggaggtttaggctgcagtgagctgtgttcatgccactgcactccagcctgggcaacagagcaagaccctgtc

SEQ ID NO: 13584 - DNA, 412 bp, Homo sapiens
gactgacaactcacacggctgggtactcttctgagacaaaacttccagaggagcgatcaggcagcaacatttgctgttcaccaatatccattgttctgcagcctctgctgtgatacccaggcaaacagggtctggagtggacctccaaactccaacccacctgcagctgagggtcctgactgttagaaggaaaactaacaaacagaaaggacatccacaccaaaaccccatctgtacatcaccatcatcaaagaccaaaggtagataaaaccacaaacatggggaaaaaacagagcagaaaaactgaaaattctaaaaatcagagcgcctctcttcctccgaagaatgcacctcctcaccagcaatggaacaaagctggagggagatgactttgacgagttgagagaagaag

SEQ ID NO: 13585 - DNA, 221 bp, Homo sapiens
aaaaacgcaattctcgagtctatggctccggccgagagttgagtctggacgtcccgagccgccgcccccaaacctcgagcgggagagcgggtcggagggtctagggagagccaaagcggggtggacagggaggcagcttgtgaatttttgttttactgtttaactttattaaaaaagaaaaaaaaaaagaaaaaaaaaaaaaaaaaaaaaaaaaaaaaaaa

SEQ ID NO: 13586 - DNA, 504 bp, Homo sapiens
  misc_feature 176: n=a, g, c or t
acatatcccctcctggaaaggctgcagtgaggcagctctgtttcattctactgccaccgcctctggtcctagaaaacactgagtttctggcctgatcacttgaacggacatatcaagcaggtgcacacttctgagctgcctcacaagtgtcaggtgtgggttgggagcagcagcgncctgccgcccctggaacctcttcctagcgacctgccatcatgggactttgcccagcctgctttgtggaggtcgtcccattcggttcctgacaccgccttttccctttctctaaaaaaatcattcccagcccttgaaaacctgggcccagcacactccagcaacactctcttctgcccagccccgccgggatatctgaggcagggctggaccaccccagaggcagcagggcctttacccagtggcctgttggctagcctgggcctccctggagagggttgacagtggaagggaacaggaggggcatttggcctgagacccctgcatttg

SEQ ID NO: 13587 - DNA, 374 bp, Homo sapiens
tagattataaaatgactatgtttaataaaattttaaaaataaaagagggagagaatgggctcaaaaaaagaaataaaaggctgggcatggtggctcgcacctgtggtcccagcactttggaaggccgagacgggcggatcatgaggtcaggagatcgagaccatcctggccaaaatggtgaaacccgtcattgctaaaggtacagaaattagttgggtgtggtggcatgcacctgtagtccaggctgctcgggaggctgaggcgggagagtcgcatgaacccgggaggcagaggttgcagtgagccgggatcgcgtcactgcactccagcctggatgacagagcgagactccgtcccaaaaaaaaaaaaaaaag

SEQ ID NO: 13588 - DNA, 313 bp, Homo sapiens
taaaaaagaaggtgggctgggcgcggtggctcacacctgtaatcccagcactttgggaggccgagacgggcggatcatgaggtcaggagatcgagaccatcctggctaacacagtgwaascctgtctctactgaaaatacaaaaaattagccaggcatggtggcgggcgcctgtagtcccagctactcgggaggctgaggcaggagaatggtgtgaacctgggaggtggagcttgcagtgagcagagatagctgcactgcattccagcctgggtgacagagcgagactctgtctccaaaaaaaaaaaaaaaaa

SEQ ID NO: 13589 - DNA, 175 bp, Homo sapiens
tatattgtttcccaagaagttctacttggtttcatttcaaacctgcctggtttttttgtttgtttgtttttatttttgttttgagacgaagttgggggtttcatgtcattgcactccagcctgggcaacaagagcgaaactccatctccaaaaaaaaaaaaaaaaaaaaaaaaaa

SEQ ID NO: 13590 - DNA, 366 bp, Homo sapiens
aaggatgtcaaaatgaaaatggtaccataaatagccaacgttgattaaaattaaacatgattactttaacaaaaagaaacttaaggccaggtatggtgggtcatgcctgtaatcctagcdctttgggaggctgaagtggaaggatcacttgagcccaggagttcaagaccagcctggagaacacagagagacccccaccatctcttccaaaaataaaaactagccaggcatggtggctcaggcctgtagtcccagctacttgggaggctgaggtgggagaattgcttgagcccaggagtctgaaactgcggtaagccatgatctcactactgcactccagcctgggcaagagtaagaccctgtatc

SEQ ID NO: 13591 - DNA, 175 bp, Homo sapiens
tgaatataattagtctcatttgaratttagtagctgaacatatactgtattaattaasaatactggtcaggcacgttggctcatgcstgtcatcccagcactttgggaggccggggcaggaggatcagtcaagaccgggagtttgagactaacctgggcaacagagcaagaccct

SEQ ID NO: 13592 - DNA, 132 bp, Homo sapiens
  misc_feature 34: n=a, g, c or t
gggagaagctcggcgcatcattgggcggtggacngcccctcggccccggggtargctgacasgggawggtcctcabctaaagccaaaagcagatcaaagtggtgggactcgcgtcgcggccgcggagacgtg

SEQ ID NO: 13593 - DNA, 235 bp, Homo sapiens
agagtggtggcatctgagaggctggtcgtggactgtggttgggggaggtgggagctgttttaaccktgtgccccctctcctgtgccggcgtgggcatsccccggggcagtggaacgcagggcgctcctccagcttccgagtccagccagcctgggcgcggggcgcgccccgtagacacccgatgagtccgttcctccctggttacgtggactgtggaggttcgcgcgtagtggcg

SEQ ID NO: 13594 - DNA, 144 bp, Homo sapiens
  misc_feature 50: n=a, g, c or t
ctttaggtgtattaagatataaggccaggctgggcatggtggctcatgcntgtaatcccagcactttgagtggctgaggtgggaaggatcacttggagcccaggatttcaaggcgagcctgggacacatggtgaaaacccttgt

SEQ ID NO: 13595 - DNA, 173 bp, Homo sapiens; identical to SEQ ID NO: 11575

SEQ ID NO: 13596 - DNA, 111 bp, Homo sapiens; identical to SEQ ID NO: 11891

SEQ ID NO: 13597 - DNA, 270 bp, Homo sapiens
aaaaagtccctgggaagcggccgggcgcggtggctcacccctgtaatcccagcagtttgggaggccgaggcgggtgcatcatctaaggtcaagagttcgagacaagtctggccaagatggtgaaaccccgtctctacgaaaaatacaaaaattagccgggcgtggtggctcatgcctgtaatctcagctacaggagaattgcttgaacccgggaggcggaggttgcagtgacccgagatctcgccaccgcactccagcctgggcgacaga

SEQ ID NO: 13598 - DNA, 306 bp, Homo sapiens; identical to SEQ ID NO: 12064

SEQ ID NO: 13599 - DNA, 225 bp, Homo sapiens
cacgagactccatctttaaaaaaaaacaagacgggccggcacgtggctcacgcctgtaatcccagcactgagaggccgatcacttgaggtcaggagttcgggaccagcctggccggcatggtggaaccccatctctactgaaaaatacaaaaattagccgggcatggtggcacacacctgtaatcgtagctggggcaggagaatcgcctgaacccgggaggcgga

SEQ ID NO: 13600 - DNA, 157 bp, Homo sapiens; identical to SEQ ID NO: 12187

SEQ ID NO: 13601 - DNA, 81 bp, Homo sapiens; identical to SEQ ID NO: 12198

SEQ ID NO: 13602 - DNA, 375 bp, Homo sapiens
ttccttccttaagtgatgagtaaaattcatcagtgttgccatctgggcttcaagttcttcttgtatgatagtctgattagagagtcagtttctttcacagttgtaaggttgttgatactcagattttctatttctcttgtattggttttaatacattggggttttttttttaaggattttgactctttcatatacgttttccaatttattgacataaagatgttaagattctatacggagaccccgttttcatttctgatattagttttgcctttgatcaactctatgatatgtctcttccctgtttcactaatttctactcccatctttattatttttgtccttattcaatatgctgttccttttctaacttct

SEQ ID NO: 13603 - DNA, 125 bp, Homo sapiens; identical to SEQ ID NO: 11934

SEQ ID NO: 13604 - DNA, 312 bp, Homo sapiens; identical to SEQ ID NO: 12418

SEQ ID NO: 13605 - DNA, 342 bp, Homo sapiens
ttgaaaaaataggacaagaacttatttttaaaaagaggccaggtgcggtggcccatgcctgtaataccagtactttgggaggccgaggtgggcggatcacctgagatggggagttcgagaccagcctggccaacatggtgaagccccgtctctactaagaatacaaaggttggccgggcttggtggcgggcacttgtaatcccaactactcaggagtctgaggcatgagtgtcgcttgaacctgggaggcagaggttgcagtgagctgaggtcacaccgttgcactctagcctgggagacaagagggaaactctgtctccaaaaaaaaaaaaaaaaaaatta

SEQ ID NO: 13606 - DNA, 183 bp, Homo sapiens
ttttaggcgtcacgcaaaggccagcctcctggccccaatacccattttggaagcccctgtggccgtgtggatgtcggtaacagttgtataaaataawttctatttatcgctattgtaaaaaaaaaaaaaaaaaaaaaaaaaaaaaagaaaaaaaaaaaaaaaaaaaaaaaaaaaaaaaaaaaa

SEQ ID NO: 13607 - DNA, 112 bp, Homo sapiens
ttaggcccaagaattacctgaacctgggacgtggaggttgcggtgagccaagatcgcaccactgtaccctagcctgggcaacagagtgactcttaaaaaaaaaaaaaaaaac

SEQ ID NO: 13608 - DNA, 120 bp, Homo sapiens
ttaggcccaagaattacctgaacctgggacgtggaggttgcggtgagccaagatcgcaccactgtaccctagcctgggcaacagagtgactcttaaaaakrataaaaaaaaaacaaaaaa

SEQ ID NO: 13609 - DNA, 108 bp, Homo sapiens; identical to SEQ ID NO: 11964

SEQ ID NO: 13610 - DNA, 399 bp, Homo sapiens
  misc_feature 94: n=a, g, c or t
acgccttgtmggchggrggtggggctgcttttgcttcctttagahrrrcgggcagggagaggaagctctagctccrgrcctgagtttccccgangctgcgtcggaagagctgcaggrcgarcccggacggctgccgtctccrccagaagccaccccggcccggcctccagggcgcagaggcgcccccctccatcctcccccatcccgggggtcacggcargggggccgcacagcrcggctgggaccgattcggtgamggcccaaggaagctgggcgcagggctcgcctctmccgcctcgatcctgcaccttcctctcccaggtcgctgctgcagcmaacccagtagcccccttarcgcmccctcggaccccgcagctccagactccgctttggcaccts

SEQ ID NO: 13611 - DNA, 377 bp, Homo sapiens
acctaatggcgcctggcaatggccggcggcccggcccttcgctgtccctcggtcctcggggtgtcagggacagctccgcgtcgccttgtctcgcttcttcggggccacgggtccagctagacacgcttagcctttaacactcaagccggattctcagaccgctccttcgctctcgcgaccacggctgcmctctccaccccaccgactcccgcccatttctcgttctcaggagttggcttggagtgccagaccctcgatcacggcacctctaggaaagagcctgcmtctcttccttcccttccccggctaccgagcgacttcaagttttcgtgcgcmggaatgamgggctcaagccccaacctcctgctccctcggcm

SEQ ID NO: 13612 - DNA, 303 bp, Homo sapiens
cccgggttcaagcgattttcctgcctcagcctctccagtagctgggattacaggcgcgcaccaccacgcccagctaatttttgtatttttagtagagaargggtttcaccatgttggccagarmtggtggtgggcacctgtagtcccagctactcgggaggctgaggcgggagaatcgcttgaacccgggaggcagaggttgcagtgagccgagatcgcgccactgcaatccaacctgggcaacagagtgagaccccatctcaaaaacaaaacaaacaaaacaaaacaaaaaaaaaaaaaaaa

SEQ ID NO: 13613 - DNA, 506 bp, Homo sapiens
atttttagtcaccaattttagcttttgttagtaatgtgttgtaaatattaatactaatgactgactacagtgagttctgacatctctcccaaatcagtttgtgattctagaaagggacacattaacaggttttaacaacacatttttgcacatggttataaaaattcctacacaatgtaatataagtcctaccgcctcaaccacccttctttccttgtccaacatttctcagctcttgtcattttgagcagtatgtctgcagtttaatgtgtgagggcttatgtgtaacgtatgtwcaggaaatagaaggataaatggcagagctgaaagtttaggtgggatggggagaaaagacaaatataactaaaatacaagctatattccccactctacaacaacaaatgcctgaagagagaaaaaggtaaagtctcttagggtgaagggactaattttggtgagaaaattttctctttgggaatctgacaccttagaaagtaacactgagt

SEQ ID NO: 13614 - DNA, 165 bp, Homo sapiens
tagcaataaaaactttagtgaaaacttattgttgatgttacgtgcttttctaggcacatgtcacttccctgtcaaggatgagtaatatttcctctttatagtatattgtttttttacaacatttagagtgattaactctgttcaagccctttttttttttttttt

SEQ ID NO: 13615 - DNA, 504 bp, Homo sapiens
aagggcttttsgggagtcacggtctgavggcgacccgggcgacccggtcgcccgtgcccggctgccactgaccgctccaacgccgccagggacgacccgccagctgcctccggagccgagcaggccccgaaccttcccattcctagatttccagccgcacaacagccgcggtgcccctggctcgacgcagctggccggagsgcggactggtcgttcgtccctcccgccgttccgcgcccctctcccggctcttgtttcctcgcctcttaacgaggcctttgtgaggaaggttgctgggccttgggactctgacgatcggctggaaaccaggcctggccctgtttcagcatccccgcgtgccaagccctgggccggcgtgcgggtccctgcccctgcgaggaagctgggacttttgcaggcctgggtggagacgtgtacataacagaggaagartgtggaggattggaggactcarggcagcacggcagagtagagatggagttc

SEQ ID NO: 13616 - DNA, 198 bp, Homo sapiens
ctataagcattccttttattctctattctatcctgggtctgcctcaaccgtgagataggagagtctctggtactagctgctgtagcagtgcccttcatccagggcagttaatggagtcttggaccctttctttctctgggatccctgcccagcaccttcctatagagatgactttaaaaggaaaaaaaaaaaaaaaaa

SEQ ID NO: 13617 - DNA, 246 bp, Homo sapiens
tsggccaccgccatcccatccagcgagcatctgcsgccgcgccgccgccaccctcccagagagcactggccaccgctccaccatcacttgcccagagtttgggccaccgcccgccgccgccccccttcccggtgctcagaataaacgtttccaaagtggaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 13618 - DNA, 494 bp, Homo sapiens
aattagtattttccctttggaaaacttgtgaacatgtgaatacacatgtgaacagtcttacatttgaaaaaccaatgttctacaacttggaaagttttcattttttatattttgctgaaatatgtcacagtggcattgcagttgtctgttagctttgggttgcagtgctagatattgttttaaattattttcattttaaacaagatgccttctaagctattgagcttattaaaaataattttacatgtttacttagttggagcaaaaataagtctattttaacaaatagctttgtttttgcatgctaatgtcagaaaggcatacgatgcacattatgctgttttaaaggttttaccacccttgtaaaaactataatcttaaatggttttatttgctgttacacaaacaacactacataaaacattttttcctaaatggtacaaatttataaactatcatttttcacttacggtatttgtaatactacactacaa

SEQ ID NO: 13619 - DNA, 436 bp, Homo sapiens
ccccatgtcaggcggaggcggaaggcccaccgtgccagaggctgggcaccastttaaccctcactctgctagcacctcctccctttccccaaggtagcacatctggctcactccccactcsgtctctggagcccaccagggaaggccctcatcccctgccgctacttctctggggaatgtgggttccatccaggattgggggcctctctgctcacccactctgcacccaggatcctagtcccctgccctctggcacagctgcttcctgcaagaaagcaagtctttggtctccctgagaagccatgtccctcgtgctgtctcttgcctgtcccacctgtgccctgccctccagcttgtatttaagtccctgggctgcccccttgggtgcsccccgctcccaggttcccctctggtgtcatgtcaggcattttgcaag

SEQ ID NO: 13620 - DNA, 92 bp, Homo sapiens
cacaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 13621 - DNA, 522 bp, Homo sapiens
aggattaaagaacaaatacagaacaaattattcctccagcacccctactgcaaggattttaagaactctatctcaggataaagacctgagggtcacaagatgtacattgctggcctcagctggattttcccagggtcaggtgcccattcctacctaatcaaaggacacttctgctgacctgcacctagaataccctgttctgtgctgatgactcagatgtaagaatgatgaagtgcatcggctggcatgcagagaacaataagaaataactgagttgtgggaagacatgaggaaaggacatgaggctcttaataacagctgccabrgtactgcagtcgggaatctggagcaaagtgattcaattctgaccactgcctgtgagtaaatggaattttatttttcaatacttttgtttaatagtacctccttcattacatgtgaacagcactccaggacagtaaatcatgaaatgggaataaagcctgtaattttaattaacataaaaaaaaaaaaaaatgcgaa

SEQ ID NO: 13622 - DNA, 443 bp, Homo sapiens
ccatatataaatttaaggtagattcattttacatttggtatcatgttaaaatgctcccaaactacctactgtataataggtattgcaatattgttgatcaccttcaggatattattatcctgaaatgtctcccagtggtccaagctgggacagtttgagcaacaaaataaatatgagaggattggattataacctaaaaaataaagtcaatatctataaatccatgttgatttaaataaatgattgactaaataaatacttggcagaaaagaagcaaatcttccttacagaaaaattccaaataatatatgtagaacacactttcaggaggtggaacttaatttacctcttcttgaatatggactggactgctgacttttaaagaacagagtatgaagagggaaaagcagtaactttacagtgaagaggcctggcagacagca

SEQ ID NO: 13623 - DNA, 460 bp, Homo sapiens
atcaattttaggagcaaggaggcaggagaagctcaggtcagtgtacatggcccatagtyattgcttctgccacttccaaggcaacagcctaggctggggacccctcaatacccagccctgtgggscttgtggcacgggcactctgtscgtgtagggcatttgaacatcaggattctggcctaggccacctgcccacccctcaaaccatgtttcctccccagcggcttttttccaggactgcatttcagagcaggaccttgacgagatgaacatcgagatcatccgcaacaccctctacaaggtaatgccccacacaagccatgggggattggcctgtcggtgggtggggctgtgggaagtggtagggtggtgatttatgtgaggtgctgggacaggatgcagctatgtcaggctcctatcccagggacttactgcttattctctggctcccatgctgggc

SEQ ID NO: 13624 - DNA, 386 bp, Homo sapiens
ccccatctctactaaacatacaaaaaatagctgggtgtgatggtgtgtacccctgtaatcccagccacacgggaggctgatgcaggagaaatgcttacactcaggaggtggaggctccagtgagccaagatctcatcactgcactccagcttgggtgagatcactgcactccagcttgggtgagaaagtgagactccatctcaaaaaaaaaaagttcactttacaagatcctgacctttggcagcaagtaacctgagcttttgaagagatggaggaaagaagttgctttgcagcaggatgaattgaaattagagtgaagagaggacttccaggtcatcatggtagcaagttgggcagcacacatggagggactggtggcttagatc

SEQ ID NO: 13625 - DNA, 476 bp, Homo sapiens
tgaagcagacctttcattatttgatcattgagtgacctatagcctcagttccaaattcttaagatagggacaaagttacctgttttataataaagcttaaaaaaaaattccctaccctgctctgtcccacttgacctctgaaatctcctagttggtcagctaccaggaacaggtaatggttgtgttgaaatcggcccactttccatacttttgggacatgttttaaggcttcatttgcaaatgttaagatcttagacagtgctagttgccaagagccacctacaaaggtaatgccagtcctcggacccaaatcccaggggactctaggtctcaggtgcagagcctaaattaagaaccaactcagtaacaaaattctccttaatccttggaagctaaagatccagctttgaaaaatgtatttccatgtaatatattgatacttttgttgtgctcattatatactataaaacacttgc

SEQ ID NO: 13626 - DNA, 138 bp, Homo sapiens
aaccccgagaccatggggaagctcgtggcgctggtcctgctgggggtcggcctgtccttagtcggggagatgttcctggcgtttagagaaagggtgaatgcctctcgagaagtggagccagtagaacctgaaaactgc

SEQ ID NO: 13627 - DNA, 266 bp, Homo sapiens
tcctgattggaaatagaagacatttccggttgagagaacagattcgttggaagcttaacttttgttgcctcttaacgccaccaaattttagggtaatttgattatgaaagagtgaatttttctggacagaaaagggagagctaccaaattgtttttttctttttaaaaggaagtttaatgtccgttgtatcacaaatcagtgttaaaacaccagaactttagccaaaataaatgtcttacattacaaaaaaaaaaaaaaaaaagct

SEQ ID NO: 13628 - DNA, 115 bp, Homo sapiens
ttaaaagaactagagaagcacagcaaacaaattcaaaagctagcagaagacaagaaataactaagatcagagcagaactgaaggagatagagacacgaaaaactcttcaaaaaaa

SEQ ID NO: 13629 - DNA, 514 bp, Homo sapiens
taggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgcagaatgtcagatattttggatgttgcataagagtcctatttgccccagttaattcaacttttgtctgcctgttttgtggactggctggctctgttagaactctgtccaaaaagtgcatggaatataacttgtaaagcttcccacaattgacaatatatatgcatgtgtttaaaccaaatccagaaagcttaaacaatagagctgcataatagtatttattaaagaatcacaactgtaaacatgagaataacttaaggattctagtttagttttttgtaattgcaaattatatttttgctgctgatatattagaataatttttaaatgtcatcttgaaatagaaatatgtattttaagcactcacgc

SEQ ID NO: 13630 - DNA, 232 bp, Homo sapiens
ccccaaggtcaggcatttgagaccagcctggccaacatggcgaaaccccatctctactaaaaatacaaaaattagccaggcatggtggcaggcgcctgtaatcccagctactcgagagactgaggcaggagaatcacttgaaaccaggaggcgggggctgcagtgagccaagatcacgccactgcattccagcctgggtgacagagcgagactccgtctaaaaaaaaaaaaa

SEQ ID NO: 13631 - DNA, 471 bp, Homo sapiens
tcaaagaagttaaaatggtgtggcaggtcattaggattaggcagwatctctcagagctgctggacaaggaggtctacttattttgtgtggatggtaattatggcatgcacgctgaatgcagttctgagcatggcagcggcccctgagggtcagatcagaattgcccacaatgtgttttttaactaggaccaggtgcagcatgctagtcttgattggaaagatttgacaggatgctaattactgaacagtgggttttgtcaacgccctggtttcagaatatgaactgaggagtcaaacagttggaaacagcacattgctgatttacactggatcttgccttagaaaccattgtctgcctgcctaaccagcctttcataaaatttaaacaaaactctttctacgtagtgactcctcaagcaatatttttgatacagcaagtgtcaaacttgctatagcataaaagccggggct

SEQ ID NO: 13632 - DNA, 507 bp, Homo sapiens
ctcaaccaaatggccctaatagatatctacggaatactccactcaataaccacagagtatatattcttctcatatgaacatggtacattccctaacattgatcatcggcttgatcataaagcaagtctcaataaattaaaaaacaactagatcagatcaagcgtcttcctagactccagtggaataaaattagaaatcaataccaagaggaactctaaaagccacacaagtacagggagactaaacaaccaactcctgaataacttttgggtaaacaatgaagttaatgcatttcggccgggcgcggtggctcatgcctgtaatcccagcactttgggaggccgaggcgggtggatcccctgaggttgggagttcaagaccagcctggccaacatggtgaaacctatctctactaaaaaatacaaaaattagccaggcatggtggcacgcacctgtaatcccagctacttgcgagactgagggaagagaattgctcgaaccccagga

SEQ ID NO: 13633 - DNA, 466 bp, Homo sapiens
aactgataaagaaaagtcatggaagacaggaagaaaggaagagagggaagtaaagaggaaaacctataaatattcccacagatagacaaagtcaagcataaaactggagcttgagaaggaaatgaaaggaaaagaagtggtactttcttttaccctaggagaagacctccatacaggaagacttgtgtgtggggctgggacattagaatcatccgcaagtcactccaaaccttgaaactgtcagggtcagaggggaactaccatttattaagcatttgccatgtgccaggcactgacccagacacattataaataccacattgtttcacctgtgtgtggcatctacagaccttagatcatagctgtgagaacawkrgtaagcactgccaaagttatcagctacccatacctcatgtttttggtgttatctactcttcctagaatcaaatattaaraataattttaa

SEQ ID NO: 13634 - DNA, 513 bp, Homo sapiens
  misc_feature 288: n=a, g, c or t
gtagacactgactgatgggaccaggtacaaaatcccctgggacaaaacagaactttcataactggctgtagagttattgtttttgccttttggatcttccaccttgtgacgggaagagcactgtcagcccaacacagaaactctgccgcctggagtcacgtggatccagatgcgaagggactccaacgtcatgctaaggagtttgggctaagaatttgtacagccatattacagatttggaaaatgatgtgaagagaagctaagggatttgccactgccactcagctnmcaaggatcagagacattacttctacttctcaacgtccatcctccaaccattgtccagtgattcaggcagaattccctcctgctcaggaggtagccatcctgtgaccctggaagaaaccagcccaaggaaggtgctaactacagaagaaggacatggccagggtaatcacatagacccggagttgaagccctgactgcaccacacccgaagcttccccacctttc

SEQ ID NO: 13635 - DNA, 321 bp, Homo sapiens
aagaagggtaggagagaaaagccatggccgacaaggtcctgaaggagaagagaaagctgtttatccattccatgggtgaaggtacaataaatggcttactggatgaattattacagacaagggtgctgaaccaggaagagatggagaaagtaaaacgtgaaaatgctacagttatggataagacccgagctttgattgactccgttattccgaaaggggcacaggcatgctctccaaaccactttttgcagctttctctagttcaagttcaccagactctataaataaaacctgacagaccatgaaaaaaaaaaaaaaaaa

SEQ ID NO: 13636 - DNA, 257 bp, Homo sapiens
tcctgattggaaatagaagacatttccggttgagagaacagattcgttggaagcttaacttttgttgcctcttaacgccaccaaattttagggtaatttgattatgaaagagtgaatttttctggacagaaaagggagagctaccaaattgtttttttctttttaaaaggaagtttaatgtccggtgtatcmccaaatcagggtgttaaaacaccagaactttagcsaaaataaatgtcttacattacaaaaaaaar

SEQ ID NO: 13637 - DNA, 504 bp, Homo sapiens
tctctatggataaatgctgatgttggttaaagaactgaaaaatgtgctcaactgtttcatcttttctattttatttttgtaatttatattgtacacaacccaggaagtaactattttggacatgtatttttataaaccaggtaatttactattatcctggaatttagactaggtttgtttcatttgttgacttagtttccagccaagaaggaaacgactgtctcccccatgtccaggtctcagtttcaagggcagagtccagagagcagacagagttctgtgagagcaggagagcagtctggaaaccctggctgtgcataccgtgtcagccgtgggcctggagatgggagcaggtgagacgcagagccccagtactgagaggaggaagccctcttacagggccccttgcccaccccaagtccgtgtctgaaacacgagcgggtgctgcttcaacccgcatttaatgctgtgtaagtagcgataaccacgtacgagtctgtctgg

SEQ ID NO: 13638 - DNA, 465 bp, Homo sapiens
ataattctgactggaaaattgggaaaggctttatgaggaatgtggcattgggttgcagctttaagaacggagaggattttgtcaggggtgtgtgtgtgcatgtatgtatgtaggggggtggaggcgatggtggtttgctggctgcaataggcaggagacaaggataagaagggaattttaggccgggcgtggtggcttatgcctgtggtcccggcactttgggaggctgaggtgggacggatcacctgaggtttggagttcaagaccagcctgatcaacatggagaaaccctgtctctactaaaaatacaaaaaattagccgggcatggtggctcacgcctgtggtcccggctgcttggtaggctgaggcgggagaatcaattggacctggggggtgaaggttgcagtgagccgagatcgtgccattgtactccagcctgggcaacaagagcaaaactctgtctc

SEQ ID NO: 13639 - DNA, 502 bp, Homo sapiens
aaaactattttaaaatgacaagagtgtggagtagaagaaagtatgaatttgttgtcaaaagggagggagggactggagtatgggaggcctttacataccagattaagaagattgtactttatctttcaagcaaaagagaactataggagcaatgtgattagagttgtgtgaaggatggactggaggttcaagactagacctagggaaatgagttgggaacaagtgaatgcccaagaaaggtagtaacagtgtgaacagataagaagcatgatgagaatgtggggaaggagagaatgggccatagagctcaggactgtcaacaggagaagcaggtctggagggacggaaagaggagtccagtgctgatcatgttgatcttgaagagcatagtggtgatttaggtgggaaatttccactgggcttctgaatatacaggtcctctatcttaggagggagggatttgggggctgtcagcatggagtggtactaaaagccatgaggg

SEQ ID NO: 13640 - DNA, 443 bp, Homo sapiens
  misc_feature 157: n=a, g, c or t
agaggatttggctctgtcacaccattcactgcctgcccttcttcccagcgcttccaagatctggttgtattaaacacgagaatgaagagaggaaaacaccttcgcccacggtgtgctctggggacatctccaggtgtgggtggtggcgtcasagggnacagatgcccactcttcctggctttgatgaagcaagttgccttgttccagggatccatattactaatgaatgagggcagcctccagccaatagccagcagggaactgaggccctcagtccagcaaccctcaaggaactgaaatgctgctaacgaccacatggatgtagaagcagatccttccccaatcaagccttgagatgagactgcagccccagacaacacctcctgagagactctgaaacagagagcctgactaagccctgcccatattcctaactcacagaa

SEQ ID NO: 13641 - DNA, 385 bp, Homo sapiens
cccccaggccgggggacaccagaggctcctccatgggcagcaggagtgagcggaggggtgtgtcccacagcgactttcccagccaatgccacggtggagatgacagccccaggtctggggtacagagaccacttaggatggcacagggtggctggccccggatgctgagagcttggtttcatttgaattttcttccccaacctgagtgctttgacaacaatggaaatagagaagtggctgctttcttttggtgaccctccaggggtggaatcggagtgtgtctgcsmgsccttgtgacagacacacggaaggcttctgacgcttgrkggccagactgcaattgcacttatgtgttatgctactaatatttgaaacagacctgcca

SEQ ID NO: 13642 - DNA, 253 bp, Homo sapiens
tcctgattggaaatagaagacatttccggttgagagaacagattcgttggaagcttaacttttgttgcctcttaacgccaccaaattttagggtaatttgattatgaaagagtgaatttttctggacagaaaagggagagctaccaaattgtttttttctttttaaaaggaagtttaatgtccgttgtatcacaaatcagtgttaaaacaccagaactttagccaaaataaatgtcttacattacaaaaaaaa

SEQ ID NO: 13643 - DNA, 328 bp, Homo sapiens
cacaggcaaaacaaaactagtttgatcgtgatgggaaacattagagaaatgcaaagacatgaccatcataattgtcaggagaaggcattggttaggattgggaagcggcaagcagaagcatttagggattggctggcaatgttttacttctcggctgagtgagggttgcatcggtgtttatttgataacacgttctaggggctgggcaagatggctcatgtttgtagtctcagtactttgggaggccaaagatgggaggattgcttgagcccgtgagtttgagaccagcgtgggtgacatggcgagaccctgtctctacaaaaaatta

SEQ ID NO: 13644 - DNA, 362 bp, Homo sapiens
ttttccctggactgactgtcaaaggaggtggttttaaaaagcaagccaaacaggtttccatcctttaggaagaccctggaacgtgccagttgattctgacaatttctcatgaacagaaacacctaggaagggagaactggtgagtcttttcaagaggaggaagtccctcaaaaggggctgtgtttcgcaaacggcgccccaaaagggctgaaatacttcgatctggaggaaaaagactcaggcactgarggaaggggagggtgcacatctggagtaatttcaaggctttttccgtgttatctgaggtggcaacaagtaagatttgttcgttttattatttttttaaaaaaaaaaaaaaaaaa

SEQ ID NO: 13645 - DNA, 480 bp, Homo sapiens
agttgaaggagttgcatttatctttctggctcctaattcctttaaaattacatttgttgcagaacctccacaaggctaaataaaattacatttgtgaccatcagagaactgaataaaccattaactggccatcctggttttgcagagatcaggttgttgacagttcctggttgacccacagctacccatgtcagttatctccactaacatatccaagaatctttgtaggacaatttctccacctgcaagtctttcaggtagaactcttcttttaaggcaattagcccattgccaaaaggttttactgtcttaaagctgtctttctgagatctaattccaaggacttctccacagctaagtgagatgcctcacaccattaggtgatgctttggacagaacagagtattttcatcttgtgtttaaagcaattccttggcttcggctcctcaccactttctatgccagtctcccatttatgtc

SEQ ID NO: 13646 - DNA, 116 bp, Homo sapiens
ctcttccgccgaagccgctccccttgcgaagaactggggcctcccgggaggagagagggctttgcttgaaacccgggacgccaggggcgctcccgcaagtgggggtcctccgggac

SEQ ID NO: 13647 - DNA, 113 bp, Homo sapiens
ctccagggctggggaacgtccgcaagtcaatgctcatagatgcccggagctgcctcttagactcgtctggcccatctacctgctgacagagcatgacaaagatgactctcaaa

SEQ ID NO: 13648 - DNA, 269 bp, Homo sapiens
  misc_feature 253: n=a, g, c or t
tcctgattggaaatakaagacatttyyggttgakagaacagattcgttggaagcttaacttttgttgcctcttaacgccaccaaattttasggtaatttgattatgaaagagtgaatttttctggacagaaaagggagagctaccaaattgttkktttctttttaaaaggaagtttaatgtccgttgtatcacaaatcmstgttaaaacaccwgaactttagccaaaataaatgtcttacattacaacatttnamarmaaawraamgct

SEQ ID NO: 13649 - DNA, 62 bp, Homo sapiens
aagacggagtttcgctcttgttgcccaagctggagtgcagtggctcgatctcggatcactgc

SEQ ID NO: 13650 - DNA, 182 bp, Homo sapiens
tccgttactggtggcgcgcgcggggacttaaagtaggtgagttctaggggcctggccacggctccccgggagcatcttggttcccccagaaggcgggaggggcgtaccttgggtgcgactgggcggaggtgacttggaagttcgcttctcggactgtaatactcatccttacctggcgcccc

SEQ ID NO: 13651 - DNA, 486 bp, Homo sapiens
atttgttttgctctataaaaaatggttggcttcccacgtttgcttttgcagtccatctattgcagaaagctttttaattaaaacgcatcaaagaagacctgactttatacggagaagtgataagggaggagtatgttaataacctttaaagataattgtggatttttttgatactactgtaaaacttaaaagtactcttacatcgaaattaattgggttggctgggcatggtggctcacacctgtaatcacagcactttggggggttgaggcgggtggatcacttgagctcaggagttcaagaccatcccaagtaacatggtaaaaccccatttctgcaaaaaacacaaaaattatctgggcgtgatggtatctgcctatagttccagctacccttgagctgaggcaggaggattgcttgaatctgggagtcagaggctgcatgagttgagatcacgccattgcaccccagcctgggcaacagagt

SEQ ID NO: 13652 - DNA, 442 bp, Homo sapiens
atatgaattttagaaatgccgaagtaacatgtctccaaagagcgatctgcactgtgctgtttgttttgtatcgagagttctgtgagtgcagctgtaggcattcagatgaaacttgaatttttccaaaggaagttctggactgccagcagacagtgtgcttccctggatggcaaatgctccatcagctgtgatgatgagactgtgaattgttacctcatagacaataatggatttattttggtgtctgaagactacacacagactggagacttttttggtgagatcgagggagctgtgatgaacaaattgctaacaatgggctcctttaaaaggtaagggttttatggtccactgcattccccccaaaagttttcctaaataaaataaaacaagccaaggtcaaataaagcaagcccagacttgaccctgtggctggttttta

SEQ ID NO: 13653 - DNA, 475 bp, Homo sapiens
ttaattattcattcatatgtttaacaaaagtttattaaatgcttactgagggcaagaaaccgtgtaggcaaaatagataagaaatgaacagcggccttcccctcaaggcatttagtttttcatggtagacaggttcataaacagctaactggaatgtattgcagtaagtgtttaaataaaggtacgtgcaaggtacttagggaccacagaataggacataagtaactgcccttcagagccgccaagggagacctccacagtggtggtgccgtctgagccggagttctgggtgagcagttcacaggcagaggcaggagtgggcatcgcaggcgggaaaagcagcaaaggcagaagggcctgagtgagcccgtagtgctgggaagagggcgatgcaccatttctggggcctggagtgcagataggaaagagattggaaatgaaattggaaaggcatcagggcttgcacagtgaaagg

SEQ ID NO: 13654 - DNA, 79 bp, Homo sapiens
  misc_feature 38: n=a, g, c or t
ctttttccggttgcggcgscggcggtkaggttgtctantccasgctcggagccatgcygtccawgggtccgctgcagtc

SEQ ID NO: 13655 - DNA, 284 bp, Homo sapiens
ctctttgtctgtaagcttgctctgggactcagcctcttaggacctacgatgccagcagctctcattaacagtgaaatgacagaggccaaagatggccaagtgaagacccaagtctcagaaaacccagacttgggacaactgcctgggaactaggatgctagagcagttctgtaatgctttgagacacagcaattttcacattggccattctttcccctcccctaccccttttcttttgagggacttttaatgtttgctgctttaggtggatggagagtccacca

SEQ ID NO: 13656 - DNA, 473 bp, Homo sapiens
tgtattcttttaagagatttttcacatagtggtcaacttaggatgagtttaccagtcttatttgaagcagtggtttctcatgtttatcacaatcctcattccctgaataaccatttattgggtgctttgccatgttccagtcagtcaactacatgctgggcatacaaaattgaataaatgaataagccataatctgtgcacttggggacctcttagcctgtgctcaaggggagacagacagataaacaagcatacattgtgataggtgttatgacaaaacccaacgtacagctgggtcacaaaggaggaagtaagtgattatattgaagggattgggaaggaaagaaaagcatcctagaggctacttattaaaagacagataggagattggtgcagtggatcatgcttgtaatcccagcattttgggaggcagaggcaggaggatcacttgagtccaggagttcaaggccagc

SEQ ID NO: 13657 - DNA, 497 bp, Homo sapiens
cagaagatcggcaaacgaatgtatattacacagtttaggttatgattccctactttaacctacttactttattaaatgaccaactactgatactgatcacaatagttattagagattctaatttagttggaaggttctaatcactttcattacaggcatttgaaaaatagggattcatttcgaatatattagccaggagcatagttagatgttacccaggccatttatcatcctgttaatgatgattttcccgacccttgtgagatcagcgtgacaggagtgtgtgtgtgtgtgtgtgtttctgtgggtgtgtggttttggttgggtgctgccaggtggcaaaggcatatgtaaatacatctgatctgcatctttatttcacagttaactaaaagtaaaaatgtctattctgattccatattgattttgtctaagatgtaaaaatttgagttcatctttggccaaaacctacctgaattaacatacaaaatatttga

SEQ ID NO: 13658 - DNA, 145 bp, Homo sapiens
tctgtttcagaactttagggcctttgaaatatttcctcaagcctatttcatgagatctacttggtttacccaagtcatgtttttaayagactgctaayatcaaaggagaattyttaaagccttcaacaatgcctactttcccatt

SEQ ID NO: 13659 - DNA, 490 bp, Homo sapiens
tgtgtgtgtaaccccctttggcaatggagtagtctgttgtaggcctggagaaagcagacatttgaattgatccagttccaggcatatgggagtggcaagagaaatgggatgttactagtagtgattgaaatgaatgagctatggagtctagagagagaagaaagtgaatgtgagaaaggactgataggcagaagttagaagcatcaagggaatggatgcattgaaaaattagagacgagacagtaaggaaacaactaggaataagaggcatttttttaaaaaactgctttattgtggcaaggcgccgaggctcatgcctttatcccagcactttgggaggctaaggcaggcggatcacgaggtcaggagatcgagatcatcctggctaacacggtgaggccccgtctctactaaaaatacaaaaaacttagccagatgtggtggcgggcacctgtagtcccagccactcgggaggctgaggcaggagaat

SEQ ID NO: 13660 - DNA, 481 bp, Homo sapiens
caaacatgcatgttatttagtttgttctttagtatattgttaactggcctaaatccaatgactgacatggtaaagattcaccacttctagcatactgggcactttttatttttgacttgattacattaactttttgaaaactattcagtgatttattcagccaatcttatgaggtacatctgagttgttctagatgctagaggatagtataacaggaaaaagcccctgctctcatggtgagacagataataagtatgtaatacaacttttcaaatagtagtatgaatggtaaaaaaaatagggaaaaggggtgggaggagctgaggtttgatagaatggtcatggaagatcccattaatgagatgtactttaagtagagacctaaatgaagataattttttctctagtactgaactagcactgtacaagtggattgcatataggcatataggcagaacttctctagtactgaactaacact

SEQ ID NO: 13661 - DNA, 234 bp, Homo sapiens
aaaacggcgctcctggcggatggaacagcacgggcaaaggctgggtatgggggtatgtggggatggaagtgcccagaggggcagcgcgatggggttgggggcgggaccccgcaggcctccagtaaggggctagttggggatctggtcagccagtggccaaggccggtggtcagtgagaagwtgatgcggasgggggggcggtttcagatcagtctgagggtggagaataggaaa

SEQ ID NO: 13662 - DNA, 102 bp, Homo sapiens
ctgaatgtatcacagttcagccactcacctactgaaggacatcttggttatgcccaagttttggcaattatgaataaagctactataaacatcaaaaaaaaa

SEQ ID NO: 13663 - DNA, 440 bp, Homo sapiens
ctttgggtgaaaaaagtatagtgtgcttaagtgcagaagtgttttttgaggatttttgattggatacaaaccaccactcatattttatgtcttttgcacttaaaaatttcaccataacttttgagtcatttataaaaaccactgaaagagtacttgagggacatccccgaatcctgaagaacttctggtgttctggagcagcctcagtgagatccaggaggatggcattgctgggctggcccagcctttattgattatggtgtaaagaattaatatggtggttatatactctttgttagacaccttggcttacaagacgtaagcgtaaagtgtagtgcgctttagtcagtatggccacatggtcctttggtggtaaattgtttgagatgcctccagtttttaaaaggagtagcatatcgggccaggatcagtggctcatg

SEQ ID NO: 13664 - DNA, 447 bp, Homo sapiens
  misc_feature 121: n=a, g, c or t
aggacagggctgtgggcgggcacttggagcccagggcagggttcacagagctattttcagttctcttgcaggatctccttcccagccttcagaaattgccggtctgggagttgggggcaangagaagatcctgaggtggggtttcgtcatgttgaccaagctggtcttgaactcctgagctcaagcaatctgccagcactttggggggccaaggcgggggggatcatctgaggtcaggagtttgagactagcctgaccagtatggtgaaactcagtctctagtctctactaaaaatacaaaaattagctggccgtggtggggtgcacctgtaggcccagcaactcagaaggctgaggcaggagaatcgcttgaacccaggaggtggaggttgcaatgagccgagattgcgccactgcactccagcctgggaggcagtgagactctgt

SEQ ID NO: 13665 - DNA, 471 bp, Homo sapiens
ctttattttcttcctattccagaacacaaattggttttgttttgttttgtttttgagatggagtttggctcttgttgcccaggttggagtgcagtggtgccatctcggctcactgcaacctccgcctcccaggttcaagcgattctcctgccacagcctcctgagtagctgggattacagacatgcaccaccacgcctggctactttttgtatttttttttttgtagaratgggggtttsacsatgttggtsaggctggtttcgaactcctgacctcaggtgatcagcccacctcggcctctcaaagtactgggattacaggtgtgagccaccgtgcccggcccacaaattgtttttaacaagaaataagtactgaaaaaaaattgatgtgtaaatgtcacaaattttctaaatttacacatctatttcatttcaaaataaatatgctaataaatgttttggtagactgcc

SEQ ID NO: 13666 - DNA, 55 bp, Homo sapiens
agccgtggaggaggaggacgatgaagaagctgcaaagaaagaagctcacagaacc

SEQ ID NO: 13667 - DNA, 253 bp, Homo sapiens
cttttgcgcctgcgcgagacccccagctaccgcacggttgtccagaggmagaagatccgtcttctcattgggcagcgggactggagggttctggttcggattgaccggctttgtgttccgttctagcgctgcacgccagacaccggcctttcaatatccgtctcttccctgcaggawtgacggcgttgcacgctctcgcggggaggctctggctttccaaacgctggcaccgagggtttttctgttccttttt

SEQ ID NO: 13668 - DNA, 475 bp, Homo sapiens
cagatctaagctccaggcacgcctgaagatgtgttgctactctgacatcccgagtttctgtccacacattgcatgcacagcgccccacacattggatactgttgttcacgataatttctcccgttttccagagcatttaacatagcttggaggcgtaaaatggctctgtattttaataacacagaaacatttgagcattgtatttctcgcatcccttctcgtgagcgcttagacctttttctattttagtcggattttgttttggaattttgcttttgtatgaacactcagcagaaaagtacttacttcttgccagttatctattaaccaaaacctttgatttgtagttttaaagattaaccctcaaagttctcttcataactgccttgacattttgggttgttctgttctgttaattttcttttgcttttttgtgttttttgtttgtttttacttttgcatttaagaccattaa

SEQ ID NO: 13669 - DNA, 456 bp, Homo sapiens
  misc_feature 129: n=a, g, c or t
tattccccaaagtaataatgttgaagtatgggtctcatcattcccatacacagaaacacaaaacactttgatcataaacttttttcttcagaagccaaactaacttgcagaataatagagccactggtntaatgtttcctcaagataggttttagtbtaagctagtattctgtgtgttcgtagaaatgattcaatacctgcagctggtgaattaggaattgtatttgttgccttttttatattagatgaggtgcaaaaattttaatgctagtcagtatgcaccaccacaggaaagttagatcccattagcacttgaaactacagctttggaaacttaggctaagttaatttggatttgttacttgattcacctactgaccttttsttttgtttgaagtgcttatcagcataatgagctaagtgtcatgcatatttgtgaagaaacaccctttttgg

SEQ ID NO: 13670 - DNA, 230 bp, Homo sapiens
tccgagattgttctgcatattcatttgcacattgttgtctgggttggacatgcgtgtgggcttcagtgtgaggcttttaatatgtatatcctgttatcaataaaacaattatccaagtggttgaatcctgtgagacttggcaagtgtgtgcaaatcaagtatacttgacttttcaacctcttctttcaatgtaacttttatatgaaataaagtaatcaattaacagttaa

SEQ ID NO: 13671 - DNA, 371 bp, Homo sapiens
aagtctcctcttcacgtcccagcgcgggtgggcgccggcggctcctcttaaccacaggttccagaagtcctctgcagaagtgcttccctctctcatttccaggaccacaattcccagagacttcggcttcacgacgtttctctttttgcccgatctctcccggagctagctgggcttcggccggccagaggccacagcgacgacgtgatccgtcgtgagcgggtcccagggtttcctcggcggcccttttttctctcccctcggtcgtcccccttgcaggctgtcgcggctggcctgagcggtgacctggcgggtcgcgctgcgstctgcamtgtttcctgcctggctggtggcggcggcattttgttcat

SEQ ID NO: 13672 - DNA, 173 bp, Homo sapiens
gtttgtttgtttttggggggttttcttgccttggttgtctggcaacgactttgtacatttgggagtttttatgagaaacttaaatgttattatctgggcttatatctggcctctgctttctcctttaattgtaaagtaaaagctataaagcagtaaaaaaaaaaaaaaaaaaa

SEQ ID NO: 13673 - DNA, 460 bp, Homo sapiens
catcacttgtggcttctggaggcaaagatgataggggatttctgtggaggattggatcagaagagggtgccctggagctgactggacataaggatactgtcggcacagtggctttcagttcagatgggaatttgttggcttgtggaagttttgatgggcaaataaatgtgtggaatacagctacacgaactctcaagggaacccttgagggttcgggtcaggttttgagtggcttaaatggcattctcggggacatttgataatcgcaggatcagaggattgtaatgtatggatgtggaatgccgaccataatgccattctgaatacctttgctggacatagtaacacagtgacatgtggtgattttactccagatggtaaacttatatgcactggatcggatgatgcgtctttgaggatatgggacccaagaagtgcacaaagcagacatgttgttcga

SEQ ID NO: 13674 - DNA, 447 bp, Homo sapiens
cgttctagctgcggccgcaggagctgtggcggttttcctaatcctgcgaatatgggtagtgcttcgttccatggacgttacgccccgggagtctctcagtatcttggtagtggctgggtccggtgggcataccactgagatctgaggctgcttgggagcttgtccaatgcctastcacctagacattatgtcattgctgacactgatgaaatgagtgccaataaaataaattcttttgaactagatcgagctgatagagaccctagtaacatgaattataagamactattttaaaattcatatggaaccaaaaaggagcccaaatagccaagacaatcctaagcamaaagaacaaagctggaggcatcatgctacctgacttcaaactatactacaaggctacagtaaccawaacagcgtgatacttgtacaataacagatacagac

SEQ ID NO: 13675 - DNA, 479 bp, Homo sapiens
cagaagaagtttctaggcgcgcgtgccctgggtttattaagctcctggctccgctctagacctcagcggttctggctgccagcctgggcagcctgggaagcctgggaggacggtggcttgccggtctgtcgtgaggcagtgcggacggggaccctctgggattctgctggatctgccccgggggttacctttgggggctgggaccccagtcgaggggacacaaccgtccctggcagtggttggttctgcttctccctgcagaaaagcagcattttcggaagctgaagaataagctagcccagccacaccaccttgttgtgtgaccttgggcaggtggttctgtctctctgagcctctgtttctctctgagctgagcagccaccatggctgacggtcagatgcccttctcctgccactacccaagccgcctgcgccgagamcccttccgggaatctcccctctcctctcgcctgctggat

SEQ ID NO: 13676 - DNA, 235 bp, Homo sapiens
caaattggggacaaaatgttccagaaaggcgggtggaatatgcttttggctctgttgacactgaagttaggttgggtagagaaacacaaaggaaactgaagcatgtgccattctatactgtcattccaaattctcatggactattgcctgttgtgaaaatgtttgaaactgcactgaaagctgcatctgtctgtatctttcttttgtaaatgacctcacatgtaaattcaccaaa

SEQ ID NO: 13677 - DNA, 468 bp, Homo sapiens
tgtgtgtgtgtctacgatgtgcttatttaataattgccaaaatatttagactagagtaacttccggtgggtcaattggattgtgactttcttttgtggttttttggttcttcgattgctctctgttaaatattttcataattccccccacagaatacgtgtgtatatactgcaacttaaaaactaaaagcagtactcgaatgagttgttttaatgttgtacttttatctgtttgttttatgggttctcctgctgcctaatgacctttctgtttttataactgccggaaagccgcgaasctctcgcatggggagctaggtccccgctgcggctccgcacttgagtttattataaactctggggttctgagtaagttttgtttgaatacagcaacatgattgtctctttctattcttatcctaaaagactctgtctggcatcttttagtttgtaccctcgtatctgcttc

SEQ ID NO: 13678 - DNA, 467 bp, Homo sapiens
taatataccgtcctcaagggggaactggcactgtgaccttagcatttagttttctagaggatgtgatctaatttctttctagctcatcattaaaaaggaaattgtatcaggacccatgggatatatccagaggcaaactttatgaggctttgaaatcttgccttcctgaagatagctgagtaggatggttctaaggaaagcctttgcaatcttgcaagatttgtagaccagcactacaaagatcgcatagatcaaataggaaaaaaatgtcgatttttattcagtctgatggttctgttcttcattgtgattgtcattaaaaagtggtaaattgctcaatgtaatatttttgtgcgctgtttagaagttgtgtgattttttgccatcgttgataaaaatgcaaagtcaaataaaaggtgtcttggtttgatgtcatagaatgatccaaggagagaaaaaaggtagtt

SEQ ID NO: 13679 - DNA, 192 bp, Homo sapiens
agtggagcaagagattatacaggaagacaaggtcgggtgcagtggctcatgcctgtaatcccagcactttgggargctgaggrcgggtggatcacctgagatcaggagttggagagcagcctggccaacatggtgaaaccggtctctactawaaatacaaaaattggccaggcatggatgacatgcacccgt

SEQ ID NO: 13680 - DNA, 355 bp, Homo sapiens
ttttgtttttactaggaggtgcatggtttttatttctgtttcaaaagtaaattaaacagacctctttacagcacatcctgtatgtcctagtccaaatgtttcctaatgcacgtttgtctttttcattgtttaatatagatggccaaagctccatcagctgctcgaagcttaccatctgcstctacttcaaaggctacaatctcagatgaagagattgaacggcaactcaaggctttaggagtagattagtcaaaagaagtcatactattttgcttacttataattatgtagtataaaccaagcacagtgcagatttcttttacaaaacacatgtattttgcaaaaaaaaaaaaat

SEQ ID NO: 13681 - DNA, 463 bp, Homo sapiens
ccacttgttctattaagtcatggttttgcaaatggtcaccatttaaatataagggacctattttgcttctttcatattcttcgacatttcctcaatgaaagaataaggaaagtttaggagtgagttacttagggtgtattctactctgaggatttcagttttactatagctgtatttaatcttatattaattgggcacttatattaatttagtgcctgtataatgttggcactgaaatggttctttagtgtgttgtgagaaaatttcaatgaagtcatttatagaaaactgtttttctcaagggaatttccctttcsccttttcagaagtcagaggaaaaaaaaactggaattagagtatagagttagagataaagcgaaacgatggcagaatatgctgagacatttgctcaggggttaaaagacagggagtttatagaactcccttttctgcttgtcataag

SEQ ID NO: 13682 - DNA, 424 bp, Homo sapiens
aacgtttccaagaatcagataaaagaggacaaaccttagggagaagaaggcagctgctcatttccagcaggggaagtagctgcatagagtacaaggactggtaggcctgttggctgttcctgtttaaggagacaagatgggcatggaacagggaccaccccctcctctgggagaagctgttacccccttcacttttcctcctctgtcattacccacaatcactctccttctttgcgctatggtaggtgtttacccatcataggaatgggcatttgaactttgaaactgaatgtggtgattacacttcatgctgaagcttttcacatgagtgctttcataagcattaagtaaaattttataatgactgcagtccaaggacattttccctggtttttggccagtctaaatattgtaagagagagag

SEQ ID NO: 13683 - DNA, 454 bp, Homo sapiens
catgatttaggaaagtttccagaccgggtgcggtggctcacgcctgtagttccggctttttgggaggccgaggccgcggatcgcggggtcaggagatcgagaccatcctggctaacgcggtgaaaccccgtctctactaaaaatacaaaaaattagctgggcctggtggcgggsgcctgtggtcccggctactcgggaggctgaggcaggagaatggcgtgaaccgggaggcggasttgcagtgagccgagtttccgaatttgtgttgagcagcattcaaagctgtcctggggcgcaasggctgtaggttggacaggtttggcctagagttttcttggcctctctaagcctgcttccttccttctgaatatsgggcaggacattctctggaataggggtcttatgacttacagtcaaacaacatgggtcagataatttaatttattcatggcca

SEQ ID NO: 13684 - DNA, 505 bp, Homo sapiens
atccttaatattcattctaaatgagttaacgacttaacttgaaattgggcctaaggagtgagaactacaaaaatacaaaatgcttgtccaggactcagccatgcacaccttgagcagcgccggcaggaggcacggaaggaactgtgctccgttctcctcactgtcatggtgccaccagtgtctgaagggcagagtgacccagactgcaggcagtaactgacttcacacagtccctggcatttagtcatctgtgattgttttatcactctggactgtgcagagccacctgccaccgagatctgcattccgactgcctatgaacgggtgtgggggccgggggctggcttgctgaagtcttcaacttgcactcggagctcctttgatacctcagagctggctgtcaggtggcagctcacacccagactcactggccacacctcagcagggggggagtcgagtgtcagtctctttctgtgaaggstttttttttctttggccatgaggg

SEQ ID NO: 13685 - DNA, 173 bp, Homo sapiens
caaaatcttgcagccattaagtccttcaaagtcaaacaaacacaacgcattctctatatggcagctgaaacagccaaggaactgactcctttcctgctgaaatcaaagattttatctcccagtggtggcaaacccaaggccatcaaccaagagatgtttaaactctcatccat

SEQ ID NO: 13686 - DNA, 376 bp, Homo sapiens
  misc_feature 149: n=a, g, c or t
atggagacgggtttcaccacgttggccaggctggtcttgtactcctgacgtcaggtgatccacccgcctcggcttcccaaagtgctgggattacgggcgtgasaccgtgctcggcccaaggcaggagaatctcttgaagccgggagssngaagttgtggtgagccgagatcgcagccactgcactccagcctgggcaacaagagtgaaactccgtctcaaaataaataaataataaaggaagaagtcagctgggtgcagaggctcatgcctgttaatcccaatactttaggaggccaaggcaggaggatgcttgggtctggaagtttgagaccagccagcgcaacatagtgagacctgtctctaccaaaaaaaaaa

SEQ ID NO: 13687 - DNA, 469 bp, Homo sapiens
agccagccccttccttcccaggcttcacacacacaccccaggaagccccgcgtgcgtcggactctctgtctagacatcatctgatttttatttgcaaatgcaggttgccaggtgacaggaaccttttatgcttgtgccccacctgagtcccaggctcccggagtccccacagagccaagcataaggtctgccgaagccttggcgttctcaggtgagtgcagggtttgctcctggaggcaccgcagaggccagcctctgctgccagctctgtcatctttgggcagattcgatgggactttagacacttgctttgctccctctggggtctggagtagatgtagacacatcctgtgagtgaggtgaccagggtgatttaggagcaccattagaaaacctgacatcactgcttgtggttstgctgaccgtttcagccactggcttgaatggagtcattttggmttcttcactg

SEQ ID NO: 13688 - DNA, 291 bp, Homo sapiens
  misc_feature 263: n=a, g, c or t
agtagcttctcaggtgattcagatgctcagtcaggattgagaaaccaggactcttcccagccctcctgttctctgatccacttctctgcttcctccacgtcctaacgattctccagttcccgcacagcaggagcgagggaagaggggagagatggcaccgctaaggaccgcwggccccgccagcggcsgacctccccattccaggggcgccasggcggattacataacgggcctcggggcgcgttctcgsaggtttccaccgncccctcctcgctccacgtcagagggaac

SEQ ID NO: 13689 - DNA, 402 bp, Homo sapiens
taaaataacttttctattttaagatgcttttctgattcccaagatgaaaagaatagtaatcaatgtgggagttaaaaataatcatttctgttcctattaatagcttaactctggatatcatttataatagtccagtctccccatagagactgcctaaggctatagtgttatgctgctttggggtgggagcagtaggccaagttcaagtcccaactcggaatttgtgtgtgtctcttttgaaggggggaagggactctggaatatgaattatcttcacttgttaatcctgaacatgcctctgactcatgagtggcagcagtcatgggagcaactccagcctttctcagcagatgtcactattactgtgtatgttgaagtatttacaaaaaaaaaaaaccaaag

SEQ ID NO: 13690 - DNA, 510 bp, Homo sapiens
ggaggagtttagagggaaacgactggtagaaagagatgagttgggccggacgcggtggctcacgcctgtaatcctagaactttcggaggctgagatgggtatgctttttctcaagaagaacacggagctgttagtcaggaagaagtcatccgtgcttatgacaccaccaaaaagaaatccaggaagaaataagacatgaattttcctgactgatcttaggaaagagattcagtttgttgcacccagtgttaacacatctttgtcagagaagactggcgtcagagccaaaacaccaggaaacacatttctgtggccttagccaagcagtttgttagttacatattccctcgcaaacctggagtgcagaccacaggggaagctatctttgccctcccaactcgtctgcagtgcttagcctaacttttgtttatgtcgttatgaagcattcaactgtgctctgtgaggtgtgaaattaaaaacattatgtttcaccaaaaaaaaaaaaaaatg

SEQ ID NO: 13691 - DNA, 492 bp, Homo sapiens
catcttcaaaatagtggggtgtaccagttatcaatttgttatctgtgagctctaaggtacaccttgctttgcagtgttgaaactcgatgcttgtacaggtttctcctttgtgagcaggttcagtgttaggctttttcattggagggacacagtaaggcaatagcaaggggaataggsttctctttctggttctggtgtgctgttatttgattggctgccagcagattggcctgcagaaggtcagtctcacctcaacaaccttcgtaagggtggcccacaccttcctttcaagtttctctgctgcctggtaaaatgtccctacagaacacctttggcctacccagaacctccagtgattcttctaccgggtgaggtgctctgattcgatcagctctggmctttssccttggtaaatttcttccatctacagcccaagttcctgtggcaactatgccctctccaaagagttctgagtctcagccctgggaatag

SEQ ID NO: 13692 - DNA, 100 bp, Homo sapiens
cacttacctagatttacagcctcacttgaatgtgtcactactcacagtctctttaatcttcagttttatctttaatctcctcttttatcttggactgaca

SEQ ID NO: 13693 - DNA, 511 bp, Homo sapiens
acaatatggttgagtcctttgatttttgtttacataaacacttaactgttaaaaataataaaaaagcctctcttaattgaagatattttattatataatgaaacaaaacaagctcttaaatcttaagttgaactctcagaacatgtaaatagatttatatatgtgtatctgctcaaaggagggagagggcagaatgtgttaatgttttgggaggcagggggtggagcagtggtggtgatacattgattacattacagtccttggcttggatgactcatgctgatatttgtttaaatcttacttgaccatttagtatacagtcacttaataaggttgagaaggctggataaaagggtggttcaaatcasagctccatcatttagtagctgtttgatcttagacaatatttcttacccccctaaatttgtatttcctcatctattaaaacagaactattaatggtacttacatcataggattgttgagaaaataggattgttaagagtgactg

SEQ ID NO: 13694 - DNA, 229 bp, Homo sapiens
tgaaatatagagagcttgaacttgagttacttaaagaagatacagtataattaattatacagaacaaaacaaagatgtgtttagagtgactctggcctgactcttgtccatcagcccctagtagcctatcttcagcctttgggaagtcttaacttcccaggttaaactagaatattctggaactgagctgtccaaatttcatcttaaagtggatcatttgactctgaaa

SEQ ID NO: 13695 - DNA, 513 bp, Homo sapiens
gtggagacaggttttcaccatgttggccagtagtgtatttagttatttaaggagggctcaatcaacaggtttaaatggtgtgctattcataattattgcaaaaataggccgggcctgtagttccagcactttgggaggccaaggcaggtgaatcacttgaggccaggagtttgagatcagcctggccagcgtggtgaaactccatctctactaaaaataccaaaagtagcgggcgtggtgacaggtgcctctaatcccagctactcgggaggctgaggcaggagaatcgcttgaacccaagagtcggaggttgcagtgagccgagatcgcgccattgcactccagtgtgggtgacgagcgaaaatccgtctcaaccaagaaaaaagaaaaaaagaaaaagaaaacttaactggcctttggggcacatgcctgtaatcccagcttcttgggaggctgaggcatgagaaaaaaaataaacctgggaggtggaggttgcagtgagttgagattgtg

SEQ ID NO: 13696 - DNA, 472 bp, Homo sapiens
cctaacaacatttgtcactgtctttgaattatgacccaggcaagatgatttcagattttctaaaatcttgcctgtgaggttttgttcatatcagtgcttcattttgtaatgtcttctcaagaaaaatacctatgttaactcacaagtataaaatatgtgtgtattataaaacaatgaaaagtgtatttttggagatagtcaagcatttagaagtgcagtgaacttgctgtcacggagtaaaatgctaattatgtttcactttcctagcctagtgaaaaagaaaagtgctcttgagtacaataccttaattatttcttaaaatactgactttgacctagctcactgtattttttatttaatggattatggattacagtatttttcttctgagttaaattttcataatttatgtgaagacacaaagatgtttaaracaatgattattcataagvatcatgatggtctcagtatt

SEQ ID NO: 13697 - DNA, 312 bp, Homo sapiens
tattttctagaagagttttaggtttaaagaaaattgaggtcaggcatggtggttcacgcctgtaatcccagcactttggggggccaaggcgggcggatcatgaggtcaggagtttgagaccatcttggccaacatggtgaagccccgtctctggcaaaaatatagaaaatgagtmaggcgtggtggcgcgcgcctgtggtcccagctactcgggaggctgaggcaggagaattgcttgaacccgggaggtggaggttgcagatcgtgccactgcactccagcctgggcgacagagcgagactccatctgaaa

SEQ ID NO: 13698 - DNA, 424 bp, Homo sapiens
caaatcaattctgtgacttttaaaaagttgacaatgttgtcagatttaaaccagtgtggctagtaaaaagcagctcactcaatgtgggtggctccctattcctttacgctccccctatccctaccccacaagcctttcgattataaaatactaccaatcttgttataagattactgtggagtagtcaagtactccccgggccttctgagctggtggaatattttatttcagactgaaaacagagagcactctccttgggaagggaaagcggasttgctgagtgagagatggagcctcatggtgtacaactgagggtagttaactcatcacttctcccaagcactcgatcccagcttcacccactggtgttgctttgcttgaactgttcaagccttttatagccttaccataagtatttagatat

SEQ ID NO: 13699 - DNA, 130 bp, Homo sapiens
acacacatcttttctgcaggataagaaatatcagtttccttgcacactagcagaagtggttcatttccactggaaacttaccagaggcattctccaccagatactgcatttccttaggaaaagttttacc

SEQ ID NO: 13700 - DNA, 266 bp, Homo sapiens
attttagcgccgcccgccgtcgccatctgtttcccttccctcccccatacctagcccgagtctgagccctaacgagaaggctgggcctaggccgctggatgctggagtgaaaggaagggagaaagggaaaaagcgggaagagtcgagaaggctgagtgttaagaggccaagtgcgacgcgcgtatccgggcagacggactgacggacgggcccgtgcttctgccgcggctgcgcccggggcctcttaaccactgatctttgaaata

SEQ ID NO: 13701 - DNA, 466 bp, Homo sapiens
  misc_feature 451: n=a, g, c or t
ctagatcgagtaaagaaacctgaatgggttatcctgataggtgtttgcactcatcttggctgtgtacccattgcaaatgcaggagattttggtggttattactgcccttgccatgggtcacactatgatgcatctggcaggatcagattgggtcctgctcctctcaaccttgaagtccccacgtatgagttcaccagtgacgatatggtgattgttggttaagagactttgactcaagtcataggcttctttcagtctttatgtcacctcaggagacttatttgataggaagccttctgtacttgaagttgatttgaaatatgtaagaattgatgatgtatttgcaaacattaatgtgaaataaattgaatttaatgttgaatactttcaggcattcacttaataaagacactgttaagcactgttatgctcagtcatacacgcggaggtncaatgtcttttagct

SEQ ID NO: 13702 - DNA, 366 bp, Homo sapiens
ctatcctaagagctgcatttttctactgctctttaccttgcattttagctaatttaggagttttgagaatgtattggatacgctccagtacataaggagttgccgcatattatatcagactgctttgagaaatctcatccctagtctattgcagttgtttctattagcttactgattaactcagtcctgacacaccttttgggaaatgctgatttaaacttcttaactggcaacagttggaacagtaatcagtttgctaacatatttaaagtcttgaatgttgaagaactcatgtgatttacccttttcaactttttggaaaacgatttaatttattctaattagattaaccctattaatctatgg

SEQ ID NO: 13703 - DNA, 446 bp, Homo sapiens
atcatggcggctcagaaagatctctgggacgccattgtgattggggcggggatccagggctgcttcactgcataccacctggccaaacacaggaagaggatcctcctgctggagcagttctttctaccacactcccgaggaagctcccatggacaaagccggataatccgaaaggcgtacctggaagacttttacacccggatgatgcatgagtgctatcagatatgggcccagctggagcacgaggctggaacccaattgcacaggcagactggattactgctgctgggaatgaaagagarwtcaagaattaaagacaatccaggccaatctgtcgaggcagagggtagaacaccagtgtctttcatctgaggaactgaagcaacgtttcccaaatattcggttgcccaggggagaagtggggctcttggacaattccggagagt

SEQ ID NO: 13704 - DNA, 479 bp, Homo sapiens
cagaatggatgttttattagcaaacatgaaaacattaatctcccttctgcatctccatcagagcttttgggtgaccaagtgcactgtcaatgggtgtagtattttgaaaggaatgtttttttctgagcagtagttctcaacagagggcttaaaatattcagtaaaccatgctgtgaacaggtgcgctgtcatccaagctttgttgttccatttctagagcacaggcagagtagatttagcataattctcaagggctctaggattgaagcactggcttcaacttagccaccagtggccaggtgcagtggctcaggcctgcaattccagcactttgggaggcagaggtaggaagattgcttgagccaaggagtttaacaccagcctgggcaacatacagagaccctgtctgtacaaaaattaacaaattagctgggtatggtggagcgtgctatagtcccagctactcaggaggctgaggt

SEQ ID NO: 13705 - DNA, 462 bp, Homo sapiens
aggatatgagaaaggtaatattggtaaataaagaaataggaaaccattgtaacaratgttaagtacagaaatacattaatgggtggtaaataaagatgtaaaagaaggcaatgcgatcgatggtggcaaaagatcatcacagattaagggctatggctggtccacttctagaaaaccacaggctgtccattaaataatgaacatctaagtgaacaagtcagtgagtatctaaatagacaaggatgaggtgaatgagaagacatggccccatgggtcctcctgatgagggtgttggggtcccccctggcaccccagctgcatgaaaatgaaggacaggaggtatggaaagctatgacagaagagagaaaggaacggtaaaaagaaatwacaaccaaatggataaatgggtagatccacgagaagagttaggctaggacttgtcataagggcactgactccact

SEQ ID NO: 13706 - DNA, 474 bp, Homo sapiens
attcctctcttctccctgaagctagagtgaggtccctcttggcagcctttgtatctagagagagccgtccaatagaaacataaggacatctgagtttggatgttacctttttattggaaatatgggatctgcacttagatttcactgaatttacattgaaaagagacaaagtctcactatgttgctcaggctggtcttgaactcctggcctcaagcgatcctcccacctcagcctcccaaagtgttgggattatagacatgagccactgcacctggccgaccttgggcaagttcttaaacccttcawagcctcatttttctccaatcacaaaaagggaaagatggtaatattttccccaccaaattcttgtcggatgccctcacagaattgagattatgtacgtaaaacaccaggtgcctaaacccggcacagagcaggagggctaagcgtgacatccagcacgtggtcagtgg

SEQ ID NO: 13707 - DNA, 203 bp, Homo sapiens
attgcatcattattaatttttgctattcatccactatggcattgcatatcaatcagtttaattacacttaatgttgcatgagtgatattttggtctgggtttcctcttaagattttaggtttgtctgaattaaggaaaaatgtttttagatatacattcttattttgtcccacccctccagaaataagctggaaatcttaact

SEQ ID NO: 13708 - DNA, 486 bp, Homo sapiens
tttatctgtagccaggaaagagcggggctggcggacggtgtttccctcccgtgagttctggcacaggttgcgagttataaggactcagcatcatgtagaagcacttgtggagcatcagaatggcaaggttgtggtttcggcctccactcgtgagtggctattaaaaagcacctttatagtaccagaaatgtggtggcttgtgagagtataggacgagtgctggcacagagatgcttagaggcgggaatcaacttcatggtctaccaaccaaccccgtgggaggcagcctcagactcgatgaaacgactacaaagtgccatgacagaaggtggtgtggttctacgggaacctcagagaatctatgaataaatggaagcattaattgttttgaacatgtaaatataaatctgtcagccactacagccatcaaaagagagcatctggaagaacagccagcttggaagttttacagcaataatgttgcag

SEQ ID NO: 13709 - DNA, 431 bp, Homo sapiens
  misc_feature 393: n=a, g, c or t
gcatgcctggaatcccagctgcttggggggttgaggcaggagagtcgcttgagcccgggaggcgaggttgtggtgagctgggatcgctccattgcactccagcctgggcaacaggagctaaactccatcttaaaaaaaaaaaaaaagagagagaaaaagaaagaawtkttcccaggagaaaccagcagaagagtggggaaaacaggacagsaaaggggaagaggagcaagaggtgayttcaggtgaagttccaacctcagcctaatcstgcagggagstccagagcacaaattaagttgtggagtctttcctgtcttgggacacatggaactgggcctttgtatctccctgtttgagcttattatagccaaacaacagaccaggctcagtggnaaacgcctgtgatcccagcactttgggaggctgaggca

SEQ ID NO: 13710 - DNA, 425 bp, Homo sapiens
gttgaggcgagtggaagcttcgagttttttttttcttccttttggcttactgcgcaagaagaagggtaacaagaggacggcggcgatggcgaagaggctgctcccatctctgaaccgggtgctggttgagaagctggtgcagcccaagaagaccgccggcggcatcctcctcccggaaacatccaagcagctgaatgctgctaaagtggtggctgttggccctggtgagcgcgacaaggcaggcaatctgatcccagttgctctgaaggaaggtgacactgttctcctgccagagtatggtggaactgaagttaagcttgcagctgataaagagtacctcctcttcagagagcacgacattttgggcacacttgtggactaattcagagcatcagcagcctgtcactagtcgttggttctagact

SEQ ID NO: 13711 - DNA, 468 bp, Homo sapiens
taaactgaaaatgctatacgaatgtgagattgatcttgtatttcaatagtcccaacaatatcactgcattgttatattaggtggaataaaaggacaatatttaactgttttgactctacaatagtgtcaatttagttgtgttcatctctattttataaaatagggatacgcatactgtagaaaatttcctgttaaattaagctttgacggccaggtgctcacgcctgtaatcccagcactttgggaggccaaggtgggcggatcacttgcgctcgggagtttgagaccagcctgagcaacgtggtgaaatcctgtctctacaaaaatatgtatatataaatkagtcataatctcagctacttgagaggctgaggtgggaggatcacttgattccagaggcagggcttggttgcagtaagcagagatcacgtctctgcactccagcctggctgacagagtaagaccgtg

SEQ ID NO: 13712 - DNA, 358 bp, Homo sapiens
  misc_feature 228: n=a, g, c or t
gttgaccgggagaaacgagatgggggtgaagctggagatatttcggatgataatctacctcactttccctgtggctatgttctgggtttccaatcaggccgagtggtttgaggacgatgtcatacagcgcaagagggagctgtggccacctgagaagccatgagtaaggaaccgagagcagaggagtagatggtttccttattgccttctcctggaagagtgaagcgnatcccacgcggacccctttgtaattggcagggggcttccagtgaagacactgaaccctgaagccgtggtctggggcagggtggtgggagakgtgggcgggggggggtggtcccggctctgaggtgtgtgc

SEQ ID NO: 13713 - DNA, 498 bp, Homo sapiens
tcttttatctgggcaaaaattaaaacacattccttggaacagagctattacttgcctgttctgtggagaaacttttctttttgagggctgtggtgaatggatgaacgtacatcgtaaaactgacaaaatattttaaaaatatataaracacaaaattaaaataaagttgctggtcagtcttagtgttttacagtatttgggaaaacaactgttacagttttattgctctgagtaactgacaaagcagaaactattcagtttttgtagtaaaggcgtcacatgcaaacaaacaaaatgaatgaaacagtcaaatggtttgcctcattctccaagagccacaactcaagctgaactgtgaaagtggtttaacactgtatcctaggcgatcttttttcctccttctgtttatttttttgtttgttttatttatagtctgatttaaaacaatcagattcaagttggttaattttagttatgtaacaacctgacatgatggag

SEQ ID NO: 13714 - DNA, 465 bp, Homo sapiens
atgtttgcaagaaggatatataaccaaaattggtgaaatgttcagattatttttatctgatttaagtgtaaatggtgtcatgtacagatttggatttcacaaaaaggtttagatagaaatgagtaacattcaaggttagtatttttgcatattaggcttctaatactttttggacttgaaatcagaatgattttagcaaattcttactgaactcatgttgatatttctctcttctcagaggaagaaattgttgagcttccagatttggattacctgcgaaccatgactcatatagtctttgtagattttgataactggtcaaacttttttggtcatctaccagggcatctaaaccaaggaacatttatttggggctttcaaggtacggttaataagaaaaacaaaagaaaaccttttcccacctcttagaatatagttcagtttaaaaggctcctcttaaacctt

SEQ ID NO: 13715 - DNA, 467 bp, Homo sapiens
tttcagttgcctctcttagatgaatattaatgacttacatagcattttagatcagtggatgtttttgtgattcttttatttgagctttggccaaagataacagtacccacaggttttttccagctactcgctcttctcccttcagtggccctcgagcctggaaaatctgacatgacaatttgcttgctcaacctaccactgtttttcttttgaaaagtttggcagcctgtttctgactcctatgaaggtgaattcctcagcattcacagtttattagaaaaatactttgcttctctccaaactcgaaattcaagataaccaaacctatatataggctgatctttcaggatgcagttgtcatgttgatgccatgcttttcagtatcgtggccatcatctgttcagtaggggaggtgtacttctgtaatgggaggtggtggttatgtgtgtgtgcaagtgtttatttgg

SEQ ID NO: 13716 - DNA, 499 bp, Homo sapiens
ttagagaaaagattggccccattgccacaccagactacatccagaatgcacctggcttgcctaaaacccgctcaggaaaatcatgaggcgagtgcttcggaagattgctcagaatgascatgacctcggggacatgtctactgtggctgacccatctgtcatcagtcacctcttcagccaccgctgcctgaccatccagtgaacatgatcctgacctttacctaggattcctcctgctccaaactttgcccatcctctttgccccctcaggagtgctgagggccagtgttgacccacactaccctcccttgaccagctgtctgggaccggaaaccagctttgtctccaggtagagacaacatcctgtgactgccaggcagaaaggacagggcccaggtcagcctcagtctgctgtgcctccagactgcagagctctcagaacccagaacagagacgaaaaggctacctctcctacccaagttaagttgttcaaggggat

SEQ ID NO: 13717 - DNA, 504 bp, Homo sapiens
ctcaaacacaccaaactcattcaagtctctgccttttacttcacccaaaaagcccttgcttggagcttctcgctgcctacgcagattttaccattccttcaagatcctgtgtgaagtgtactacctgttagatgcttttcctactcctactattttcctgcaaattctcgggtgatttttaatttagcaaaccaatgaacaaaaatctgtgtagtgtcttctatcacacactcttgtatcttcactaatgtaaacattttgaatacaaacaccatatcttttagctaaatctttcacagttcctagcataaggcggaggaaactgattttgaagagaaagaaaaaatagtaaatgtatttcatcatgcttatctaaagtcaactcaggccgggcacagtggctcactcccaaagtgctgttattaaagtgatatagccagctgccgttggagagatatagttttgataataacagctttccatcctatagaactatagattagg

SEQ ID NO: 13718 - DNA, 489 bp, Homo sapiens
acatttcgttagaggcagaggcaggattcagacccacagatagccttccattccaaggaagtttctttgcacttcacaccactatctggtaaaagaagacttatccgttttcttgtatgcatcagctcatctttggattgaacaacacttcagctctccaagctttatttagcagctctttctgggcactgaaggtatgaaactatatgaaatcaatcttgctgacaaaaagctctagtaataaatttagatggggaaacacaagattactacaagataataaaaataaatacacagtaaagaagaaagtcagagtgtggggtgagtagcagaagaaaataaatgtatatacatgtgaaatatatgcttagataatatttgtaagagtgagaagaaaatcagtacacaactttaaaaacatgacatcttaattctgtactttcgttatttacctaaccaaatagttttaagccacactctaaatgacca

SEQ ID NO: 13719 - DNA, 420 bp, Homo sapiens
  misc_feature 43..44,239: n=a, g, c or t
aacccagaaacatagaaggcgtgtacaccaagawgaagccggnnaaccaaccgactcccccgaccctcctgatcgatcgagggccccttgttctagccagttgtccccttccctctcgccggcgttgctcctgcctgctccaatggccgctgcctctgccgccgcccccacgaagacggcgaacatccccgcgacgatgcgggccgtgcagtacgactcctgcggcgggggcgstgggnactcaagcatgtggaagttccggtcccttcggccaaaaagaatgagcttctgctgaagctggaggcatcaagcatcaacccagtggactggaaggtgcagaaaggcatgctgaggcctttcctgcctcgtaaattaccttttatcccagtgactgatgtggcaggagtcgtggctgatgtt

SEQ ID NO: 13720 - DNA, 507 bp, Homo sapiens
taaaaaatcctgcacatgtgtcatgctggagccctattgattccaacagggatggcgccttgtccaagaagagacccagagccagtgaatgggacatagggtttatttaggacttaaatacagatgtggtccagtggcagtgggctggacaggaccgctactatttgtaaagagtatgtagtttatataacatttctacttagcactctccacttagcaacctccatttaacccaaaataaaaggccttggttccttgcacatcctgagttccaacggacaggcagggagttcaagtgtccttcacagataagaagtgaatctctctgggttggccattcccggattccttagcttagactctgaacacatattcttcttagaccatacagtcattctcagggtatgcttgagttaatgctgtcggatgcatctgtcatacaaagtgtttaacatatacgatttcatgattttggaaatatgcatacacccatgatatcactggcac

SEQ ID NO: 13721 - DNA, 487 bp, Homo sapiens
atctagtcctttgcagtcgttagtctttttgatgcttaaattgtttcatctccatccagtgggagccattcaagtttgctcctttctcccgttgacatgagcctactcctgtctctgatagcttgctggcttctcggcagtgagctttcacaggcttgttttgggaatagtcagcccctagttttgaaaccacttttataaggaatctcatttactttttgttagaagatgtagttagagaacacagtctgggttctctaggattttkttctttttcttgtagagcttttcagagttcagatctgggtactattgtttcttaaaaagagaaaaattctgagtttattgatacctttccaattcagatttttttattgagatggagttttgctcttgttccccggctggagtacaatggtgcgatctcggttcacagcaacctctgccttcgcagttcaagtgattctcctgcctcagccacccgagt

SEQ ID NO: 13722 - DNA, 468 bp, Homo sapiens
aagagtacttcagatcatcctaaaagcagcatcatttccaccaggaacccagcttctaccagaaaagagtgctgggaaatggtgcttctggattatccatctgcaaaataaaagcaattgcaatttctgcatgactgcaagaaaaatagatactattccttagtatgctattttacaagtttcttaaaggttatttgaaatttcagatggtaacaagcttggaattgtctttttcttcagctatggactgtatcaaagtttatgggctataactgtattttggtttctgtcaggcatcaggatagctcatttgcatgactggtacaaaatttacttattcagtgaatcatgctcagctgctgtactgttcaatctgtaataataactgcagggtgactgactaacgataactaatcttctctcaactacaaaagcatgtaaattagtaaaataaatgtttagttgtgt

SEQ ID NO: 13723 - DNA, 372 bp, Homo sapiens
ttacaaagttcatttaggtgctatacagacagcttgaaaaatgtaagactagttttccatttatgtagtggtagatttttaaacaagtatgttttaaataaatgagtggaggaaactaagacatgtatgtggacataacagggatgatgaaggtgatatcacaaggctgacacataccagcttacatgagtgtgaaattccacagcacaatccttttaggatcctctaaaatgggtatctctttggtcatgtgcccctcgggtatggcagttgaagcatcaggaaccttcctgactgttttcattggcagttgagtgttagagatttgtatgccaaattacttcttaataatgcttatactacttcacattt

SEQ ID NO: 13724 - DNA, 116 bp, Homo sapiens
caaggcactgggtggcagcaaccttttttctagtagttttttcccagcagttttccatttctccacagtatccttttcatttagaggagcttaataaatgctttttaaaaagtaaa

SEQ ID NO: 13725 - DNA, 483 bp, Homo sapiens
ttcaacttttcatttggatgtttggcgttgcacacacacatccaccggtggaagagacgcccggtgaaaacacctgtctgctttctaagccagtgaggttgaggtgagaggtttgccagagtttgtctacctctgggtatccctttgtctgggataaaaaaaatcaaaccagaaggcgggatggaatggatgcaccgcaaataatgcattttctgagttttcttgttaaaaaaaaatttttttaagtaagaaaaaaaaaggtaataacatggccaatttgttacataaaatgactttctgtgtataaattattcctaaaaaatcctgtttatataaaaratcagtagatgaaaaaratttcaaaatgtttttgtatattctgttgtaagaatttattcctgttattgcgatatactctggattctttacataatggaaaaragaaactgtctattttgaatggctgaagctaaggcaacgtta

SEQ ID NO: 13726 - DNA, 454 bp, Homo sapiens
ttcacatttaatattttaaatattaatatttraatgtktgcatttaatactttttaaattctgcatttaataatttgaatttaagacttgtaagtccattgtacttcattgttatacacattattgttctcttctctcttttggtgtttaggaatgctttgtgttaacacaaaggccagggtgagagctgcaagccagggaaagatgaaccgaggcatttagattaccacctacattggcttgccagacagaagctctgcctggggataaagatgaggataaacataaggcatttggtgtttcctttgtgtcctgacttagaaatctgaccatggacgatggaacgggaaactcacattttagggtgtattaatagctctctttagtcttgagaaatatcagtgaggctgaaagtgccttggaatgactttgcaggtttaagatatgaatggga

SEQ ID NO: 13727 - DNA, 510 bp, Homo sapiens
aggattaagtaatgaatatgttttgtggagctttctgaatctgagattgaacaaggtggagagatacaaatcatccctatttacctttttaaaaattgatctgtttattgatgtttttgttattattcaccaccgtatttggaataggactgttattaaaccaaagcctgaaaacaaaaccagtcagtatttgctgctgatattcctaagaagttcagcatctgagcacttacagtcttttcataaaatatgtgtcactttacttttcgagaatgttcaaaatgtatcatttgtagtgggttttcccttaagtttcccaatatatagaatcagaataacaattaaatacataacccaatcttggattttatacatcaggaaactaagatctgcatacttctttcattttatatattgcattttagaatagcaaaaacaatgtattaatgttataattattttgagggatgaagtctaatctcagctactcgagaggccgaggcaggagaa

SEQ ID NO: 13728 - DNA, 458 bp, Homo sapiens
cttctagtttgcaggacttgtggtagacagacagaataatatcctggacctcttgggtgtatacaggacaaactgaaataaactctcatttttagatcataatgtcatcatgaaacatatcaattcggtctatttctgaagaaaacaagcacaatgataaagtttgaatgtttgtctcctccaaatctcatgctgacatttgatccccaatgttggaggtggggcgcactgggaggtgttttggttacgggggcagatccctcatgaatggcttggtgctgtcttcatgggattatgttctcactcctacttcctgtgagatcttattgttaaaaagaatctgataccttcctcccctctcttgctctcttcctccctgatcatgtgacacacgggttcccctttgccttccaccacgatggaggcttcctgaggccctcaacagaagcagatgctgg

SEQ ID NO: 13729 - DNA, 417 bp, Homo sapiens
ttgtttgtgtatctgcctaaactcattgagagttgggactatttcacacatacagtgcctggcatgtagaagggacttaatgttgaaagaaggggaggcattttaaaatccacatcaaaaaaatgttgttctgtttgggagtggtggctcacgcctgcaatcccagcactttgggaggccaaggcgggtggatcacctgaggtcaggagttcgagatcaacctgagcaacatggtgaaacccatctctactaagaatacaaacattagctgagcgtgggggcgggatcctgtagtcccagctacttgggaggcttaggcacttgaatgagaatcacttggacccaggaggtggaggttgcagtgagcaatgattgtgccactacctgggcaacagagtgagactctgtcccaaaaaa

SEQ ID NO: 13730 - DNA, 137 bp, Homo sapiens
attatgaatatgttcaagtgaggccatttagaagactgcagcaaatttgttgtgtgatgatgaagaatcagtcatccccaaattctctcccagagatgtttacaaagcatccttattaggtgatttctggagattgt

SEQ ID NO: 13731 - DNA, 370 bp, Homo sapiens
agagtacttcagatcatcctaaaagcagcatcatttccaccaggaacccagcttctaccagaaaagagtgctgggaaatggtgcttctggattatccatctgcaaaataaaaccaattgcaatttctgcatgactgcaagaaaaatagatactattccttagtatgctattttacaagtttcttaaaggttatttgaaatttcagatggtaacaagcttggaattgtctttttcttcagctatggactgtatcaaagtttatgggctataactgtattttggtttctgtcaggcatcaggatagctcatttgcatgactagtgtgattcctatataattgaataaccaattaaaatgaatattaataaaa

SEQ ID NO: 13732 - DNA, 113 bp, Homo sapiens
aaaaaaaaaaytagstgggtgtggtggsgcacgtstgtagtccsagctgsttggaggstgaggsaggagaatcgstcgaacctgggaggsagaggttgsagtgagacgagatt

SEQ ID NO: 13733 - DNA, 408 bp, Homo sapiens
ccttatctgcacccacctcccctgaaaaagagagaaaaaaaaaaacctggttttgctttccatgtataattcaacaacacaaaatgggaccatgtcagaatctgtatgatcctattctgtgttagctccaatcagccagctgagagccatcctaaatattaataggatgagagagtaactcctaactgtgcataaattacagccttaagaaagaaggccacccggtctctggggacatgttttgggagggtgtggctgcctcatatagcctacctttgctttaatcagcattttatsagtcaactctgggattaatgaacatatccgactttatgggtatgtgtatattcagtgccagtaccacctcccaggctaatgtgttamagtgtttyctatgattctaaactt

SEQ ID NO: 13734 - DNA, 472 bp, Homo sapiens
  misc_feature 401: n=a, g, c or t
ttaatattgaagaggctaaagaccgtctccgcattctgatgcttcgcaaacacccaaggtaccgatggtcaaatttagttggtgtgtcaggtcccatgtcccaataagatgtaactactgacctcttgagaacatcatgcctttttcctgctgttctatagggaggataagagagaaccattgcggccgggtgcagtggctcgcgcctgtggtcccagcactttgggaggccgaggctgttggattacctgaggtcgggagttcgagaccggcctggctaacatggtgaaaccccgtctctactaaacatacaaaattagccaggtgttggtggctcatgcctgtggtcccggctgctcaggaggctgaggcaggagaatcgcttgagcccgggaggcggnaggttgcagtgagccgagatcgtgccatgtgcactctagcctgggcaataagagtgaaactccatcataaa

SEQ ID NO: 13735 - DNA, 263 bp, Homo sapiens
ttctctagagaagtcctctcttccaccctcagtctgtgtcatcagwtagaaaaagccccaagcttcacaagggggagtgtgatcgaggcctggcsactgatgccatttcatcmtcctggcctccctgactggtccgtgcctgggcatatcgcccaactcagtccaatgagattaaatctcaggaatttacatggaattctttggaaagagactcgatttsmtctgggmatgccgaactgatagaatgaagtcgaaattttggt

SEQ ID NO: 13736 - DNA, 483 bp, Homo sapiens
caaatgcaagtaaggtagtttgggctccttaattccaaacatcccatgagtatatcaagatgaataagdgaccaagggacctctgtgactcatagaagggctggctgaatcctgaagtagcatagtgggacctggtctacaatttatgcacatgcactgacagccttgctgtgccacgtgtctcaccaagacccagttgggaaagagcgtcatattgccaacaggttgggtttctctggcctacacctgattaatgggccctttatctttggtgtcccctaggagtgtccagttgttttattgctgtattttgttattgcagtacttaataaaaattgttgatagggcccaaaaccctacagaaattctatgtctgtaaaaaccaacaaaggcattggacttgtgtgaatgtacagggtttttttagtagtaattttaaatttaaaatgttttaagtgatcatcagtgttcctttttacttat

SEQ ID NO: 13737 - DNA, 476 bp, Homo sapiens
  misc_feature 34: n=a, g, c or t
caatattaccacacagtaccgaggggaaaatccnyscccgtgattaaatcacctcccaccagaccccacccctaacaccgagggttacaattagacatgagatttcagtggagacacagatccaaatcatatcagctactttggaagacagtatagaagtttctcttaaaactgaacgtactcttaccatatgatccagtaatgatactccttggtatttacccaaatgagttgaaaacttaacacacacacaaaaaaaaactaacccacacatggatatttttaggagtttcagtcataattgccaaaatttgaaagcaaccaagatgtctttcagtaggtgaatggaaaaataaactgtggtatatccagagagtggaatatttttcattgttaaaaagaaatgagcaggccaggcacagtggctcatgcctgtaatcccagcactttgggagttcgaggtgggtggattgcct

SEQ ID NO: 13738 - DNA, 282 bp, Homo sapiens
  misc_feature 58: n=a, g, c or t
attccgggacgagcctccagagaccaagcgggataggtaaacccgccgcgcacgtggnaccggctgggccaacgaggtctggggtcttggcgcggagttcatgggccgccggcaggcttgtgccagtggctttggatccctggcctgcttcccccaacccagcctccagaccagcgctggcctgctccacacactccgcagcaccgtcccgggaaccgagcgtcggcgggaggccgcstctccgcagtaggtctcggcgggcstgatcccttggaggcgcgt

SEQ ID NO: 13739 - DNA, 469 bp, Homo sapiens
attttcaacccagagtgtgacttccccgcagccctggcccaggccctctcacaaggaggaggcaggagcacgtgcaactgaacaagctgtgaagscagccgggcacagaacccccggggtggaaggctcccctgtgaaaatgcaagaggaaaggcgcaaagaaactgggcctctttgttgcccacgctggttgcaaactcctgggctcaagggatcctctcacctcggcctcccaaagcactggaattaacaggagtgagctactgtgcccagccaagcttgttattttcttagggagaggacatcttagtggcaagagcacatgtcttgcattggtctccagcagatttgaactcatcctacctctgtgccctcagggaatcttcccaacctctctacatggaagcatcctcatctgtgacatgaagcaaagaacagttccttcccgtgcaggctctttttgggatta

SEQ ID NO: 13740 - DNA, 348 bp, Homo sapiens
aactttttgatctgagttgcttttcataggcttttaaatttcaaaacgtttgaatgaagtactctatgagctttttcatttcatgtcagcaattctcaaacatcgcctggctttgttaacctggtccttgaggtaagattgagggtgggtgggcagggtattttagaaaacagcccttttaacttcatctgtgatcacttttcagggctgttgcttaactgtccatatgttgtgtttctgtgtaattgtttctgtgctccaccgtatgaagacggacagagggcttgcaaagacaaaaataaatacgtctcttttttttaaaaaaaaaaaaaaaaaaaaaaaaaaaaa

SEQ ID NO: 13741 - DNA, 357 bp, Homo sapiens
agaaaccctaggagacaccgcggagaactctgcctctgagctggtgggcgggccggatgtagccgagcgcggacagggctagtccggacagagtccagagccatgggagcgaaaagagactgctgcggattaaggaggcctttcggttggcgcasagccacaccacaaccaggcgaasagagatagagttttgctcttgttgcccaggctggagtgcaatggcgcaatcttggctcaccgcaacctccacctcccgagttcaagcgattctcctcccacaacctcccgagtagctgggattacaggcacccgccaccacgcctggctaattttgtatttttattagagacggggttt

SEQ ID NO: 13742 - DNA, 483 bp, Homo sapiens
ttacagtgagccgagatcgcactgctgtacccagcctgggccacagtgcaagactccatctcaaaaaaaaaagaaaagaaaaagcstgtttaatgcacaggtgtgagtggattgcttatggctatgagataggttgatctcgcccttaccccggggtctggtgtatgctgtgctttcctcagcagtatggctctgacatctcttagatgtcccaacttcagctgttgggagatggtgatattttcaaccctacttcctaaacatctgtctggggttcctttagtcttgaatgtcttatgatcaattatttggtgttgagcctctcttccacaagagctcctccatgtttggatagcagttgaagaggtgtgtgggtgggctgttgggagtgaggatggagtgttcagtgcccatttctcattttacattttaaagtcgttcctccaacatagtgtgtattggtctgaagggggtggtgggatg

SEQ ID NO: 13743 - DNA, 396 bp, Homo sapiens
gaagatcagcttggataaatctgaatcaaagaagcgcgacaattctggacagtcaacttcccatgaaataaagtcccctttttacagttctgcaacatatctgaaatgtgacattttctaaatgcctcccttaaaaaaaaaactgctgaaaatctgtgctattttgaaattgatttggcatttttgtgcctaatggacatacactgtgggagagaacctgtcaaaatgtcgaagaaggaaggcgaagaatcaagtgatctctaggcaaatgccttcaagttttccagttctgaggtaactagttcagtttgttgggatggaagcatgaaggaaagggctagagaagtatgaaatctcgaatgtgtaatacctgaaaatttaaacacttgaatgtca

SEQ ID NO: 13744 - DNA, 468 bp, Homo sapiens
cttactattggattcactttagttccgtgcctttcaaatagttttgtttcattatgccaacctcaggacctcctcaagaagtggggttgaggcagaagaaaatgttcaaccctctgtctcctcatccagacctgttccttttgagccatctcatatagtgggggctgcatggatatgttttaagtaacagagttcctctgcctttaaaaaaatgtttgaaaactaagccgggagcggtggctcatgcctgtaatcccagcactttgggagaccgaggctggcagatcacttgaggtcgggagttcgagaccggcctgaccagcacggagaaaccccgtctctactaaaaaaatataaggttagccgggcgtggtggcgcatgctctagtcccgactacctcgggaggctgaggcgggagaatcgcttgaaactgggaggcggaggttgtggtgagccgggatcgcgcc

SEQ ID NO: 13745 - DNA, 480 bp, Homo sapiens
agttagtctatttgtataaaatttttaaaaaatctaaaagaaaaagaaaaaaaacaagggtgggttgggtattccagtgggaagatcattgaagggaaaaatgttactatttactgaggtatttttcacagaatgattgaattaaaaaaaactcaacttgcattttcattgtgggtgcttagagaagttctacaaaattcaaactgtgaaggtttatgcttcattaattatgaccatactttttcattttctgacgatccctgatttccttatggactcaataagaatcttttatatcaagtaaaatgaaagttgatgatagaatatcaaatagtgaatttgatatgaaatctaagagtgtgagtcacttgcatatgtaatgctttgggtttttgcatattttcttaggtcacagtgacaggtttctgagttgtttcccttttcaagtctctgggaggccagtggcagcagcaggtctgt

SEQ ID NO: 13746 - DNA, 449 bp, Homo sapiens
aatttcagtgcgtggtgccctcgaagcgcccgcggastacgggaggctaggcaagtacggttcagaccgcctcctcatcaaaaacagcctctctggmgacsttcctgctagatcgacctttcattccttggaaagagtctcgcacactgtgtgatcatcgtttgagcccaaagtgctaaaatacaggtgtaggtgtttgagaagcgctgtagttgattatggacgaaatgcctaatttaaggagcagaggcggagtggaaaatgaaaaaagcttcaccgcagtggagacttgttaacagccctggggagaaaggggcttaacagagtctggaaatcgtgaaagagcttgaccgatgaaatgggcctggctgtcgtatcggtaatttggtgaatgttgcttaagatcagcctggaaagtagttagtcagatccgaagtgacatatttgca

SEQ ID NO: 13747 - DNA, 462 bp, Homo sapiens
taaaataaaatttatgttcacttaaaaacttgtacgtaactgttcatagcagacttattcaaaacagcaaaatgtgaaccaatccaaatgttgtgtcaacaagtgtaaagcaaaacatatgacatccatagcatggaatactactgagtaatcaaaaggaacaagcaagctatagataacctgcaacaccttgaatagactacaagggtaatgtgcttagtggaaaagcttatctcaagaggtcacatattatatagttccatttatatgacattctcaaagtgacaaaactgtaaagatgaagaatagattagtgattgccaggggacaggggggtagtaggtggaggggctataaatacagagaggtagcagaacagttctgtatcttgattgcagttgtggttataaaaatctatacatgagacaaaactgcttagaaatacacacacaaatgcaggtt

SEQ ID NO: 13748 - DNA, 491 bp, Homo sapiens
tagaattgttttaaataaattgactaaaagtaaaattcttagaaacatgcttgcacataataagtcctcagtaagtgttaaactgctactgttggttatagatcatgagaactgagtaagtttaagaagtccagagacttctacctgataagtggtagagccagtgattaaatataggtgatctgaatctaagtcctacttgctaatttatctagttgcctttaccatattttattatatgtttatttacttattggacataaaattattagccttctaaactttgatttaaatgtggactggctgaatgcggtggctcacacctgtaatctcaggactttggaggttgaggtgggagggaattgcttgaggccaggagttggaggctgcactaagctgtgatcgtgccactgcactccagcggtgacagagtgagaccctgtctgaaaaaataaatgtgggccagaccatagaccaagtagttatagcaa

SEQ ID NO: 13749 - DNA, 361 bp, Homo sapiens
  misc_feature 331: n=a, g, c or t
accacagcatccgcagttccccgaccacaccgttcctccgagcccaggagcagccccgcgccaggaggaagtttgttcttttaacaatatgtcgagggaggagaatgtttacatggccaagttggctgagcaggctgaaaggtatgaggagatggttgagtatatggagaaggtggctaagactgtagatgtggaagagctcactgttgaggagcgtaaccttctgtctgttgcatacaagaatgtgattggggctcgccgcgcttcatggcgcattgtttcttccattgaacaaaaggaggagtcccgtaagaacgaagagcatgtgaancttatcaaggaatatcgtggcaagatcgag

SEQ ID NO: 13750 - DNA, 287 bp, Homo sapiens
aataatagaggtgcttttaaggaaggaaagggcttctggagactcatgcctggattgtgcatctgccccggagcagaatggaacagggaatttccccctgccctggtaactggaagaaatgacactttaaaaaatcaaggctaggcacagtggctctcatctgtaatcccagcactttgggaggccgaggtgggtggattgcttgaggttaagagttcaagaccatcctggccaacatggtgaaaccccgtctctactaaaaatacaaaaattagccaggcatagtg

SEQ ID NO: 13751 - DNA, 436 bp, Homo sapiens
  misc_feature 18,399: n=a, g, c or t
aagtttaggctgcgctgnyccctctcakcsccccctccaggtgaccccagcccctgaaaatcctcacccagggccccaaatctcccagccccatgaccgccaaacctctcgccctrgccccctaaatgccccaggccccggagatgaccggcctcctcaccccttaacttccagtgcctcccaaatctccaagcccaccctgtcccgtggtggcaactgaggcttctcgggggcatcagcctcagattacctgagaaactgggcagcctcgtcctgagaatgacggagaaggggactggggctagggaatccctgattcaatcatgccgctccccaggagacgttcggagcccaggacatgtcgggaatgaggagatacgaggtggcgctggaggcggnaggaggagatctactggggctgtatcgataccgtcga

SEQ ID NO: 13752 - DNA, 59 bp, Homo sapiens; identical to SEQ ID NO: 13084

SEQ ID NO: 13753 - DNA, 63 bp, Homo sapiens
  misc_feature 51: n=a, g, c or t
aaaaaggaagtaggaactgtccctggctttcaggcbccaacatcctccccngtcaagatgtgg

SEQ ID NO: 13754 - DNA, 477 bp, Homo sapiens
aatgattatttagatgatgactgaaaatgtgtataaagtaattaaaagtaatatggtggctttaagtgtagagatgggatggcaaatgctgtgaatgcagaatgtaaaattggtaactaagaaatggcacaaacaccttaagcaatatattttcctagtagatatatatatacacatacatatatacacatatacaaatgtatatttttgcaaaattgttttcaatctagaacttttctattaactaccatgtcttaaaatcaagtctataatcctagcattagtttaatattttgaatatgtaaagacctgtgttaatgctttgttaatgcttttcccactctcatttgttaatgctttcccactctcaggggaaggatttgcattttgagctttatctctaaatgtgacatgcaaagattattcctggtaaaggaggtagctgtctccaaaaatgctattgttgcaatatctaca

SEQ ID NO: 13755 - DNA, 461 bp, Homo sapiens
ctgtttgaggctcagcctgtcttgtttcccttgaagcctttgctacaaagcggtgccatttggatttcgatttctgcacgcagagtgatcttattgctcctaattccctaggatttcacggaaattgcttgagttcctgtttcagtgtgtttcttgttctagcagtgatttttcttttctttgagacggagtcttgctctgtcgcctgggctggggtgcagtggcgcgacctcggctcactgcatcctccacctcccgagttaaagcgattctcttgcctcagcctcctaagtagctgggattactggcgcgcgccactacgcccggctaatttttgtatttttagtagagacggggtttcaccatgttggccaggctggtcttgaactcctggcctcaggtgatccgcctgtctcagtctcccaacgtgcggggattacaggcctgagcaccgcgcccgg

SEQ ID NO: 13756 - DNA, 93 bp, Homo sapiens
aacgatccggacgccgcgagctgacccgctctgctgttgggcgatttttttttaattgcagaaaaatttattaaattggaaaatcttgcgttt

SEQ ID NO: 13757 - DNA, 493 bp, Homo sapiens
tagataaactcctggatacatccagcttctcagcattgaaccagaaagaaacagaagtctcgaacagagcaacaatgtataaagtatataataagattgaattactaataaaacaagctaccaaccatagaaagccctggataagatgagttcacagccacattttatcacatatacaaagataacctggtattaattctactgagtgtattccaaaaatcaaggtggaagtccttcctaaattatttgaaaacattattatcttggtagtaaaacctagtgaagacacaacaaaaaaggaaaattaccggtcactattcttggtgaaaattgaracaaaaattcatgaagtactagcaagttgagttcataagcaaagcaaaaagttactttgccacaatcatgtaaacttcattgtatgaatgcaaagatgtttcatcatatacaagtraataaatgtgattcaccatgtgaagataatttttaaaaaaca

SEQ ID NO: 13758 - DNA, 433 bp, Homo sapiens
gataaggaaactgccagctgtcgaaagttaaccagcagagaggggaagatggcccaggagccagcccctcctgagttttaaactacactgttttctgtccagatattccaatggagacagttggaaaacctgtacttcagagaaaagaagttttccgtggaagttcatgacccacgcagggcttcagtgacaaggaggacgtttgggcacagcggcattgcagtgcacacgtggtatgcatgtccggcattgatcaagtccatctgggctatggccataagccaacaccagttctatctggacagaaagcagagtaagtccaaaatccatgcagcacgcagcctgagtgagatcgccatggacctgaccgagacggggacgctgaagacctcgacagctggccaacatgggcagcaaggggaagatcatcagc

SEQ ID NO: 13759 - DNA, 61 bp, Homo sapiens
attctkccctcgagcccassggcaacgaaagakaagctctatctcccctccakgagsscag

SEQ ID NO: 13760 - DNA, 437 bp, Homo sapiens
  misc_feature 18: n=a, g, c or t
agtttaggctgcgctganccctctcarccccccctccaggtgaccccagcccctgaaaatcctcacccagggccccaaatctcccagccccatgaccgccaaacctctcgccctggccccctaaatgccccaggccccggagatgaccggcctcctcaccccttaacttccagtgcctcccaaatctccaagcccaccctgtcccgtggtggcaactgaggcttctcgggggcatcagcctcagattacctgagaactgggcagcctcgtcctgagaatgacggagaaggggacctggggctagggaatccctgattcaatcatgccgctccccaggagacgttcggagcccaggacatgtcgggaatgaggagatacgaggtggcgctggaggcggaggaggagatctactggggctgtttctactttttcccctg

SEQ ID NO: 13761 - DNA, 60 bp, Homo sapiens; identical to SEQ ID NO: 12480

SEQ ID NO: 13762 - DNA, 207 bp, Homo sapiens
  misc_feature 16,24: n=a, g, c or t
gccaggagtgggagcnrgcggcgnggccagctgcgttctgagcctgggcgcmstgccatctgctkctgggaagcaccagggtgtccccgccgccctcagctcgaagtcagcycascatggaggcgcaggcacaaggtttgttggagactgaaccgttgcaaggaacagacgaagatgcagtagccagtgctgacttctctagcatgc

SEQ ID NO: 13763 - DNA, 335 bp, Homo sapiens
  misc_feature 274,289: n=a, g, c or t
aatagctgccttagacattatgaggtatacaactagtatttaagataccatttaatatgccccgtaaatgtcttcagtgttcttcagggtagttgggatctcaaaagatttggttcagatccaaacaaatacacattctgtgttttagctcagtgttttctaaaaaaagaaactgccacacagcaaaaaattgtttactttgttggacaaaccaaatcagttctcaaaaaatgaccggtgcttataaaaaagttataaatatcgagtagctctnaaacaaaccacctgnccaagagggragtgagcttgtgcttagtatttacattggatgccag

SEQ ID NO: 13764 - DNA, 493 bp, Homo sapiens
gtagtaagggttttatgaatgttgattattttgtgccaacagcccagaattgtcacttatatgtaagcagaaaacaatgagctctgcttccaaagttatttaattttctcagtgtttgaatgttattttttgtaagtgtgttaataaaagtgtaaagaattggaaaaaatataaatattcttaactcaagcatttgctggatcatttttctacaaaacttgtttgtacaatataaaacactctctgaagagttgactttttttcagtttcgtatcctggaaatcacattttgtaaaactggggaccattcataattgtcagatactttttaaaattatctcaatacatcacttttataaaaaaaaaaagtttttttgaaagaaaattagatacatatgtggccccagatgtttgtataactctagaatgatctagactatgtatgtttaaattaactttttattgaatgtacaggtgtccatttttgacgtta

SEQ ID NO: 13765 - DNA, 115 bp, Homo sapiens
ctgtatttatgtgtgaggagctgctggcttgcagtgcgcgtgcacgtggagagctggtgcccggagattggacggcctgatgctccctcccctgccctggtccagggaagctggc

SEQ ID NO: 13766 - DNA, 459 bp, Homo sapiens
csacctakctattaccatgaatattttagtatacttgstttatcacatatctstccatttatccatcccacagttctgggtgatttttaccatttttctcagcccccassatcccttttttttagctagatgatgctcacttttataatctctcattatatagatagcsacatcaatattgtgatcttttgggtagaaaatttaagattgataagtttttagaaaacagcttttatggctaatggggcatttaggatatagttaagctagatgtggcttrgtttcacttaatgaagactaagaagctttaattatacctacaatataattttratttcatgtcatcccttaaaakcaaccattttkttcctctccagctgttttctgacaccattttctaaattttctagaaacatgaatgaagattgagaaagawttttgctgtgcagccttccatat

SEQ ID NO: 13767 - DNA, 543 bp, Homo sapiens
acatggggcccgagctcggaggcggccgggcggcgcggagtcctcctggatcgccaatgggcagacacagagcagaaagtkggcggacttgggcggccacagagcctttatgaccgaaagatggraactgaaatgccatcctgttatcaagaarggagcataagramcagctagaggagagatgcaagattgaaatatcatgggawtkggmywwtggtttatcctctcttctggtcgtaaaacaccatcaggttgtaattgttcagatcagaaattcccaagcttttaataaagcctttcagggagcctcatccaggggcaactgccctgtcattgggaataagtagagtgtgtgggaaatatgttgtccttggtaaaacctccccttaggaaagaaggcaagagaattgagtaagagaatgatggccccaaaaggagaaaatagagaaagaggctgcatgctacagagaacaagagcaaaattcaaaagcctggcacagttgagcttgaaccatctgtgtaaaggggactaataatgctgac

SEQ ID NO: 13768 - DNA, 392 bp, Homo sapiens
acatgaagagctggggccaggtcctgatggatccgtaccagcaaaatgactcgcctgaaccactgagaggtgatgggacttcaagcccagatcttaagagatctagagcttttgctttctctctgagaacccaactgccttgtaaagaagttcaggctgtccagctgtagacagcagcaacgtggagaaagawgccttgaaggttgagtccacatggaggaaaagagaggcatcccagctaagagccagcaccagcgtggcaaaggaggccatcttggatgcttcggtcccagttgaactgtcccagcagacaccatatagggcagagatgagctggccaaaattctaactcgaaaagcgttgtggttttagatccccaagtgttttcttca

SEQ ID NO: 13769 - DNA, 97 bp, Homo sapiens
  misc_feature 86: n=a, g, c or t
agaagccgcacttgttagtgtggggggaggtgggggcgggggacgcgacaccgtcaccgtcacccagggacgccgaggagaagrsnggaggggggtg

SEQ ID NO: 13770 - DNA, 178 bp, Homo sapiens
aaaaaatacaagaagtagccgggcgtggtggtggcgggcgcctgtagttccagctactcaggagcctgaggcagagaattgcttgaacccgggaggcggaggttacagtgagccgagatcgcgccactgcactccagcctgggcgacagagccagactccatcccaaaaaaaaaaaaa

SEQ ID NO: 13771 - DNA, 463 bp, Homo sapiens
taggacagtgtggttcccaaactggctgtataccacaaacaggtacggcattctgggccccggccctaaaacattcattaagtctggggtgaagatttggaatcttgaatgcttataaaggttaccacatgactagggtacagccagatttggaaaccatagcttgaaggcagtgagggagccatgaaatgtttttaatagggggactccagatcagatgtgaacttaacctgtttctggctggctagcaaccagcatggaaaacagattaggttagatgttcatgctgtatgtgcccgtgcctgtagcttccctgttaatcagcttcttacactactatatttgcttattttgtctctgaataagctttaggcaccacaagggtgggcctggggatattttgcttaccagtatagcccctgcaaaaaagcacagtgcctgacacaaaacaggcacccagtaa

SEQ ID NO: 13772 - DNA, 396 bp, Homo sapiens
cataacttctacttccttttaagtgtcattaaaatatctcagaaaaccagaaacattatttgatatctgccaaatactttcagataaaatacagtctttaaaagagtgacaaggccgggtgtggtggctcacgcctgtaatccagcactttgggagactgagacaggcgaatcacaaggtcaggagttcgagacctacttggccagaatgsgaaatcccgtctctactaaaaatacaaaaattagctgggtgtggtggccggtgcctgtaatcccagctacttgggagactaaggcaggagaatctcttgaacccgggaggtggaggttgcagtgagccgagattgtaccactgcattccagcctgagtgacagatcgagacctcatctcaaaaaa

SEQ ID NO: 13773 - DNA, 313 bp, Homo sapiens
ataaatatttaaaaacaaattaaaggccgggcgcagtggctcacacctgtaatctcagcactttgggaggctgaggcgggcgaatcacgaggtcaggagatcgagaccatcctggctaacatggtgaaaccccgtctctactgaaaatacaaacaaaattagccagacctggtggcatgcacctgtagtcacagatactctggaggctgaggcaggagaatcacttgaacctgggaggcggaggttgcagtgagccgagattgcgccactgcactccagcctgggtgacagagcaagactccgtctcaaaaaa

SEQ ID NO: 13774 - DNA, 582 bp, Homo sapiens
atgtaccaggccctgtgcccgagtaatacaacaatattaacatcaccttttggtagataaggaaagtctaagaccggacaacttgttcaaggacacaaagccaacatgtgttagaaccaggacctgccggatcagtcacataaggcttagaggatcaaggatcctgcccagatgacttaccgaaatgttacagattaagttggtgtggtaacctgggctgagcactctgggagaggaagagaagagagaagacaggaaacaactgaactatgaccaatcccagcacggaggcccagaaaactttaagatttgagtattaatgtctcaaggtcaggagcaacctcaaggctaaaactcagatctcaggactcaatttcacagaagttccactataaaggcaataatctaaagctttaaatgatatgaaaattttgtaataagagttcagtatttctgccaacattggcgcatggattgcaaagttcacaggattgaaaacaccatcgacataatggaaattgaacagcatctgattactgagtgctatatcagcaagttaaaaggatcttttgcatacctttt

SEQ ID NO: 13775 - DNA, 507 bp, Homo sapiens
cttaggaagtgcccctttgatatttggaatgtggatatatttataaaacaaatggattgttattccaaatccacatggatttataaccaagccccagaagaataggcagctttgaaatagctagttcgtggaattgaacagaaccttgatggaatgcagttgcctgtgtgaggacagaaaacaaagaggctgcctcagaccacatgcctatctagagattaagtgaatttgtgagggacattttgtggatgccttaaagatgaccagtggtgggttctgatgggaatatatacactcatctggactaggccaatggaagcagtctctttcagttcacctccgtacagcacaagttgttcctgctcatgacctcattgaggaaaatgagaattgtggtgctggtgactttcatgtgtcttgggaggttgaggtgttcaacatcgttaaggcactcccaaaacgcaaacctccttttttaaatgccaattgtacatctacattaattca

SEQ ID NO: 13776 - DNA, 342 bp, Homo sapiens
ctgatacacttggggggacataaagggaaacccacacacccaaggaggagggctctggccatgcaaggctgaaggccagtgtactgatatgaaaactgaagctcagacagaagaggcgacgttgctttcttaaccactggatttgcagtgctgtggttctcagaagaggccaggacaggttaatccactcgcttgggagaaggaaatctttccatatcacccaggctgatcttcaacgaactggactcaagtattcctcccacctcggcctccagggttgaatgtacagctggtataaaaatggtgctttgtcgtcatgaagaaggtgtattctgggatcaa

SEQ ID NO: 13777 - DNA, 407 bp, Homo sapiens
ctgagggtggtgatcccccatcacggagttcctggtggcggtgtacggtttcgaatctacataacacgcctgtgaccctttcctggacacaatgcagacagttgctcgcttccgcacctgtaccaccacacaatctagtataacccttatgtaatttattgacctacgtttgtcttccctactagacctaattccttatgtggtcaaggactgttttttttaatccacactcaactagtgattgttgagtgaataaatgaacttaccctcacctccctgtcttcgctaatagcatgtcttcgctcttaagtcggttccttcaaccagtgttcaagatcccatcccctcgctagtctattaatagatcccatgggaaaaatgaaataaatttttaaaatcacaaaaaa

SEQ ID NO: 13778 - DNA, 475 bp, Homo sapiens
aaaaccttgtctctactaaaagtacaacaattagccaggtgtggtagaggacacctgtaattccagctactcagtaggctgagacagaagaatcggttgaacctgggaggcggaggttgcagtgagctgagattgcaccagtgcattccagcctgggtgacaagagtgagactccgtctcaaaacaaacaaacaaacaaaaaaattagtgggccgggtgcaatggctcacgccggtaatcccagcactttgggaggccaaggcgggcaggtcacctgaggtcgggagctcgagaccagcctgaccaacatggagaaaccccgtctctactaaaaatacaaaattagctgggtgtggtggcacatgcctgtaattccagctactcaggaggctgaggcaggagaatcgcttgaacccaggaggcggaaattgcaatgagccaagatcacgacattgcactccagcctgggcgccaa

SEQ ID NO: 13779 - DNA, 534 bp, Homo sapiens
aggagtactgggacgattccgcggascgggcagaggttttaggggtgcgcaggagtcaagtggtggttcagtggggacggaatgattaacaaaggcgtccgaagaaatcgttgttggaaggtgaccaaggtggaaagagacgttgctttggccctgcaagtaagaagagagagggaatagcctgaaggagtaacactaaatttaaaatgacacttttttaccaaccagcgaaasagatgttcaaaggggatattggccagagtctgtcacactaagatgagaaatgtcctttcttcctgaaggtgtctgatgtgtaaaaatatgatatactttgtgctgtttcctcccttcccttttgcatattattctgaaacaacattaactagttactttgcgtcattgaaggtatgcacttcccctctatgttaggagtgaataaaattaaaaatagatccttataacaaagaaaggcagatagaatgattaaaaatgaccaaaacatgttagaaacagtctctcaggtgtatgcagatg

SEQ ID NO: 13780 - DNA, 348 bp, Homo sapiens
ctgggttaggagaagtaatgaatgtatccatttgtacatggtttacatgttgtggatgctttgtaaacattttcctgtatgtttaaattgtgtttcagcaggatgtaattgcccttgtgtgtagttaaaatgagtcatcatctggtcctttgtgaaatggaattcatggtattttctgtaacgttttcctgaagctgtttctggagagccacacatttaaatacagacagctttcctgatcatttgatttattgtgcacctgatttttggtctaaaaggaattattgccacaatatatttkatttattctttagattttagccttgtaagttaaagtgctttacatga

SEQ ID NO: 13781 - DNA, 454 bp, Homo sapiens
gttttttgcttaggtatccagctcccgtccgcctgtgtgtggcggastgctgggtaacggtgtcgaatagcaaaccttgggggctggcgggaggtggcttatcttgtgggtagatccctctcgagcagccgtatccacctctcggctctgcttatctctaagtcccacttgctttgaagcatatctctaggaatcccccttctgcagtcaccgaagtgtcacctgaccttgcgcctaggggacctaatttatcttttatgtatcttactgtaagaggtgtggagtttggcctactaattgaacccccagttcttggataaagtccaccgacagttactgggcaagaaatttttcagtgatcagtggaatcaattttcccaaatcttggtcttaggcagtgtcgtgggagtcttccttagaattgccttgtgattgtccaaactatcccaagaat

SEQ ID NO: 13782 - DNA, 485 bp, Homo sapiens
ctctctcactggcagcaacccagcgcttccattgctgacctctaccgacctctacctgtggtccttcctctactgcagcagagacactgttttcttcctttgttcttccaaccccatggcacagaaacactctccactgcggccaaggattgcaggagaggtggcatcagtgattcaagacttcttttcctacctcttcagtgtttctttcagtgatctgaagttaaagccagggggaatatcacagaagtgaagtgcaattctcatcatgtcatatcaagagcacacactaacaaacaacatgacttattgctgaatattgaacttgatcacctggctgaggtagtgtttgccagatttctctgtaaaggtgaataaactgacactggaacattcaggaacttcttcatggtcatggtcacccagctagagtgtggaagccaggctgtctgattccaggatctgtgttcttaatcctatacata

SEQ ID NO: 13783 - DNA, 134 bp, Homo sapiens
aatttatcaaacactccggctgacagaagaatgcaagttaagctctctgctgccttggcattatcaaccagcccaagttccattctataaaatctccagcaagcctttgtctccttgcagtcagctcctcttct

SEQ ID NO: 13784 - DNA, 266 bp, Homo sapiens
taaaaaacttttattatggccgggcgcggtggctcacgcttgtaatcccagcactttgggaggccgaggcgggcggatcacgaggtcaggagatcgagaccatcctggctaacacggtgaaacccgtctctactaaaaatacaaaaaaattagccgggcgtgatggcgggcgccmtgtagtcccagctactcgggaggctgaggcaggagaatggcgtgaacccgggaggcggasttgcagtgagccgagattgcgccactgcact

SEQ ID NO: 13785 - DNA, 417 bp, Homo sapiens
cttaccaggaagcagatacatatgagtgtggaagccggagggtgtttatgtaagagcaccttcctcacttccatacagctctacgtggcaaattaacttgagttttatttattttatcctctggtttaattacataatttttatttttttactttaagtttcaggatacatgtgccgaatgtgcaggtttgttacataggtatatatatgccatgatggaaatatttatttttttaagcgtaattttgccaaataataaaaacagaaggaaattgagattagagggaggtgtttaaagagaggttatagagtagaagatttgatgctggagaggttaaggtgcaataagaatttagggagaaatgttgttcattattggagggtaaatgatgtggtgcctgaggtctgtacgttacc

SEQ ID NO: 13786 - DNA, 499 bp, Homo sapiens
gctgttccctggtcctggcttttgagaaaagagccagcagcctctggtcttgttgacaccatcatctgagagtggcaggccaccagagggaagggctaaggacagagccagatctggctgggccatctcaccttctggaggccgaacttgacccgggatggaaataatgaagcagccactggctttcccaaggcctgtgatcctcctggtcaccagaaatcccaagttcttatctcctgctcttccagtctcctctgttagggtactggttcccagcgcagagcttctgtgattaccagaagaacactgaaggagtcttcttgtctgtctggagccagctgagatggccctgagatccacagagcctcctccacgcccctggatggaggcgctcctgctcttccaccctttgtatctctcacttggcacccattcccgtaattaatcacaaactccgtctgagctattcctttctaagccatgccctctgtactctgac

SEQ ID NO: 13787 - DNA, 478 bp, Homo sapiens
ctctgaaatctacccttgcaagcttcagacaaatcagttgatctccctgagccacacggcctcattctgtgagggagggaaagattagccaaagagttaattttcattccaaatcacttagctgttagactgatctgtttgtagcagttgtttgtctcatttttgctctgtgcattttttgagacatttgttgagaatattctatttggtgctctactgtatttttctttttaatatctacttgatatcttgttctttaaattttcttcacatatggtttgcctgatacaactgatttttataactgaaatttaaggaatctaacagctaaaactcagtaagtgcatctatttccttataacatagacccgttgctactctcagcaccctctcctcaattttttttcctgtagcatgtgatgcctgattaaactcattttcatttgcttttatttctaatatggggacaatgagagtg

SEQ ID NO: 13788 - DNA, 605 bp, Homo sapiens
aagggatacccaggcaatccccgaaactacaatgcccaaaatgctccaagtgggacgcgcccagagtgaaggagcaaaggggactcggccgccatgttaggagtactgggacgattccgcggascggggcagaggttttaggggaatgattaacaaaggcgtccgaagaaatcgttgttggaaggtgaccaaggtggaaagagacgttgctttggccctgcaagtaagaagagagagggaatagcctgaaggagtaacactaaatttaaaatgacacttttttaccaaccagcgaaagcagatgttcaaaggggatattggccagagtctgtcacactaagatgagaaatgtcctttcttcctgaaggtgtctgatgtgtaaaaatatgatatactttgtgctgtttcctcccttcccttttgcatattattctgaaacaacattaactagttactttgcgtcattgaaggtatgcacttcccctctatgttaggagtgaataaaattaaaaaatagatccttataacaaagaaaaggcagatagaatgattaaaaatgaccaaaacatgttagaaacagtctctcaggtgtatgcagatggtaa

SEQ ID NO: 13789 - DNA, 472 bp, Homo sapiens
arattttcctgaaaccatacatttctagtgaaataagtaattctagattaggamcaatttaaattggataattttaaagtgtctataattgcagtggtttatttgcaaaattcctaaaaggaaaaattttatcactgccatcacagcaggtttcctcatccagatgaggaaactagacaaatgctagtgtgttttaactagctaaacaaaactaagttaaatgaacatttaadagtttccctagcgggccattccttagcaaaatgttggaatccctgttgctacattgactaaaaggtcatgatgaatggaatatgtaagacttggctcatagaaacctaatcagatggttagaggtgttggcagtttaggacctgctgtcataaatgtgtgaacaaccttttgtaacctaacctattgacctgcatgttttttctttaccccaattcattacatggaggctcaatcttga

SEQ ID NO: 13790 - DNA, 239 bp, Homo sapiens
aacagtttggcctttcaaggagcagactgggtttgccctggggactcccaagtttctctgggccccagctctgggctaggagccgtgggcacgagaagacagggctccttcctacctgaggtgaacaggactatggccttgaggcagctgtactcggctgagtcaacgtgcagcgccttgagcttctccacttgctcttggaagatccgtatgtggtccataaaggcgaccacccggtc

SEQ ID NO: 13791 - DNA, 500 bp, Homo sapiens
  misc_feature 493: n=a, g, c or t
taaaagaataaatacttaaacgtgaaaggtgactaaatgcggggaagaaagattgcaaataaatacatgggccaaagatgtttggtttgcccatggagttttaattaaaaaaattaataaggaaaacaaatacccaaaataaggaagactgacaaatgagtgagtggatgagagagtgaatggtgcttgacgtaggagcagtagtgctttagggaccagcatgaaggtggtgaccgggagccctgattcatgggattctgtccacctgactttataagaaccaagaatggctgggaatggtggctcacgcctgtaatcccagcactttgggaggccgaggtgggcggatcatgaggtcaggagtttgagaccagccagtttgagatcagcctggccaacatggtgaaattccatctctactaaaaaaatacaaaaattatgggcgtggtggcacctgtctgtaatcctagctactcgggaggctgagagaggngaattgc

SEQ ID NO: 13792 - DNA, 449 bp, Homo sapiens
  misc_feature 418: n=a, g, c or t
cttccgtacatcattatttccatgctaatgtgtgtctgtgatccagaataacttctcccactcatatcttcagttcacctaatgaaatgaatggatagcaagagccctttgttcccaggactttaaggcaaaatattaaaaattattgccaaaattaagaatataatgtttgtataaatgtccttgaatttgccatttaaattaactcattttcttttcactttgatttgaaagctgataagtatttctgcagcagatagaatattaaaatcaggttgtgtgtacacactgcactatgaggtaccttggtgtcctggtgtgaatagacaagaagctgtactatatgttgctctctcagtggcaacaatgaagtttttgcaattctagaacttggatttttttttaacaaaagtcccanaacaccaaaaatgtgaacaagataagagatt

SEQ ID NO: 13793 - DNA, 433 bp, Homo sapiens
  misc_feature 32: n=a, g, c or t
awatcgcaaatatggcgcsggagcggctgcgnascgggcgctctccgccttcaagttgcggggcttgctgctccgtggtgaagctattaagtacctcacagaagctcttcagtctatcagtgaattagagcttgaagataaactggaaaagataattaatgcagttgagargcaacccttgtcatcaaacatgattgaacgatctgtggtggaagcagcagtccaggaatgcagtcagtctgttgatgaaactatgtatgtgggtacagttaactttttwcctccttggagtgttattgagcacttattttkaattattgtcttggaaaattattagtgatcaacgtttctacagtgattactgttgttatttctgtgtgtctttttaaataatggctttctttgcaaacctcattattaaatgactcatctt

SEQ ID NO: 13794 - DNA, 394 bp, Homo sapiens
acaggttgaggctactaaggtacattttgctgggccaggctgggcgggtccccgggatgggcagccctctcgacgagcggcgacgccgtggttgagtctagaaagctagagttgctggacagctatcgcgggagscggagggaagtgggaggtctggacggagtgtgcacgtgttggcagtctcgctccgccgtcggagccaccaggtcaaacctgtgctggccctggccaaagaaacttctgcgggtcaggctgctgttgccggtgcagttcccagtacttcctctggggcgtttttcaataaaagccaaacgcccttgctcattttcagggaaagacctgtttcctcctgctctttcctctccacggatactctccccaccactaaaagggt

SEQ ID NO: 13795 - DNA, 507 bp, Homo sapiens
gtggggctgctcccctgctggccagcctggcccgggagtggtgctggccacaggctcccgagatttcctgtgcccagggcaacagatgtgtgttcagcctgtgccgcggctgctgcaagaagcgagcctccaaagagactgcagactgcccaggtcacggattgctttttaaaaccaaattggagaagtctctggcctggaaagaggcccagcctgagctgcaggagcctcagccagcagcacctggaacaccaggtggcttctccgaagtcatgggcagtgcctggcctgaaggccacaacccccacccccaggactgctgctggagcctggacacgtcctacttaagaaaatgccttttactcagggaatctcctgctacttaatgtggaaagacacgcccatgtsccccttcggcccactctgggggctggaaatgctgcagtggggagcaggccccaggctggacctgccctgtcctcagcamgcgtgtgsaaaagtgaacaa

SEQ ID NO: 13796 - DNA, 363 bp, Homo sapiens
atgttaggagtactgggacgattccgcggascgggcagaggttttaggggtgcgcaggagtcaagtggtggttcagtggggacggaatgattaacaaaggcgtccgaagaaatcgttgttggaaggtgaccaaggtggaaagagacgttgctttggccctgcaaagtctgtcacactaagatgagaaatgtcctttcttcctgaaggtgtctgatgtgtaaaaatatgatatactttgtgctgtttcctccctttcccttttgcatattattctgaaacaacattaactagttactttgcgtcattgaagaactcactttgaggccaagcgtggttgctcaggcctgtaatcccagcactttg

SEQ ID NO: 13797 - DNA, 146 bp, Homo sapiens
ttacaaattagccagatgtggtgacacatacctgtagtcccaactactcaggaggctgaggtgggaggatggcttgagcccaggagctggaggctgcagtgagctatgattgtaccactgcacttcagcctgggcaacaaagggaa

SEQ ID NO: 13798 - DNA, 518 bp, Homo sapiens
catagaatatcctaaagtatcacatagttaaatttttcagtcagtgaagaccgggagggaatgtcagtgaattggcttgaatgttctgtggcaatccacaggtctagccaaatattgaaataggagtttagggtataatttgccttgtgatgtttggcagtcactgtttatactttaaaggttatattttaagctatttgagattgcttttgggaagatcactagatttatggaggaattagtcacaaatgacttgtagaaaatactgtcatatagttcatttcatcattttctgttgcaggaagccactccaccacagaatgctaatatgccagtggtacccagtacctcttgtatataggttattgcaaatattgttctgaaatgcttaacttcagaattacattttttaaagtaaataattgttttaaatctattttgtaaagatataaagtacaatagaatttctggagtacagattaaactatttgcactaacacacgtgacgtgcatgattt

SEQ ID NO: 13799 - DNA, 294 bp, Homo sapiens
ttataggtacttcacagcaggataactagttgatatagctactaatttaatcaaataaagattttattttttcagtttgtacaggagaaaaaagacattaccattgaactgaaagagaaacatgttttcgaattattcttcatagcacactaaagacactgccaaacaacatctactgccttacacatggtattagtttaagaaatatttgttgaatgaatgaacattgaatttaaactgctatcatcagtgtcaggracctacaggtgaagtctcatgtcatttattgacagg

SEQ ID NO: 13800 - DNA, 343 bp, Homo sapiens
attacctaggaccattcagagcctgactgacatcttcttagactagttctccatcactgcttgtccttggggaaggtactatctagtgccctacccagagaaagtgtatatgttctaggtctgggagggacgttggagggtcatcccatatgatgtgctccctgactggctaaaggacaacgactatctgctacatggtcatagacctcccatgccctcctttcgggcttgcttcaagagcatcttccgcattcatacagaaactggcaacatctggacccatctgcttggtgagtgatttggatggggaaaggtggaatttgttgtctccctaactgcgaag

SEQ ID NO: 13801 - DNA, 420 bp, Homo sapiens
atgttaggagtactgggacgattccgcggascgggcagaggttttaggggcgtccgaagaaatcgttgttggaaggtgaccaaggtggaaagagacgttgctttggccctgcaagtaagaagagagagggaatagcctgaaggagtaacactaaatttaaaatgacacttttttaccaaccagcgaaggcagatgttcaaaggggatattggccagagtctgtcacactaagatgagaaatgtcctttcttcctgaaggtgtctgatgtgtaaaaatatgatatactttgtgctgtttcctcccttcccttttgcatattattctgaaacaacattaactagttactttgcgtcattgaaggtatgcacttcccctctatgttaggagtgaataaaattaaaaatagatcctttataaca

SEQ ID NO: 13802 - DNA, 465 bp, Homo sapiens
tcacccctgaggaagagctttaatgtcactagggattcacccttatgacacaaacacctcctgcaagtggacccaacattgggatcaaatttcaatattagatttggagggaacagacatctaaaccatagcagaaggaaagaggcaagaaagtagctgcaaaagcatatgggctcgaagaaggagttgaaaacaaacatgtttaagattgtgagaaggtgctagctgacagagaaaagtcgcatatgcaaaaaacacaaagcactaatggaaagttcctgagaaggttgtgacaagggaggaattttgtgacttgaagcccagttaggagaatgatgagagatggtgtgaggacagctcctgccttttcacctgacagcccaagatggtgtcttcatctgctagtgcaagatctagggagggtcttatttttatatctttcttcctacttggaagggaggcagt

SEQ ID NO: 13803 - DNA, 369 bp, Homo sapiens
  misc_feature 148: n=a, g, c or t
atggagacgggtttcaccacgttggccaggctggtcttgtactcctgacgtcaggtgatccacccgcctcggcttcccaaagtgctgggattacgggcgtgasaccgtgctcggcccaaggcaggagaatctcttgaagccgggagsngaagttgtggtgagccgagatcgcgccactgcactccagcctgggcaacaagagtgaaactccgtctcaaaataaataaataataaaggaagaagtcagctgggtgcagaggctcatgcctgtaatsskcaatactttaggaggccaaggcaggaggatgcttgggtctggaagtttgagaccagccagcgcaacatagtgagacctgtctctaccaaaaa

SEQ ID NO: 13804 - DNA, 477 bp, Homo sapiens
tatttttagaaattcatgggaaattggatttttgtaataatcttttgatgttttaaacattggttccctagtcaccatagttaccacttgtattttaagtcatttaaacaagccacggtggggctttttttctcctcagtttgaggagaaaaatcttgatgtcattactcctgaattattacattttggagaataagagggcattttattttattagttactaattcaagctgtgactattgtatatctttccaagagttgaaatgctggcttcagaatcataccagattgtcagtgaagctgatgcctaggaacttttaaagggatcctttcaaaaggatcacttagcaaacacatgttgacttttaactgatgtatgaatattaatactctaaaaatagaaagaccagtaatatataagtcactttacagtgctacttcacacttaaaagtgcatggtatttttcatgggtattt

SEQ ID NO: 13805 - DNA, 312 bp, Homo sapiens
ctttttgtttttaggtcccttgggtagaacctgcagcaggctaggtgaccgacgggcctctctagcctttacagaaaaaccattctccttgctcaggccacaggacttcagtcaacaaaaaggcctgaacatactggtgctcataaaggactcagtgcagcatttacagaccctgacgcaatccggagctgaccagcacgaggcttggaaccagaccactgtcatacacctccaggctgctaaggtgcactgctactatgtcactgtgaagggttttacagaagctctggagaaactagaaaatgaaccagc

SEQ ID NO: 13806 - DNA, 383 bp, Homo sapiens
tgatcagcaccagggcggccagcgggctctaccgagcgataacagagacgcacgcattctacaggtgtgacacagtgaccagcgccgtgatgatgcagtatagccgtgacttgaagggccacttggcatctctgtttctgaatgaaaacattaaccttggcaagaaatatgtctttgatattaaaagaacatcaaagagggtgtatgaccatgccaggagggctctgtacaatgctggcgttgtggacctcgtttcaagaagcaaccagagcccttcacactcgcctctgaagtcctcagaaagcagcwtgaacacagcagctgcgagggcctcagctgccagcagacccgggtgctgcaggagaagctacgcaagctgaagg

SEQ ID NO: 13807 - DNA, 348 bp, Homo sapiens
tagatagatagatggatccaactgtgtgaatagccagcaatccctgaatcccagagccgggcactcctccccatgtgtcagtctcatgaatcaaagtcttatagtgtatattttatggatatgctgtaaatatttctcagaaatcacagaccatcttttcagttataagaatgtccaaacttggcacggtggctcactcctataatcccagcactttgggaggccaaggcgggcagatcacaaggtcaggagttcaagaccagcctgaccaacatggtgaaaccccgtctctactaaaaatacaaaaattatccaggcatagtggcatgctcctgtagtcccagctac

SEQ ID NO: 13808 - DNA, 72 bp, Homo sapiens
atgtatgatttctgcttggactgtattgttaatacatacatacatcttttggtctattggcaaatgaccctt

SEQ ID NO: 13809 - DNA, 471 bp, Homo sapiens
  misc_feature 454: n=a, g, c or t
aagcctaacccttcaggtttgcttcaggtggggtcgtgggcgccaggttctttctcgagctggggggctctgtgtgcccagggcgctcctgcgctgggatctgcgaggagatacccagagccctgcgtcctctcctattcagcgcccgtgtatgttaattgtgttataccatttaattctaacatcggtctcaaaagagctcttaatgagaaaagcatatacaacatggatcactttgctattcagcttagccagatggacaactgctaaccttttttttttttaataatgaaaatccccctttgacaaaggggctcggatgaataggctccaaataacacctcaaacacttctaattgttttgaggacaatatgctaatccgcgggtttcggctttggtgtctgttgacaacgtttcccgtgcacttcgagccacsgastcctttggaaacansggaggcaagsgtacaa

SEQ ID NO: 13810 - DNA, 505 bp, Homo sapiens
agaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgaacacaagtagatgcctgaacttgaattaatccacacatcagtaatgtattctatctctctttacattttggtctctatactacattattaatgggttttgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgat

SEQ ID NO: 13811 - DNA, 466 bp, Homo sapiens
tataacaaggtatgttaggctttttctgtatgtgttctcatgtgaaatgttagagttgaacattttctgtaaaattgtttaatatacagtcatgtgccacataatgacattttggtcaatgatagactataaacaatgttggtttcataacattataatgaagctgaaaaatatctattccctagtgatatagctgtcataattttaaagtgtattacatgactcatggggttgtgttgatgtttgtgtaaacaaactttctgcactgccagttgtataaaagtataagtacagttatgtacagtacacagtacttgacaatgacagtaaacaactgttactggtttatgtatttagtatatgataacttttattatctttgagtgtgctcctccatataaaaaggtaggccgggcatggtagctcacgcctgtaatcccagcactttgggaggccaaggtgggcg

SEQ ID NO: 13812 - DNA, 320 bp, Homo sapiens
tttttaaaaagattttgaatttaggctgggtgcagtggctcgcgcctgtaaccccatcactttgggaggccagagtaggtggattgcttcagcccaggcattcgagactggcctggacagcatggcaaaaccctatctctgcaaaaaataaaaaattggccaggtgtggtggcatgcgcctgtggtcccatctacttgggaggctgaggtggatggatcacctgagcctgggaagtggaggttgcagtaggctgaagtcatgccactgcactcaaacctggcggacagagtgagaccctatctcaaaaaaaaaaaaaaaa

SEQ ID NO: 13813 - DNA, 294 bp, Homo sapiens
aaaaaagagtagggccgggcgcggtggctcacgcctgtaatcccagcacttgggaggccgaggcgggcggatcacgaggtcaggagatcaagaccacggtgaaacctgtccctactaaaaatacaaaaaattagccgggcgcgatggcggcgctgcagtctcagctactcaggaggctgaggcaggagaatggagtgaacccgggaagcagagcttgcagtgaggtgagatcgcgccactgcactccagcctgggagacagagtgagactccgtctgaaaaaaaaaaaaaaaaa

SEQ ID NO: 13814 - DNA, 475 bp, Homo sapiens
agaaaccctcataaagtagatgcagagggcagtaagatataactcaactttgaaaatgtcagccgttatagttgaagaaatctgacccaagagacttcgctccgctgcaagatggaaggaagcttaagtaagacataaatttgtaatgaacttgctcacaacatccgccgccactgtgacttgcagtcatcatccattaccacaaaattagttgcaggatggctactcgtatccctccacacatgatcatcagtatttgcctcctgtgtcccaaccggcctgagtcaaggttacgactcactgattaaaaagagggactttttcaaatactttgcacttttgattgtgtattatggataccaaggaagagaagaaggaacggaaacaaagttattttgctcgactgaaaaagaaaaaacaagccaaacaaaatgcagagacagcctcagctgtagctacaaggactcatactggg

SEQ ID NO: 13815 - DNA, 481 bp, Homo sapiens
ccatggtcaatggcctggmacggctgccggctgtcaactggttgccagctgcgacattgccgtggcgagcgacaagtcctcttttgccactcctggggtgaacgtcgggctcttctgttctacccctggggttgccttggcaagagcagtgcctagaaaggtggccttggagatgctctttactggcgagcccatttctgcccaggaggccctgctccacgggctgcttagcaaggtggtgccagaggcggastgcaggaggagaccatgcggatcgctaggaagatcgcgtcactgagccgtccggtggtgtccctgggcaaagcaccttctacaagcagctgccccaggacctggggacggcttactacctcacctcccaggccatggtggacaacctggccctgcgggacgggcaggagggcatcacggccttcctccagaagagaaaacctgtctggtcacacgagccagtgtgagt

SEQ ID NO: 13816 - DNA, 109 bp, Homo sapiens
agggatgtgacagagcgcgagacccagcctaaagagagcccggagccagcgtgggaggccgctgccgtcgcgcgccttggtttttctgttccttttttttttttttttt

SEQ ID NO: 13817 - DNA, 472 bp, Homo sapiens
  misc_feature 56,337: n=a, g, c or t
tattgcactctggcagaagtatttcccacatttaattattgcbkccccaaactctncccacccctgctgccccttcctccatcccccatactaaatcctagcctcgtagaagtctggtctaatgtgtcagcagtagatataatattttcatggtaatctactagctctgatccataagasaaaaaagatcattaaatcaggagattccctgtccttgatttttggagacacaatggtatagggttgtttatgaaatatattgaaaagtaagtgtttgttacgctttaaagcagtaaaattattttcctttatataaccggctaatgaaagaggttrngattgaattttgatgtacttatttttttatagatatttatattcaaacaatttattccttatatttaccatgttaaatatctgtttgggcaggcatattggtctatttatttttaaaatatgtatttctaaatga

SEQ ID NO: 13818 - DNA, 443 bp, Homo sapiens
  misc_feature 405: n=a, g, c or t
ttttccgggcaggaccccgcacccaaaggctcacctgtgggaccgcgttgtcagtctcggcgcctgcgctccgctccaggaagaaagcgccaaggcgaggcatggcggtctccgtgcgcaccggcagcttctcgtgggacatcaggatgtcgtccaaagaaagaaagttctcctcaggccccagcgcacccgactccactcggaaataagcctctgacatggcggccacttgagcttctccgcttccactcgcgtgattcggaggagcctcaggagttaggggtgtacaagacggggaagcggagactgggcaggatggttggggtcaggaaagtggattgaaactcgtttcccgcgcccggggacgcatcagacaggagcagtcaattcgggcggtaccgccangcagaagcaatcgatcaagtctgcagatttagagcagc

SEQ ID NO: 13819 - DNA, 372 bp, Homo sapiens
aaagcctcctgcagactcggggtttgacttgcgggaggtggagcattttctgaaggctgagcctgagaaaaacggggaggtggttcacaccccggaaacaagtgtctgagtggctgggcggggccggcasacagggaggaggtacagaagccggcaacgcttgctatttattttacaaactggactggctcaggcagggccacggctgggctccagctgccggcccagcggatcgtcgcccatcagtgttttgagggggaaggtggcggggtgggaacgtgtcattccagagtggatctgcggtgaagccaagccgcaagttacaaggcatcctcaccaggggccccgcctgctgctcccaggtggcctgcg

SEQ ID NO: 13820 - DNA, 105 bp, Homo sapiens
agcgcctgcgaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 13821 - DNA, 428 bp, Homo sapiens
tttaacagttctacttgtgtacctctggcaatgaggaactcactctctaggagccactctttccattgtggatagctcttctcattggaaagctctttcccgctgatctgacattcgtgtctggaactttcatccatttcagaggataggagcattcttgacggtacagtttgtccaaccagtcaacacattactcttccttttgttctgacataagtggtataaaatgaggtaatagatgcattttggaaaaagtaatggcattatacaaatgcaagaratgttattgataggcttttatggcttagatgaatctgacttgaactttcagcatcatatactccattagtcgagaacattgcagtgaccttttttaggaagcagtttcctggagatttaatcagtgtagaaaaataccatattcagcc

SEQ ID NO: 13822 - DNA, 485 bp, Homo sapiens
gtccttatcccgaagctggggttactaggtgaacacggccggaggagagcgctctgaaatccattcttcagccgcacgtggaaaatggacagctgtgactcttaaagagaattaaagcaacaaagcatctcagcctgctctatgagctggatatttcgtaggaaggagccgatttggcgaaagttacgtaaacaatggaattgtctcagtttgcgcctttgtttcgtttgacagccctccagggagtcatagtgattgctggagacggtgaactaacactgtggggacccttgtgctaaacgtgtcaagtggcacaacaaggataggaacacgggtcctttggactccacagcttctgctccttccagattaagccacactgctttctccaagttgttactgtagtaacatcattttggctgcagtttgtggatgkgttggaagatgggaagtcaatgcagaagcaccgttgaaagtattccact

SEQ ID NO: 13823 - DNA, 257 bp, Homo sapiens
  misc_feature 11: n=a, g, c or t
gcgctctgssnctgacggcgcttttgtctccggtgagttttgtggcgggaagcttctgcgctggtgcttagtaaccgactttcctccggactcctccacgacctgctcctacagccggcgatccactcccggctgttcccccggagtgagcggccctgtggttccccggctccccacccccatcgctagagtgctcgccgcgctagagccttcgcgttccagggctgggggtgcgccgccgggatcctctctgatcg

SEQ ID NO: 13824 - DNA, 139 bp, Homo sapiens
gctcacgcctgtaatctcagcactttgggaggctgaggcgggcagatcgcttgaggtcaggagttcaagaccagcccgggcaacgtggtgaaaccggtctgtactaaaaaaaaaaaaargaaaaagaaaaagaaaaaag

SEQ ID NO: 13825 - DNA, 477 bp, Homo sapiens
taaaaaaatcagtgtggacttccattcctctttcttttgattccccccctttgacttttcatgtatctctcctgccttccttccccagagtggaggagttagacttgcctcgtgggatgagaggagttgtggctttgtgtctgctggcaccaagagggctgagggtgaggtgtggaagggacagggggaggagatgggcagcattgttgagagattggtaacactgagcaaataaatatgttgagaatgatgacagcaagatttctccattagagaaggtatttataaaaataggaatgaggagagctagaaaacctggagtgtggcattagaatagaactcatatcttttaaatatataggaacaaataaataaattgttgtgtgtgcacatatgcatatattttgtgttcattctactgagaggacctaaacacaatgacacctcagtaacagtaagcacaccaactgccaagtt

SEQ ID NO: 13826 - DNA, 460 bp, Homo sapiens
ctatactttcagggatcatttctatagtttgttacaaacatatgccattaatagcttgataggtcatactttaatactttttctttctaataaatagatatgctttttaaaatttggctaagttacgggcaaatctatattctcttacccaaatcagataatagactagacagtaagcccacaaaaccataaaccaggcaccaccattcactcggtagccagtacctgagttataaatacagtgactcacagaaaataataaattttcattaggctggcctcccccaagttaaatctgtaacatgaaacagccattttaaagtggtgtctaggcagggcatggtggctcacgcctgtagtcctaatactttggggggctgagacaggcagatcacctggggtcgggggttcgggatcagactggccaacatggtgaagcctatctctactagaatacaag

SEQ ID NO: 13827 - DNA, 481 bp, Homo sapiens
tatttaaaattgggacttatacagattatttaaaactgggatacatgcatctaaaacactgtaatatttataagaraggaagataaacttacggggaaatacagtaacagtaactacatacgagtctgtacccattaaattgcatatctatctcctttaggaggctggtggtggcatgatgagtgtggagaaaacaacctaaatggtaaatataacaaaccaagagcaaaatctaagccagagaggagaagaggattatcttggaagtctcaaaatggaaggttatactctataaaatcaaccaaaatgttgatccatccaacagattcagaaagctttgaatgaactgaggcaaatttaaaaggcaataatttaaacattaacctcattccaagttaatgtggtctaataatctggtattaaatccttaagagaaagcttgagaaatagattttktttatcttaaagtcactgtctattt

SEQ ID NO: 13828 - DNA, 52 bp, Homo sapiens
aaaaaaaaaaaaaaaaaaaaaaaaaaaaaaaaaaaaaaaaaaaaaaaaaaaa

SEQ ID NO: 13829 - DNA, 471 bp, Homo sapiens
aaaaatgagccgaggtcatggtggttcggagatgacagaaggcaggcactsaggtgcacctcctggatgataggagactggagctgctggttcagcccaaacttctagcaagagagttgctggacctagtggcttcacatttcaacctgaaagaaaaggagtattttggaataacattcatagatgacacgtaagtcctttaatagttttagtttctttaccttttgcctgggctacctacttgctgtcttccataattaacaaaaaaggaaataagtcctccagcattcagaacatgtcctgcttagctaaaggttttttaatatgcgatttttctcctaggattatggcaaagggagaagaaagggatactgaccattttaggaactcaatattgttctaaatgttttagaaatgtgtagtaatgagtttgttattcccaattacagtgtatcttctcatgtcttttga

SEQ ID NO: 13830 - DNA, 428 bp, Homo sapiens
atttcctttaagtctcattggcttcagagctttctgctgcaacaccaaacatcagaagacaacaaatcaatttctacagagaacaaggagcagcatcatccaaggctcttaagtctcactattatccttcctctgtgaagacaaccagatggtgttacacatgatagaaactaatagtccttcttggaaagaaataatttgaatatttacttcaatccactggtagttacatttttttaaagggccgacaaatggtggtagtaagtactgggacaagtccaaagtttaaataattattgcattctggtttaaaaggtgaccaaaagtggtgtctttatcaaataatattttgtaattgcttgttgtttgttcatatgtatgcaactaatttttgtgtatgaatcttatatatatctaaattaacaatc

SEQ ID NO: 13831 - DNA, 84 bp, Homo sapiens
  misc_feature 2,53: n=a, g, c or t
antcttctggtccccacagactcagagagmsacccaccatggtgctgtctccngccgacaagaccaacgtcaaggmcgcctggg

SEQ ID NO: 13832 - DNA, 496 bp, Homo sapiens
gcggtttctgcggcggctggagaggtggtcggagaagtaggaacctcctgccgggctcgtggcggcttctgtccgctccgscggggaagcgccttccccacaggacatcaatgcaagcttgaataagaaaaacaaattcttcctcctaagccatggcatatcagttatacagaaatactactttgggaaacagtcttcaggagagcctagatgagctcatacaggtgggagactgaattaaaaatcaaacatttttatcttgatgggtttacagtaattcttgtcatatcacttaggcaaagagatatgaggtaaaatatcttggactgtttgacccagcaagtcagtaacactgattaaattacctcaaattcttgtttattacactgtcctgacaacaggacacaaaacatgattgaatgatatcattaaatatagctaaatctgggtacatgcagtgtttcatgcctctaatcccagcactttaggaggacaa

SEQ ID NO: 13833 - DNA, 402 bp, Homo sapiens
ccaaaatatttttttcaataccaagcgcatagtgacgaatgatgtaatcaatggacttaatctctgtgcctttttaaaggcttagatttgcttaaataaacaaatcaaatgttagcagggaccaggtacaggtggctgacacctgtaattccagcactttgggaggccgaggcgggcggatcacttgaggtcaggagttcaagaccagcctggccaatatggcggggccccgtctctactaaaaatacaaaaattggccatgtgtggtggtgtgtgcctgtggtcccagctgcttgggaggctgaggcaggagaatcgcttgagccggggaggtggaggctgcagtgagctgagatcacaccactgcactccagcctgggcaacagagtgagactttgtctc

SEQ ID NO: 13834 - DNA, 479 bp, Homo sapiens
tttctgtactcagatatgcagtcactggcacacatcctgttactgacgggaagctggacccagcactggagtatttctgagactatgacactctggtgtattcctgaaactatttatgacactattaagctcttttctgtaattttacaatatgtttggtaagatctcagcgcsagatttttttaaatgatgtgtttatttcttttaattgacaaatacacattgtatgtgtttatgtggttgcacatggtgtcttgatgtatgtatccatagtgagatggatttaaatatgcatgacctcacagactttgcagcacttttttgtgtgtggtgagaacacttattcagaatgggctcctttagtcgttttcaaatattcaagccattgttactaattgcagtcgccatggtgtctctgagctttcctgaagttatttgtcctgtctcatggacgctttgtgccctgtgaccgatcgtct

SEQ ID NO: 13835 - DNA, 487 bp, Homo sapiens
agcgccgcgcaaagaaacaggccgagggagacaacgtgcgtggaaaccatagcaacgtcctttctggcctctgttgactgcctctcttccccgggcctggactctacacctgacaaagcaaaatactcattgacttaaattcccccgaaacacgtttctcgccctctcatggagtcgaagtccttcggcctctgagaaggtcagcccaatttcataccccttaatcctgtgaaatccttgataaatatttgagccatttctctttctcgatggaaaacaagagaagtaggcgcttcctgaggatgcttcctgttttctctttggaaaggacagactctttgagatctgctctccggacgaaaaatagattgattcatacacgtcatctgcctaagtgctaaggaaaagaaataaacatactgtgagtttcctatatcatcttcccactaatttaactacataaagtgaaatcaataaagatatatgg

SEQ ID NO: 13836 - DNA, 100 bp, Homo sapiens
ccggagcccggggtgctggagggaggcggcaggccgggtcaggggctcgagatcgggcttgggccagagcatgttccagatcccagagtttgagccgagt

SEQ ID NO: 13837 - DNA, 537 bp, Homo sapiens
gtcagattcccagagagatccgtgtgatagccgtggcccaagaaaggttaacagttacagacttagaactaaaagaagtcaggtacactgaaagccttagaatgccaacgattggccaagcgtggtggctcatgcctggaatccctgtgttttgggagaccgaggcaggcggatcacctgagtttgggagtttgagaccagcctgaccaacatggagaaaccccgtctgtataaaattagccaggcatggtggcacacgcctgtaatcccagctactcgggaggctgaggcaagagaatcgctttaacccagcgggcggaggttgtggtgagccdagatcgtgccactgcagcctctgcctcccagattcaagcgattctggtgccttggcctcctgagtggctgggacttacaggcacgtaccactataccctgctaaaatttgtatttttagtagagacagggttttgccatattggccagggcttaggtcgtaatgtctctttttwaacactgaatatgttaggtggtttttcc

SEQ ID NO: 13838 - DNA, 481 bp, Homo sapiens
cattaaaaagtgtcagaggtaaaaaagataggaagaatgcatgggaaggggagaacaaagaggattagagtcaaacagtcagaatggggcagcaagttcaactgtgcagtcagcctgagttttaaattttgtccttagaaaagcatgtgaactcccagggtgttagtgttcgagtagacaggcaaggaattctgtttgtcagcttaaccacatcttgtagcgtttgacctgagcacgagtgtccaggtatattttgagtggtacatttatctcctggcttaaagcccttactttgtttccataaaattaggacagaggcaaaaaggcattacgggatagcaccagccaattgtacatcaccttttgaatcattttcttgaaggattgtcaatattctctgacatatatcacctgacaaaaagcgaacaagcctagacaaactgaaaaaggaagcattcagtggttggagctgagcactact

SEQ ID NO: 13839 - DNA, 452 bp, Homo sapiens
  misc_feature 422: n=a, g, c or t
tattatacaccctgtacaagactatatgaaggaacttggtatttttggttttataggtttgggcacagcacatcaaaggaagctaaagaatactttgcagatatgaaaagacatcgtatccagttcaaatattctggtcctgaagatgatgctgctatcagcctggtagrtttgagttgtattttatatacattctaattttagaaatcactactttagccagttgaaacatttacatttttgtataagactccgtatcaaaaaaaaaagaatgttttatagaatagaatgtttccagtaagcatatcccagagaaggaatcagatattttagaaaattttgatttttggctgggcttggtggctcatgcctataattctaggactttgggaggccaaggcaggtggatcacctgagatcangagttggagaccaacctgtccaacatggtg

SEQ ID NO: 13840 - DNA, 284 bp, Homo sapiens
twttcctctgggacctacagtgatgagaatttaatgattatctcctccactataatcctctttagggtgattttttaaatcaaaacccagtgaatctcattactcctaagaaacgaaagattccttcaaagccttttcaggcacatggtttcaacaaagcctggctttgacattcacttgtcctgaggagcactttccaggcatagttacagcttccccactgtatttacaagccagaattgtgcaactcttctggatcattaataaagtagcaagatcctcaa

SEQ ID NO: 13841 - DNA, 353 bp, Homo sapiens
aaacctacagcttctctttgccatttgtggatttcacatcactccacacagaaacattacagcctggcatccccagtctttgccttcttccagctgcctcgacacagcactgtggcctgtccctattgcccaggcacgccatttccaagggcaggaaggggcagtgtcctgaagcccatcttttctgtgactgtcttaggtgatgtgtagccccctccacctttccactcaacaacctcccacccctgtcctgctgcatggtccggagtctgggacctactttgttttttgttatttatgaccttgtttaaagaaaataaatatctcccaaccttcaaaaaaaaaaaaaaaaa

SEQ ID NO: 13842 - DNA, 63 bp, Homo sapiens
aaaaaaaaaaaaaaaaaaaaaaaaaaaaaaaaaaaaaaaaaaaaaaaaaaaaaaaaaaaaaaa

SEQ ID NO: 13843 - DNA, 494 bp, Homo sapiens
aataaaataattttaaaatgattttttaatgtatttgagtaaagatgagtagtattaagaaaaacacacatttcttcacaaaatgtgctaaggggcgtgtaaagaatcaaaagaaactattaccaataatagttttgataatcacccataattttgtgtttaaacattgaaattatagtacagacagtattctctgtgttctgtgaatttcagcagcttcagaatagagtttaatttagaaatttgcagtgaaaaaagctatctctttgttcacaaccataaatcaggagatggagattaattctattggctcttagtcacttggaactgattaattctgactttctgtcactaagcacttggtatttggccatctccattctgagcaccaaacggttaacacgaatgtccactagaactctgctgtgtgtcacccttaaatcagtctaaatcttccagacaaaagcaaatggcatttatggatttaagtcatt

SEQ ID NO: 13844 - DNA, 429 bp, Homo sapiens
  misc_feature 129: n=a, g, c or t
taaatttaaatttcttctaaaatctatggtaataaaattattattataataacattgcaagataatgggagcatgacattacaacatcaagaataaggaatagccaggtgctgtggctcacgcctgtantcccagcactttgggaggctgaggggagaggattacttgacctcaggagtttgagaccagctatatataaagaactcttaaaactcaacaaaagtcaaataatccaatttaaaaattggcagaagacttaaatagaaactttaccaaaaatgacatacaaatggccaaaaagcgtatgaaaagacgctcaacatcactgactaccatagaaatgcaaatcaaaaccacaatgggccatcacctcacatttagtgagctattacctacattgtagtaaacccaattttttattccgtattg

SEQ ID NO: 13845 - DNA, 472 bp, Homo sapiens
tccttaaatattgggttgccttgtgcagctgtagtatcagtttttgaaccacagtaatgggaagaaagacaaatggattcccttagaagtaagatttctatttgcaggatgagttgggcagggaaaagggtcagggttcatcaggtgaactcaacactgggatgagactagaacttcactttatgatataaacacaatacgattattcaatgtggtgactggggtagactgtgaagcagccctccttatgcccactgccttttagaatcgtttgttttattcatggtagttttatgaagacatactattattgaatgaaatttaatgtgtacttgaaaacattgcttttgtcccttctcttcatctggtcttgggtcaagaacattgttttaatggctgccgacaatgaactgtctgtctgagtctaaaaccaagctcaggtttctaagccacatgaccttgattgttaaat

SEQ ID NO: 13846 - DNA, 317 bp, Homo sapiens
gagggtggtgttgcgtagatatgggattgagatggagggatgagggaattcaaaagaatggagatggagaagtaggggaggggagggaggtgagagataaacagagagagagatagagaattatatagcagtatgcgaaaaaccagtttaaaacccatgaagcaaagagaaatggatgtataagctagacaggcatgaggagtgacagagtttccttttcaaggagatggtatccctcctgttgatatacacagatgatccataattgctgtgtattattgtgagcgaataaacagagagacgctaacaaaaaaaaa

SEQ ID NO: 13847 - DNA, 316 bp, Homo sapiens
tttctgaatacaaattccttatcagatacatgatttgcgaatattttctctcattctttgagtgccttttaactcaaacagaaaaaaataaaacaattacctagaattgctatatgtatacagtggtatttattcactaaaatatttttkaaactttcttattgaagtatggcttatatacacaaaggtacaggccaggtaggccaggtgtagtggttaatgcctgtaatctcaacaccttcggaggccaaggcaggaggatcatttgatcccaggaattaaaccagcccggccaacatagcgagaacctgtctct

SEQ ID NO: 13848 - DNA, 390 bp, Homo sapiens
atgctccttaagttccccgtactccctcggagaccctagctacacgccgaatccgttactccgggttttcgcagtggctcggtggcctaccccgatcgaaaccgtgagcttttgctgagggagggcaatgggagaggggaggatggacgcagagtttagaagtagtttgccgaggtgcagtcgcacgaatggatttcatcctcactggtgtatttaatagtttgtaatctaccaaacagcaactgccagaagccagtcccagctaacctactggcgtgcacgaaagaacccagcgatgctgatctcgtttcgttatttttctgacttaaacggttaaatctaaacgcgattactaagaaaaaaaattttatacctatcattgtacacaaa

SEQ ID NO: 13849 - DNA, 181 bp, Homo sapiens
tgtggtaagggccaggagagtccttccatcctccaaggccctgctaaaggacacagcagccaggaagtcccctgggcccctagctgaaggacagcctgctccctccgtctctaccaggaatggccttgtcctatggaaggcactgccccatcccaaactaatctaggaatcactgtctaaa

SEQ ID NO: 13850 - DNA, 544 bp, Homo sapiens
acctgccgcgcgcttccgctgctggccagtctcttctgcccctccccctcctgtacggccgctactctgcgcccggcttccttctcacaacctggttctgcccacacctgttcttcagccctgtgaacagtggctgtagaacagtctcaggccctgcagacccacctccctcgctcccgtggtggcggttaacacagaaatctgcctcctgggccatgccgcttctaaggcctgtttcttctcatgagccccagcacaagacagatgggccagttctcacagtggataacttcccctgcctgagcaagagatgggatagtatctgggatctgtccatcaccagactctgagcttaataaggcagctgaatgaagaaggtgttgagctggcgagttcgcggaggctactattcaggaaatcttatccagatgagtacactggaagctacacctctccattactctgtccaggtgcatggctgcctcctaatcccatagtccagaggaggcatccctaggactgcgggcaagggagccgggcaagc

SEQ ID NO: 13851 - DNA, 234 bp, Homo sapiens
ttcttagggtccaagttgaaaggcagtggttcttttgtgaacaccactaactacattcgaaaagcctctccaattccacattccaagtctataacagctttggaaatgagtaacaatgacctctcatgtagtagattaaagcagaggcctttgccatatgattgttttttggcttaaatgtttgcttgccctgtaactgtaatactttggttaccagaatcacttgaaaacaaa

SEQ ID NO: 13852 - DNA, 52 bp, Homo sapiens
taaagaaaatatgatacatgtacactatggaatactatgcaccataaaaagg

SEQ ID NO: 13853 - DNA, 304 bp, Homo sapiens
tgtatttaaagtgatatttagggccgggtgcggtggctcatgcctgtaatcccagcactttgggaggccggggcaggcggatcacctgaggtcgggagttcgagatcagcctgggcaacacggtgaagccccgtctctactaaaagtgtaaaattggccgggcatggtggtgcatgcctgtggtcccagctgctcgggaggctgaggcgggagagttgcttgaacctgggaggcggaggatgcggtgagctggggtcgcgccattgcactccagcctgggcaacaagagtgaatctccgtctca

SEQ ID NO: 13854 - DNA, 486 bp, Homo sapiens
catcttctagcctgggcctgacttccattaaaacagggttttgtgcgttttttagattcctgttcgtttttatgctatttcatccactcagtaaattacctgagtaaagtgcatctccctgccaggcccccagtatagacactggggatgcggcaaggactaagcggtccctgctgtttggagatacttaagatggggctccactttttgagccccccgactcccttatttggtcttatactgcctgtgtgcaagtcaggctctgtggatatggcaccagtatgaaatgcagggtctcttggtttttccccttttctagcagacaggtcattacttagttcccaactcccactctaaagctctggttagcgggtgatgaaaatcagcacaagtgatcacatacagcaatcccaacctttagaccacttcctagctgcctctccaaaatatgtagtaaacggtcattcagaaactctccctcctggt

SEQ ID NO: 13855 - DNA, 354 bp, Homo sapiens
  misc_feature 57: n=a, g, c or t
atagccccccacccccgctgctgctggagawaagagaagggtgggtgggtgggagrngcgaacaaaaactcaagtagctagagagagaaagcaaaggcagcaggctcagctagctccgtgtgagtgagtgagtgaggtatagagagagagagagagagtgaggaagggaagccattgattgcagttgcacaggaaagaaagaaggaaggaacgagcgagagtggaaaagttggtggaggaggaggaggaggaggatggaggagagagcgggcgagccgtcggwggtggaggagcagggctgcgcasgaggccagccaaaagtagattcggcgccgtgggcccgccgtcctccag

SEQ ID NO: 13856 - DNA, 464 bp, Homo sapiens
gataccactgtgtgacaggaagcgagagtcaacgcagggagcctgcaccctgcaaacagccacagcccttcactgaacggggagcataaatcccaccctagttagaaccatggcttttgtgcggaccagaagtgccagagccacaatataggggtgagatgtcttaccgttttgcggtgttgagtgtgtggattcccttttaagatagaaagtaggaaaactgccagtaagggagacgactcactaaaagaggattcagtctctggttgacatgttttgctgagtgtagttggttacttcaggtacagtatcacattaataggggccacagtctatatccctgtttagtttgttagttaccactcaagagcagacagatattgtccactttatcccaaatcccagccagactttgttgtatgctgtgcttcattcatggggctgtgaactactgattatattct

SEQ ID NO: 13857 - DNA, 475 bp, Homo sapiens
gtttttcctaagtttggtacatagtaggcactcagatgcttaaaggaatgaatgaattgtgctttaattccactttactaaacccaaatctccctttggacattgttatctatgtgttttcaaagaagtataatcataatttgacagaaatccttgagaggcagaactaagtgagggattgggcagggttcagatgttaagaacagtaagctcagcagggtgtgattgctcatgcctataaccctagcactctaggaggctgaggtgggatgattgcttgaggccaggagtttgaaatcagcctgggcaacatagtgagaccccatcactaccaacaaaataaataaataaatgtacatggtggcatatgcccatagtcctagctacttgggaggctatagtgggaggatagcttgagtacagaagtctgaggctgcagtgagctatgattgtggcactgcatgctagcctgggc

SEQ ID NO: 13858 - DNA, 451 bp, Homo sapiens
ctattaatggcccatctgagtacttatcatacgcggtcaccctatctttggatcagaaggtacactcagagctcctagtgtcacatcccaggcccaacctgctgagagcagtcgaggaaggtctggaggatggatttgggaaaccagccggagcggagataaggagtctaccttgcaaagacacgtgtgaaagcagagagagcatcgcccagatgggctagattcttctcacaggctcactgctagaacgaacattcttgagactttagatctaagtcagcctgattcctgaaagccttggaccgtttccaaaatcaaatcaatactccaggaacaagatctgcctcgactttgtctccatccaaggacgctatggcaacgcagttttcaaacgtgctttgagaataaatggaacagggtcccctgtgtcctcaaaaaaaaaaaaaaaaaa

SEQ ID NO: 13859 - DNA, 667 bp, Homo sapiens
ggtcgccatcttgggtccgctgtcggcgctgccgggggcgaaacgtaagaccggagcggasacgggaggcggagatgcaaagcgcgacaacttctgttgcgtcacttccgcgcgagttcaagttagtttctgagattaaccttttcggtgacgcggggagccatattgaaacctggaaacgatgaggctgcacggctcaccgtcwggataatggcaaagatggcctgcaagtgcgtgactctcgttatggaaatctctgtcctggagaggtgcttacgaaaagcgccatcttactctaggcaggtgcctggagtgtcctacgaggacgaggaccatattgaatcgtgacggattttcttacaggagtcacttcctaactgtagtctcctggcagaaaagaggcaacctccagccggtagtcccagacgaggtacctgcagagaatgatgtatgatctggtcatagacaccgtggatttcaactctccagagtctaaacgctgaaaacacccaacttgatttagtgccttacactctttatctccgatttttcaggacgacacctgttaaaattttttgccacactttcggcgtgtattccgattatctttttggaaaatttgatcctgttaaatagactatacgtgggatcaacccaattcctgata

SEQ ID NO: 13860 - DNA, 353 bp, Homo sapiens
  misc_feature 93: n=a, g, c or t
tttaattcaaaatttccagatttgggctatttctgtatgatccaataacttattttgtcacagggcttaatttgccatttttkgggatttgtngactcattttgtctgaattttcacaactggtattatgtcactagctacctgataccagttgtgaaaattcagacaaaatgagtcgacaaaccccgtatctactaaaaatacaaaattagcccgggcctgaatcccagctacttaggaggctgaggcaggagaatcgctggaactcggaaggcggaggttgcagtgagccgagatagcgccattgcactccagcctgggcaaaaatagcaaaactccatctcaaaaaaaaa

SEQ ID NO: 13861 - DNA, 498 bp, Homo sapiens
caggggactgttctcaccttaactcagccagaaagatgccctagttgtgatcaaaggtaactcgaggtggagggtatccctggggcccctcgacatcaccgtcattgatggagcctgaaccgtgtgctcctcggcagatgctgttgttgttacttccctccaagaggctggaaaagggctcagagctgctgagcaggaaccggaggtgacccatttcaggaggtgccggtaccagcctgactaggtacaggcaagcttgtgtgggcccaacaggccttggtagagctggtgccagatgtgggctcagatcctgggcatgatgggccgagccacctcggatcccactgattggccagccgagcgagaaccaggctgctgcatggcactgaccgccgcttccagcttcctctgagccgcaggcctgctacgcgggcaagcgtgctgcctctcttctgtgtcgttttgttgccaaggcagaatgaaaagtccttaaccgtg

SEQ ID NO: 13862 - DNA, 506 bp, Homo sapiens
taaatgaatgaatgacagaaaaagaatattctgtttaatccctacattactaccagcattatttttctaaaattcagatctgtttgtgctgttccttgtttagaaatattgtgtgacctcacawtgcctttagaatctggtatgaactccttagatggtgggcagaccttccctccatctgttctcatgctcagcccccacatggtacagtagaaaagtggcttcagctttcatgtaccttggtcaaataggggcaatagacactacctcaaggattgttgaaaggattaaatgaggccgggcatagtagttcacgcctgtaatcccagctctttgggaggcagaggtgggcagatcacttgagctcaggagtttgagaccagcttggccaacatggtgaaaccgatgtcaactaaaaatacataaattacccgggtgtggtggcacgagcttgtaatcccagctactcgggaggctgcgacaggagaatcgctttgaacccagga

SEQ ID NO: 13863 - DNA, 480 bp, Homo sapiens
cttctgtctttgtcctgggtgcttctgctttacaatgaacatgcagtcgtttctgtcacttggggagatttgaatgggagtaatctaaatcaggtcagcaaactgtggttccgtatgccagatctagcccacagcttgtttttgtgtgacctgacttaaaaatgatttttatatttttaggccaggcacagtggctcatgcctgtaatcccggcattttaggagactttgggaggcagcggatcatttgagtccaggaatttgaaaccagcctgggcaacatggtgaaaccccactctactaaaaacacaaaaaattagccaggcatggtggcacacacctctaatcccagctacttgggaggctgaggcattagaatcacttgaacccaggaggcagaggttgcagtgagctgagatcacgacactgcactccagcctgggtggcagagcaagactgtctcaaaaaaaaaaaaaaaaag

SEQ ID NO: 13864 - DNA, 378 bp, Homo sapiens
gagtgtgactcccatggtccccgtggggtctgtgtggttggcaatgagctctgtgctgtcagctttskatgagggagctccctggctggttcctgttctttggggtcttcctccccgtgactttgctgctgctcctcctcatcgcctacttcaggatcaaactgattgaggttaatgaagaactgtcccagaactgtgatcgccaacataatcccaaggatggctcttccctgtaccagagaatgaaatgacgtgaagttggggactttccaataactaaagcacaatgagtttctactggtcatcaagcaatggccaacagttcagctaataaagtaggttgataaactagaaccatagcaaaaaaaaaaaaaaaaa

SEQ ID NO: 13865 - DNA, 516 bp, Homo sapiens
atattcaaaaacaatagaagatggaatcctttgtaagggtaaacatttgacctattataaaacgtgactaagatgagggagagaggaaatacattaagagagtttcgatctttcaaaatgccatacagttttctgcttttctctctgatattaggtatgaggttaatttccaaaatggaatagaatgtggtggtgcctatgtgaaactgctttctaaaacaccagaactcaacctggtatgtaattcccatttctggaatgtggctggacacccactattaccttgtaagaattttgtaattgggccgggtgcggtggctcacgcctgtaatcctagctcccagcactttgggaagccaaggcaggcggatcacgaggtcaggagattgagactatctggctaacatggtgaaacccatctctactaaaaatacaaaaaattagccaggcgtggtggcaggcgcctgtagtcccagccacttgggaggctgaggcaggagaatggcatgaaacctg

SEQ ID NO: 13866 - DNA, 491 bp, Homo sapiens
gaaaataagtattaaaagatatggtttccacttccagtagttttcaatgctctttgctgtttcaggggtataaactaaataagtaaagcaagatggaaaaaaattagcaaatgacaactttaaataataagcttttaactagaaaattgataaaccaagagtaaatatttaaggattataaatatgcatactaaacaccctttcatgagatcagatggtgggtttcaattttacataaaaattatggtaactggaaaccgggcggattaagtagtgtagatgaacagacaagatattgcatatgtgtagaggaaagataaatatttgtattaggtgccattcaaatatggtagtcttttcactacatagaactatgccttgaaagcaatagatactacactgtataacttaattattaacttaagctctgattaagcaaactcagtaaaactttcaattgtccctcagacttgaaatgtattactgcatca

SEQ ID NO: 13867 - DNA, 479 bp, Homo sapiens
aatgaaatttctgtggggctctatttttgctttggctttctggtgagagagtgaggaagcattctttccttcactaagtttgtctttcttgtcttctggatagattgattttaagagactaagggaatttacaaactaaagattttagtcatctggtggaaaaggagactttaagattgtttagggctgggcggggtgactcacatctgtaatcccagcactttgggaggccaaggcaggcagaacacttgaaggagttcaagaccagcgtggccaacgtggtgaaaccctgtctctactaaaaatacaaaaattgtttagctctgtttttcataatagaaatagaaaaggtaaaattgcttttcttctgaaaagaacaagtattgttcatccaagaagggtttttgtgactgaatcagcagtgcctgccctagtcatagctgtgcttcaaraacctcagcatgattagtgttggagca

SEQ ID NO: 13868 - DNA, 468 bp, Homo sapiens
attctccatcccacgtcctccagtgccggggtcacggtcgcagcacccggcgttcccgttggctcttttgccgctgcgcgagccggcggtttttctgtcacagcacttgtacggagtttctcggcggccgaacgtctctttttttctcagagacgacggtttcttggtgacagtaccgttggttgcgccgtaacgaatgttctcctttacagccccaccagctggcgtcactcgcaggctccagacgccgccatttcgccgagccgaggtctcttggttgcggcactgcttctggctcggtgcctgtattttctcggtgcctacagcgcccaggtcaccgatctgagggcttcggagtaccggccgggcgcggtggctcacgcctgtaatcccagcacttttgggagggccgaggcgggcgggatcaggaggtcaggagatcgagaccatcctggctaacacggtgaa

SEQ ID NO: 13869 - DNA, 382 bp, Homo sapiens
tgctcggcattgagggtagaaagacttttcgaaggtggcagggtgtttcttaagatcattgaaccttaaaatgaaagtgtaggccgggcgcggtggctcacgtctgtaatcctagcactttgggaggccgaggcgggcggatcacgaggtcaggagatcgagaccatcctggctaacacggtgaaaccccgtctctcctaaaaaatacaaaaaattagccgggtgtggtggcgggcgcctgtagtcccagctactcgggaggctgaggcgggagaatggcgtgaacccaggaggcagagcttgcagtgagccgagatcgcgccactgcacttcagcctgggtgacagcgagaatccgtctcaaaaaaaaaaaaaaagggaaa

SEQ ID NO: 13870 - DNA, 268 bp, Homo sapiens
attattattattactccaatatcttaccaccctaacgcagggaagttcttcctgttatatcacacaaatcttcctcagtgcaacataagcttcaatttcctctatgactacattattgacttgacctactcacttggatccctgcctcctgcactgactgattgactgattaatcaggagagaggtcagaagagctaaaatttggaaacaacctaagtgtccatcaacagatgaatgaataaagaaaatgtgatacttaaaaaaaaaa

SEQ ID NO: 13871 - DNA, 534 bp, Homo sapiens
ctcaggtggagatgtggccactgttgactgctgagcagaaccacctccttcacctcgttctgcaagaaaccatctccccctcaggacagggagtctgatccatcccattcacccagtgacttctttttgcccaggcctggactttttgcatcagtcacgttaaccagatgactttgcctgttaccaaacctcatgcatccacgtttgcgtctggggaggaataaaaagacatcgttcccgcttctgcgttttgttattcctactgccgccataggaattatttcgttggctgaacgttaccagcaccccgagaacacattttgatagaatcagagtagaggacatggctgtcttctaaataagccacgacatgaaaatgacaatccctttcgtctccttcctccgctgcttccacctaacgcagcctcctgcctccgcctttgtttcatagtgaggattttattttgcacggsgccctccctctaaatacctaccctagatgatttcatcctgccctcacttcttaacatattc

SEQ ID NO: 13872 - DNA, 278 bp, Homo sapiens
ataagtgtactctgttgatctaggcaacagggcatggaggagagtatggaaacaagaatttcattatcacttggtcaagaccaaccattacagataagaatcttggtatgagtcatttccactgtccccccaacccatctgtgtttaaaaaatggagactgctattgaagatcttggtgatgttatctttcagcatatctgctctttgaattgcagtgttccagtcaagactggttaccctctgcttctgtacagctgttgttttgaaatataatgat

SEQ ID NO: 13873 - DNA, 386 bp, Homo sapiens
taagtgaataatataggtgcacagaaataggactgaaaagctgaaggtaaggaaggaaagagataagaataacaaatgggccaggcgtggtggtggctcacgcctgtaatctcaacactttgggaggctgaggtgagaggatcacttcagcccagaagttcaagaccagcctgggcaacaaggcagaaccctgtctctacaaaagataccgaaaaagcacaattagccaggtgtggtggcacacgccttcgtcccagctacttgggaagctgagatgggaggattgcttgagcccaggaggcccactttgctgtgagccaagatcatgccactgcactccagcctgggcaacagagcaataccctgtctcaaaaaaaaaaaaaaaa

SEQ ID NO: 13874 - DNA, 379 bp, Homo sapiens
attaattatatcacaaatttataagaggctggaaatgcaagatttacatctgagtttttcacctttaattaaaaatattstctgggtcgggtgcggtggctcacgcctgtaatcccagcactttgggaggccgaggcgggtggatcacgaggtcaggagatcgagaccatcctggtgaacatggtgaaacccgtctctattaaaaatacaaaaggaattagccgggcatggtggcgggtacttgtagtcccagctgctcgggaggctgaagcaggacaatggcgtgaacccgggaggtggagcttggagtgagccgagatcccgccactgcactccagccagggcgacagagcgagactctgtctcaaaaaaaaaaaaa

SEQ ID NO: 13875 - DNA, 502 bp, Homo sapiens
  misc_feature 498: n=a, g, c or t
cagtgtccttcatgtctcagctcctgtcttccaataattttctgaaaaaggtaatgtgttctttaaatgtgtttataaaaaggtattctgctgtctccaaggaactgttctcaaccagtagaagtagcttggtaaatggctcatgaaaatgggaggcacgcctttaaagataatagaacaagaaagtacgtttcaccatgaaaagccgttcgtcatgatctactgagatggaacataatgtaaactctgtgactcagtggtttcattcttaagtgttgtgtacccatcagaagtttatgaacctgtacaccaaaaaaactacaagaatctttataatattcataacattcttcatggtagcacaaaactggtaacaactccagtgtctaccagcagagtagataaattgcctgtattttattttattttttgagacaggtctcactccatgtcccaggctgaagtgcagtagagcaatcatggctcactgcaacctgnaact

SEQ ID NO: 13876 - DNA, 239 bp, Homo sapiens
  misc_feature 136: n=a, g, c or t
aatggccgggcacgtggctcacacctgtaatcccagcactttgggaggccgaggcaggcagatcgcctgtcaggagttcaaggccagactggcaacatggtgaaactcatctctactaaaaatacaaaaattagtngggcatggtggcagagacctgtaatctcagctgctcgggakgctgmggcaggagaatggcttgagcccaggagctggaggttgcaggtctctgccaccatgcc

SEQ ID NO: 13877 - DNA, 75 bp, Homo sapiens
cttcctctcctgggccgtcctctgagcagcagacggggctaagcgttccccagctcgccttcacacacagcccgt

SEQ ID NO: 13878 - DNA, 248 bp, Homo sapiens
aaaacaaccgactcctttccaggtgaagggtgacttgggtacgttggggctttgagcgagcctccccgcaccctcccataggaccccaggacagactgcgtcctcgctgacccgccctaggctgaagaaacacttaaattctggaaatagcgactcagtatcatggccagcagccttaatgaagatccagaaggaagcagaatcactttatgtgaaaggagacctttttgcatgcccgaaaacagact

SEQ ID NO: 13879 - DNA, 480 bp, Homo sapiens
gaaaaataggatcctgccatcccaaagacagctttcgtctaagagccatatgtgagagagtatttaagccagccctgatacgaaacggagctctaaatagaacaaatgctcaaattcagaatgttctatttaaagtaaaatgctgttaattggcaagtgtgacgcttcctgccaccccataggctgtgggctcatgggaaagatccaagcagtttggagaatacctacctgaccagcactaacctaaggagtttgtataaatctaaattacaatgtagcaatttatagtcaggaatattttgattaggcaattcagaatccttgtaccagcctgttaatgccttcttccatctgcagcaaagccaacaagcagagcaaatgtataagagaatggtgcttggtgagtgtggaattggagcattgcagracaccacacattctcactttggagcccttttccaatactctgcatgcacgact

SEQ ID NO: 13880 - DNA, 481 bp, Homo sapiens
caaatcattaaatcattgaaatatttctaagcacccagctacttgacatcattcagatagaatgtgttcatgaaagaacttgctccatttattcagaaatcgttattgtataaacctagattttgtccattcattcagtgttgaatatgcccaaaggtgtcactgatctagaagtggagtaagttgaatctgctagaatgcttagagatgtttgtttccttttatggtcagctaaagaagatatttctaaatatttattagctgtgcaggtaggttataaactaggttttcagcagttttttaacttttatctgaaataattatagattcataggaagttgcaactgtagtacagagaagtcccttgtacccttcaccagtttcctccatggttacatcttacataatatgctataatgtgaaaaccaggaacatgacattggtacaatatgtgtatatagttctatatcattatatcaca

SEQ ID NO: 13881 - DNA, 433 bp, Homo sapiens
aatggaagaagatacagtattgtttagatcagaatcattaaaaaatatttttgtttagtaagtttgaagatttctggcttttaggccttttctattttgttccatttatttttgcaggcaatcttttccatggagggcagggtatccattctttaccatgggtgtacctgcttaggttaaaaatcataccaaggcctcatacttccaggtttcatgttgcgtcttgttgagggagggagagcaggttacttggcaaccatattgtcacctgtacctgtcacacatcttgaaaaataaaacgataatagaactagtgactaattttcccttacagttcctgcttggtcccacccactgaagtagctcatcgtagtgcgggccgtattagaggcagtggggtacgttagactcagatggaaaagtattctaggtg

SEQ ID NO: 13882 - DNA, 242 bp, Homo sapiens
gtttcactgcagaaagtctccactgcggtatgctgacatctgccctgaaccttcaccctacagcattacaggctttaatcagattctgctggaaagacacaggctgatccacgtgacctcttctgccttcactgggctggggtgatccttggtgcctttgtttccacaaggccttttcctgccccctgccttgccaaagacatttaatcagcacacagctgccagactattcccacagtgct

SEQ ID NO: 13883 - DNA, 387 bp, Homo sapiens
taagtgaataatataggtgcacagaaataggactgaaaagctgaaggtaaggaaggaaagagataagaataacaaatgggccaggcgtggtggtggctcacgcctgtaatctcaacactttgggaggctgaggtgagaggatcacttcagcccagaagttcaagaccagcctgggcaacaaggcagaaccctgtctctacaaaagataccgaaaaagcacaattagccaggtgtggtggcacacgccttcgtcccagctacttgggaagctgagatgggaggattgcttgagcccaggaggcccactttgctgtgagccaagatcatgccactgcactccagcctgggcaacagagcaataccctgtctcaaaaaaaaaaaaaaaaa

SEQ ID NO: 13884 - DNA, 85 bp, Homo sapiens
agcgaggaggaggaggaggcggggyyakgwarrgmtatggttgcttggagagtgcatccggcccggtacttgtgatcggaggaga

SEQ ID NO: 13885 - DNA, 403 bp, Homo sapiens
catggttaaatcagcagatggagtaatcgtttcaggagtaaaggatgtagatgatttctttgagcacgaacgaacatttcttttggaatatcataaccgagttaaggatgcatctgctaaatctgatagaatgacaagatcccacaaaagtgctgcagatgattacaatagaattggttcttcattatatgctttaggaactcaggattctacagatatatgcaagttttttctcaaagtttcagaactgttcgataaaacaagaaaaatagaagcacgagtgtctgctgatgaagacctcaaactttctgatcttttaaaatattacttaagagaatctcaagctgctaaggatctcctgtatcgaaggtctaggtcactagtggattatgaaaatgctaat

SEQ ID NO: 13886 - DNA, 343 bp, Homo sapiens
agtctatgatgttctgtgacagcagcctgagctgactgaggcagaggggaagtactgttttaccagctccagacacaggcccaagagcattgtggatttctgcttgctctcttggctcctcttctccttctccaagagaacaagcccaagctagtctgctgtaggatgggaggccacatggaggagctgatcctgacatcccagctgatgcctcatacgtttgagtgagccccaatgacaacagctgaggttggcccagactggaagaactgccctctgagcccatttaaattactgccagcagaattgtgacctgaatgtatgctgtcttaagccactaatt

SEQ ID NO: 13887 - DNA, 211 bp, Homo sapiens
cataggatgggcctagatgaggggtccaggctgttacgtcagtaattgcatcaagggcctgagttcaaagttaaaggaaattcaaagtcaaagttcaaatttcaaaggaaattgatggaatctcaacagagatcctgagctctggatcaaagccccaggagcactggtggttaaaaaaaaaaaaaaaaktcaasagrggcccaggtttaag

SEQ ID NO: 13888 - DNA, 513 bp, Homo sapiens
attgagcacctactacatgccagacaccctactgggtcacagggagacagcaggaagtggaagaaacaaaaatccctgtccagctggagcatttgttctcaggaaggagacagatgacaagatgcataaggaaaagatgtgatattaggtagtgacaagccctaagggaaggggggttggtatcagggtggtggcctcaaagttcattaagtcactgcctagtagccaggcacggtggctcatgcctgtaatctcagtactttgggaggccaaggtgggtgggccacctcaggtcaggagttcgagaccagcctgggcaacatagtaaaaccccatctttactaaaaatacaaaaattagccgggcatggtggcatgcacctgtaatcccagctactcgggaggctgaggcatgagaatcactccctggtggccccatcccccagttcctcacgatatggtttttacttctgtggatttaataaaaacttcaccagttaaaaaaaaaaaaaaa

SEQ ID NO: 13889 - DNA, 447 bp, Homo sapiens
attggtgtatggctttgcagcaataactgatggctgtttcccctsctgctttatctttcagttaatgaccagccacggcgtccctgctgtgagctctggccgctgccttccagggctcccgagccacacgctgggggtgctggctgagggaacatggcttgttggcctcagctgaggttgctgctgtggaagaacctcactttcagaagaagacaaacatgtcagctgctgctggaagtggcctggcctctatttatcttcctgatcctgatctctgttcggctgagctacccaccctatgaacaacatgaatgccattttccaaataaagccatgccctctgcaggaacacttccttgggttcaggggattatctgtaatgccaacaacccctgtttccgttacccgactcctggggaggctcccggagttgttggaaactttaac

SEQ ID NO: 13890 - DNA, 488 bp, Homo sapiens
ttaagacaaggatggtgaaaggaagccctttaaacagttaagtgtagaaaaattcctgtttctttaagaaagttccagcatttcatcacagcagattataatcctctttttaaaaaacactaatgttcagacctactagttagtggcataatagaacatttagccgtcacctggctaaacatttttttatttaaactttttttttaaatttctgtgcatatgtagtagatgtctgtatttatgaggtgcatgagatgttttgatacaggcatgcaacgtgaaataagcacatcttggagaatggggtatccatcccctcaagcatttgtccttggagttacaaacaatccagttacactcttttaaagttatttttcaatatacaattaagttattattggctgtagtccccctgttgtgctatcaaatagcaggtcttcattctttctattttgtttgtacccaagccgtcacttggtattgatgtg

SEQ ID NO: 13891 - DNA, 574 bp, Homo sapiens
atagtaggaccactcgtttctaacatgagagaatgtgcctggctgctttggacaccatcttgcttggacatgcacatgtgagcagaggttacctaaattccgttgctggtttcaatatggactcctctctagcacttttctatttaagtaactgaaatttaatgacctagaggaaacagaggcagttgaattaaaagatttgtaactatgcacagtcaattatgacctctgctgttagctatggctcactaaaggctgattattttcatttatatgttctgcaaacactttaacttcagagtaattaaaacctaaacttcaaatttttccggaaaaccaggactctttccaactgtcccattttttaaaactaatggtggcaaaattaaaccacctgtccaaagctaaaagacagttataacttatcaagccctacaaatatgtgttaatgccagccatttttttccataagttaccagcattctccagaatttcatcagcaagaatggagtgagaagtttataagtggtttttctcactaatctttatcactcccatacattttatctgcaat

SEQ ID NO: 13892 - DNA, 487 bp, Homo sapiens
cttctgtgtaaatggtactagagaaaacacctatattatgagtcaatctagttagttttattcgacatgaaggaaatttccagataacaacactaacaaactctcccttgactagggggacaaagaaaagcaaaactgaccataaaaaacaattacctggtgagaagttgcataaacagaattaggtagtatattgaagacagcatcattaaacagttatgttgttctccttgcaaaaaacatgtactgacttcccgttgagtaatgccaagttgttttttttattataaaacttgcccttcattacatgtttcaaagtggtgtggtgggccaaaatattgaaatgatggaactgactgataaagctgtacaaataagcagtgtgcctaacaagcaacacagtaatgttgacatgcttaattcacaaatgctaatttcattataaattgttttgctaaaatacactttgaaactatttttctgtatt

SEQ ID NO: 13893 - DNA, 503 bp, Homo sapiens
aaaagagactgtcaggtcaccaaacagctaattaaagcaataaagagtcaggaaggctaaatggcccctttcttcctcaggagcctaaggtcccttgtaggaacctgcatggttcttcttccctggaagtgcagtccaagatggagaggatattggggaatgtcccagcaagccctcggatcagaaaaaggatgaagagggcctgctgatgctgaaccaaagagccgcactgcaagataatgaatcataacagcagagagaggaggaagtgactccaatcagcaccctccatccggaaggcattccaccttgaattatggcctggtgtaagaaggggaaggaatcagtattcccatttgacggatgtgaacattgagaaaaacagagtgaatttcggcaagtgtaactggggtggcattgaatcatcaaggtccagtcctttagctgggctccagggagaaggtgaaaaattcacccagagacctcttggagatagtaataca

SEQ ID NO: 13894 - DNA, 100 bp, Homo sapiens
atttttgaggattcctgtattctgtatcctctcctcgcatctcctcacatggaaagaaataatgtatttgtgccttctgtgaggaatggggggaacaagt

SEQ ID NO: 13895 - DNA, 138 bp, Homo sapiens
acctgtcattcgttcgtcctcagtgcagggcaacaggactttaggttcaagatggtgactgcagccatgcystacagtgctgcccagtgcttgcccggggccccacaagcctcctaggcaaggtggttaagactcacc

SEQ ID NO: 13896 - DNA, 388 bp, Homo sapiens
  misc_feature 11,28,30,33,45,47,179: n=a, g, c or t
atcggtgtgtngcarggtcatgaaaaancndmnhmhgcrggaganangargawgcggcggcggggcagtgaaactacggtagctgccccctragctggtggtgtggctttrtrgggagggcgtagttcctaatcccctttccggrcagccgccggggctcggggctgtragcrgccgtnagstgcctccccgggccccctgcctccgccatgttccgcaggcacgccttagcgtgaagccgaatgtcatgcctggtgtaggcrccaggggctccacagcttccaatccccagcgtggacgggagtctcccaggccgccggagcctgccacggactctgcttccaarcccgcggasccacagatgtrcccacagtcgatttcggtggag

SEQ ID NO: 13897 - DNA, 543 bp, Homo sapiens
tttttttttctctctcgctcgctctccttctgcgtctcttctctccctcctgccctcactgtctgggcctccttctctcttgctcccgtttctctttctctcctcctctcaatatatactgacccttttataaacccaccctcaccgcacccagctgaggtcggctgccagtgggagggcccaggcactccggttcctctttctttgggcccccacccaatccctccagacagacatcatctggggctccctcccagggttgagatgagaaactcttggaatggggttcttggggggggcaagcgtcaggggtgggagggcccgattctcaggacccttgagttttgaggtcttgccctggggccggatgtctgctttccctgatggagcttggagctggataggagtctgggaaaagaggccagatttctgtggcatggacttgagattgggctggtgaagttggccccgtggtggggggtcagaggatgggagatgaaatttgtgaaactcggcagggcgttgtggctcasgcctgtaatc

SEQ ID NO: 13898 - DNA, 521 bp, Homo sapiens
atacattttacttttcctgcatggactgttttcttcacgttgagttgtattttaagtgtttcatggtaaactttcccgagatgtttgctaatgttaatctgcttaatagtttttttttaaattgaggtgtatgtacatacaataaaatgtgtatatcttggctgggcatggtggctcacgcctgtgatcccagaacttcgggaggctgagacaggtggattatggattcttaatttactacagtttagtttatgttagttggttttattacttcccaggaaatgcaagaactgtacatttagctctttacctccttcttgtcctttgccctattgatggtatattttcttataaacctctaaagcaacagtattattgttttacatagttgctgaggtctggccagtcgtggtggttcacgcctgtaatcccagcactttgggagatgaaggcgagtggatcacctaaggtcaggagttcgagaccagcctggccaacatggtgaaacccgtctctactaa

SEQ ID NO: 13899 - DNA, 133 bp, Homo sapiens
  misc_feature 26: n=a, g, c or t
gtagtggtggtacgggtccgactgangggtactcgccaccggctgcgtccacccgadcrgctgcgagadccaaggcccgarggggtrrgcgtrrcggccgccgaaacacaaccccctctgttccctctcttcr

SEQ ID NO: 13900 - DNA, 127 bp, Homo sapiens
actgtggctaagtgtggggaccagacaggactcgtggagacatccaggtgctgaagccttcagctactgtctctacccactctttgctacaataaatgctgaatgaatccgaaaaaaaaaaaaaaaa

SEQ ID NO: 13901 - DNA, 103 bp, Homo sapiens
gatggcgtagtttcctggggacccagctgggtggraaaagtggctaggagttagcttgggagccgctggtgttctgagcrmwcccctctctggccactttttc

SEQ ID NO: 13902 - DNA, 131 bp, Homo sapiens
cwttttttttttttgtccgacatcttgacgaggctgcggtgtctgctgctattctccgagcttcgcaatgccgcctaaggacgacaagaagaagaaggacgctggaaagtcggacaaaaaaaaaaaaaaaa

SEQ ID NO: 13903 - DNA, 176 bp, Homo sapiens
ccattacgccccatctcgctctgtgcccctccccaccagggcttcagcaggagccctggactcatcatcaataaacactgttacagcaaaaaaaaaaaaaaaaaaaaaaaaaaaaaaaaaaaaaaaaaaaaaaaaaaaaaaaaaaaaaaaaaaaaaaaaaaaaaaaaaaawtaaar

SEQ ID NO: 13904 - DNA, 74 bp, Homo sapiens
atagccctggtacatggtacacacccccccacctcctgcaattaaacagtagcatcgcaaaaaaaaaaaaaaaa

SEQ ID NO: 13905 - DNA, 259 bp, Homo sapiens
agacgaacggaagawrgmagmrgcggcggcggcggagtgtaggaagaggcactgctgarggggcgcgargggaacggaggccagagctgcgaggttagctgggcatggtggcatgtgcccgtaatcccagttgcttgggaggctgaggcgggagaatcacttgggcctgggaggcggargttgcagtgarctgggatcgcaccaccacactccaacctgggtgacagagcaagacttcatctcaaaaaaaaaaaaaaaa

SEQ ID NO: 13906 - DNA, 159 bp, Homo sapiens
tacaaaaattagcttggtgtggtggtgcattgcctgtagtcccagctacttgggaggctgaggcaggaggcggaggaggttgcagtgagtcaagatcatgccactgcactccagcctgggcaacagagtaagaccctgtctcaaaaaaaaaaaaaaaaa

SEQ ID NO: 13907 - DNA, 276 bp, Homo sapiens
ttctcagcaaactattgcaaggacaaaaaaccaaacaccgtatgttctcactcataggtgggaactgaacaatgagaacacatggacacaggaaggggaacatcacacattggggcctgttgtggtgaagrgggagtggggagggatagcattaggagatatacttaatgttaaatgacgagttgatgggctcagcacaccaacatggcacatgtatacatatgtaactaacctgcacattgtaccctaaaatttaaagtaaaaaaaaaaaaaaaa

SEQ ID NO: 13908 - DNA, 181 bp, Homo sapiens
actaaaaatacaaacattagctgggtgtggtggcacgcgcccgcagtcccagctactcgggaggctgaggcaggagaatcacttgaacccaggaggcagaggttgcagtgagcggagactgcgccgctgcactccagcctgggtgacacagtgagacttcatctcgaaaaaaaaaaaaaaa

SEQ ID NO: 13909 - DNA, 69 bp, Homo sapiens
actaaaaatacaaacattagctgggtgtggtggcacgcgcccgcagtcccagctactcgggaggctgag

SEQ ID NO: 13910 - DNA, 186 bp, Homo sapiens
aactcgccgcagcctgcgcgccttctccagtccgcggtgccatggcccccgcccgtctgttcgcgctgctgctgctcttcgtaggcggagtcgccgagtsgatccgagagactgaggtcatcgacccccaggacctcctagaaggccgatacttctccggagccctaccagacgatgaggatgtag

SEQ ID NO: 13911 - DNA, 600 bp, Homo sapiens
cagatagagaaaacacccattatagagctgtggagcccttacgatatagtgctatgctgcaacaaattagacagaagagtatttgttgaataataaaagttttccaataataacatagaaaaaaggaagaatttgagagtttctcagattaggcaattccttgaagaatctgagaacacagaagctcccctccctactttccatgattgaaatcagtgattcattggtttctttgtgtgggcttttgaaagatcattagaaaccaacctgaagatcatgagattcttgtggacacaggagcaatgagtggcaatacagtgctttctaatccaacctactttaaaagttgctggaaggcagttcaagtaactgccttagtatcaattgttattatttcgaattggttatgaagttgaataagtttggagtatccttaaccatactttttctaatccaacctggagatgttccatgaaggaaattctggaaattatggttctgacttctttgcaatgtagaggacaccacggaaggggatgacaaggactttgagtgatatttcccaaaacatgttctccaagctgttaatattctatgtaa

SEQ ID NO: 13912 - DNA, 183 bp, Homo sapiens
actaaaaatacaaacattagctgggtgtggtggcacgcgcccgcagtcccagctactcgggaggctgaggcaggagaatcacttgaacccaggaggcagaggttgcagtgagcggagactgcgccgctgcactccagcctgggtgacacagtgagacttcatctcgaaaaaaaaaaaaaaaaa

SEQ ID NO: 13913 - DNA, 473 bp, Homo sapiens
acagcaagtctggctagagtttctcaagggtgtgcccatggggattagtggaaagagctctgtgcttgggttgggtggtttgcccactccaccttttattctccttgggtaagtggcttgggacctcatttgccctttccaatgggatagcaacatgtttmtttttggaagctacwgtgaaagatgatgatctgggagggacttgggacacaggcttatttgttacacagatgctaccggccttgcatctctcttgtgagctcagaagttgcttgacatcactgcctttttcatcaggtggttcataggaagaggccaaaagagagagaaggatgctgtatttatgggaaaaggctaccagaatttccatccgaggttggtggtccattcctctacctatgtggaaggcaggttctccttgacaatagccaggtctgcatgtgtcttccactcaatctacaacgtacccacgg

SEQ ID NO: 13914 - DNA, 254 bp, Homo sapiens
agagggccttggggcacagtccaatgaggagcgagccgggtggccggctgaggggcgtgcttcatgctcgcgggatttttaaaaatggtttctcctggatcttatcccaactgcgcctgagaccttgtttcacctcctgatgtgctgggtgtggttaggcctcgagccgggagctatttgcctcccaggaggaagccagggcagggttccgcggggaatggcggtgagggagccactcgggacgcggaggccct

SEQ ID NO: 13915 - DNA, 75 bp, Homo sapiens
atagccctggtacatggtacacacccccccacctcctgcaattaaacagtagcatcgcaaaaaaaaaaaaaaaaa

SEQ ID NO: 13916 - DNA, 181 bp, Homo sapiens
actaaaaatacaaacattagctgggtgtggtggcacgcgcccgcagtcccagctactcgggaggctgaggcaggagaatcacttgaacccaggaggcagaggttgcagtgagcggagactgcgccgctgcactccagcstgggtgacacagtgagacttcatctcgaaaaaaaaaaaaaaa

SEQ ID NO: 13917 - DNA, 67 bp, Homo sapiens; identical to SEQ ID NO: 11909

SEQ ID NO: 13918 - DNA, 108 bp, Homo sapiens
tacaaaaattagcttggtgtggtggtgcattgcctgtagtcccagctacttgggaggctgaggcaggaggcggaggaggttgcagtgagtcaagatcatgccactgca

SEQ ID NO: 13919 - DNA, 437 bp, Homo sapiens
caaaattgcatatttaacagtgtctctcccctgctaagctctctgagaagagaatcttttttaagttttgttttgcattgacacataatatttgtgcatatttatggggtacaataatgatgtgagtcttcacattaaccttgtagctgtgcctgacttatagtaaatgctcagatwtttttttagggggaatgagcaaagtttttttaaaaatcagtaaaacataaatatacttgttgggcaaaaggaaaaatgttatatgtattttttckgggcatgcttatttctgatttatcaatatttaacaaatttcagccaggcacagtggctcatgcctgtaatcccagcattttgggaggccaaggtgggaggattgcttgagcctaggagtttgagaccagcctggggaacatgtgaaaccctgactgtacaaaaaa

SEQ ID NO: 13920 - DNA, 64 bp, Homo sapiens
ctggtgggttcaggcttctctgggtcactgcatcaaggcactgtaccttgagagtgccaaggac

SEQ ID NO: 13921 - DNA, 463 bp, Homo sapiens
tccagatggtgacgagaaggacataacgcaggacaattctgaattaaaacacagatcctcaaagaaagatttgttagagatagacaggttcacaatttgtggaaaccgaattgactgaatctgtggcttcatgcgctgaagaagctgggtcctggggcaacaagtgctgtgttgccaggracaaatagatgctaaacatggcacttaaatatttatttaaaaacttaaattattattggcaagcaaatcttagtatctttcttccagtaatatggcctggctgagggtcagaccacaggacaggagcgacctccggscttgactgtctgggaagcttgatggattataaaacttcctcmtgsctggccaagcagcagcatcatttccaggacccaacaaaggcaacatcaaaatctgttttgstttgtcagtctgggcttccagaatgttgaatttgcctcaa

SEQ ID NO: 13922 - DNA, 691 bp, Homo sapiens
aacttgcagcatagtattacttctttgatgttctcattagcataatgttatttttgaaaaggaaagatactatcacataagttttcctcatctgttgtgatatacaccaatggataaactaacggaaactgctttttgacattaaaagacaggagaaattatatttaactaagtaaaagttaagtcagaattacttgggtgatgtgattcaatttagttaaaggatgatatagagaaaatacattatttagcattatttcttcagctataatgaattgctatagaaatcaggcagatctttctaatgtgtattgattggtcttttcagctactctgaacagattactaaggccatctcctcatctctaagggagaaaaatagtctgtagatgaataatgtaaggtaaagagttgcatgtcagtctttgtaattatttacactttaactttctccagaactcagacatgatttcaacatggtgttagatttgtgcattttattttcctgaccacctcattccagccaatgtatggttatccactctgtgtgccaaaaccaatcatgcctttcacggccctttagttcagagaagttctgcactgatttttagtctcttgatgtctcaatcttacatgtataccaatcacaatggaataaagtgttgagttgtactgtgaaaaaaaaaaaaaa

SEQ ID NO: 13923 - DNA, 381 bp, Homo sapiens
tacttgctagagtttgcagcggtcaataataaagtattaactaacctgagagaattgagaatatgyaactaacctaagaacagcaaggtattttacatwcagttttgcattcatgtagtattttgaacttgtttaacaaacaaaatttgtgctaaccatgatagcttctattaaaavaaaaaarttctaacctacsctaaaagctagggctgtatttagaaggcattacttttttmatcctcctctcttgccttaaagagggctctgggccgggtgcagtggctcacgcctgtaatcccagcactttgggaggctgaggcgggcggatcacagggtcaggagatcaagaccatcctggctaacatggtgaaacccatctct

SEQ ID NO: 13924 - DNA, 450 bp, Homo sapiens
  misc_feature 34: n=a, g, c or t
actcctaattcttgtttctgccttttattttbvnaracagggtctcgctgtgtcacctaggctggagcacagtggtgtgaccttggctcactgcagcctctgtctctccagttcaagcatctgctagcctcagcctcctgggtagctgggactacaagtgtgtaccaccacgcctggactaattttttaaatttgttttagagacaagatcacgctgctgggcgcggtggttcatgcctgtaatcccagctctttgggaggctgaggtgacggatcgcttgagcacaggagttgggaggccgaggtgatggattgcttgagtgtaggaattcgagaccaggctgggcaacatgacgaaaccctgtctctacaaaaaatacaaaaaytagccaggtgtgatgctgagcacctttggtcccagctgctcaggaggatcgcttgagccaggtg

SEQ ID NO: 13925 - DNA, 356 bp, Homo sapiens
caacattggtttcccaatatttaatataaatataccatataatatattgtttgtgaattattgagaaatgtaacattcaaatttctaaaattgtctgccaaaggcttattcattctggttttgtttgctgttgggtgtttggggcagagttaaccatttctccatggtgtctttawactttactggtttgtgaattttatacaattgaaagtctttttttcttgcttctttcttctcttctcaagtttcccccctgtttctactttattgtttgtcctaaccatttctactacagttttttccttatggacccatactaggttgtacaaaccttaaggactcgttaccatttgcag

SEQ ID NO: 13926 - DNA, 447 bp, Homo sapiens
tagacattttcatgatgtgcctacttctaacatttccttgtagacgttgtttgaggtttctttgctgtattagttattaatgttttaagtacataggtgaggctctttaggggatatcaaaaatgtaagattaggtcatcctctttaaacccgcccacttaagtatgaatttttgaaaacctcagatcatctgtgcatgaattttagatactcagtgggaacaactagaaaaagggaatggatagagaagaataaatcacatagcagcaggaatagaagattttgctaatttttcagcatatttggaatataaactgaggtgtgatgtggcataaagttaccatgcatagatctggacacaaaaagtgtacagcaagtaaacttgacgagtgtgacatgaaaagttgtatttgatctcatagattaacagtacgttttaatagagta

SEQ ID NO: 13927 - DNA, 477 bp, Homo sapiens
actcctaattcttgtttctgccttttatttttgagacagggtctcgctgtgtcacctaggctggagcacagtggtgtgaccttggctcactgcagcctctgtctctccagttcaagcatctgctagcctcagcctcctgggtagctgggactacaagtgtgtaccaccacgcctggctaattttttaaatttgttttagagacaagatcacgctgctgggcgcggtggttcatgcctgtaatcccagctctttgggaggctgaggtgacggatcgcttgagcacaggagttgggaggccgaggtgatggattgcttgagtgtaggaattcgagaccaggctgggcaacatgacgaaaccctgtctctacaaaaaatacaaaaattagccaggtgtgatgctgagcacctttggtcccagctgctcaggaggatcgcttgagcccaggtgttcgaggctgcagtgatctgtgatggtg

SEQ ID NO: 13928 - DNA, 109 bp, Homo sapiens
ccattacgccccatctcgctctgtgcccctccccaccagggcttcagcaggagccctggactcatcatcaataaacactgttacagcaaaaaaaaaaaaaaaaaaaaaa

SEQ ID NO: 13929 - DNA, 388 bp, Homo sapiens
  misc_feature 19: n=a, g, c or t
ctccgcgctckctctccknctctcctgcgccaactgggcgaccgcgacgccaacgccgacgacctacgccaggtgctgggatttttgtcggttccttcggcagctttcgtcgcgtccttcgccggcgacgagcactcaccaggtccgctcctgaagaagactgggatattttrgcatacacagaggatcatctgtgtagaggacattcagttttctccagttctccagttcctggatagcaatggcaaatgagtttcctgatgaagttcttaagtctgtttttccattgctggatggtaaagatctagtattctgcatgcttgtatgccgtcaatggcatgaaatcgcaaaggatgattacttctggaaatgcatttgctcacggaag

SEQ ID NO: 13930 - DNA, 221 bp, Homo sapiens
tttacctgacaaggaaggaagagctgctccacgtgcagagcaaggtttcagaatgagaggagaagagcaggcactsagagggtgagggaaagggcagcagtggactgggaagccctcaggtggaggtcagcattgcttccctcagatcatgggtgaatttgaggaactcagttaatatctttgtatgttcctccctccataaggtgagaacaagcacatgc

SEQ ID NO: 13931 - DNA, 463 bp, Homo sapiens
gagggactggccgtmrcatgtgaagctttattgccaatcttcattgaactcacacttcaaaagtcatggttttctctttgttttattgtaattttctgttttattataaagaagattgcagaaaagaggcagaataggagagctgaaagacaaaaaaagagtatctaaacaacagaggacacatactggaatctctggagctcatcccttcagagggcccttcccagaagaactgtatctccacttcctcggttctctggaataaattacaaccttatgactcatgagtccaaacaggacagtctttacgtctacccatcttatgactgatgtggctctcaaggaacaataaaacctaagcaaattatgggaacaagcatttatcaaccacgcaaatgaagccattctttgtatgtattatgcatctcaatctcccatatatggttatcaacgtaataattca

SEQ ID NO: 13932 - DNA, 457 bp, Homo sapiens
ttgcagaatctgaggaagattttttgacttcatgagatagcatcacaggagtaagtgatgcagcagtttaggcccagatcataggtcaagacttcaataaacatttgtatagggattgtcgtcccttcatctggtacagaatttttaataacagcctcatagccctgtgacagaataagcctaattctaggataagcagtaggtatatcatctggagagaggagagaagcaagtgcattcttcaacctttgtacccagtctggtggcatttttctttagtctcaaaatgaagatctgatcttgtgggattttggcagcttagactgattagcccacaagtagtccccatgtggatacaggtacattttagcactgaaggtatctatctcccacagcagccactccccacttccagtagacaactatgaagacctaattcataggaatatgacctcac

SEQ ID NO: 13933 - DNA, 127 bp, Homo sapiens
ttggcttggctgctccttgttcacaccttggtaaatgacccttcacaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 13934 - DNA, 154 bp, Homo sapiens
agtctactggtcacattctgtcaggttgggcttcaagatggacctccttggaatgcttgcaagaaactagtttttttttctcttgaacagctaaacctttcaggttgacacagctgaaggagtgtgagttaggagagtcgttataagcttgagc

SEQ ID NO: 13935 - DNA, 173 bp, Homo sapiens
agataagttctggaactctctcactgcagactggaggctgaccctccctctctttggagaggatctctttcctgccattcatattggagagtgataccacctaccaacttctgcctggaataaatatgttccatcattttattttattttattttttaatttaatttaattta

SEQ ID NO: 13936 - DNA, 261 bp, Homo sapiens
gggatttgctaagtagttttacagagctagatctgtgtgcatgtgtgtgtttgtgtatatatacatatctagggctagtacttagtttcacacccgggagctgggagaaaaaacctgtacagttgtctttctcttatttttaataaaatagaaaaatcgcgcacttgcgstacccccccccacccccttttttaaacaagtgttacttgtgccgggaaaattttgctgtctttgtaattttaaaactttaaaataaattgg

SEQ ID NO: 13937 - DNA, 57 bp, Homo sapiens; identical to SEQ ID NO: 11970

SEQ ID NO: 13938 - DNA, 340 bp, Homo sapiens
attcagtgtgtggttccaactgtaactggcagatgctttaatacaatctggattttatttttctgtgagaaggttttctgtatagcttgtggtgctaacgatgaaacagagaggtatgtgttctgtggcttcattttaagtgtcacattgtcaatgcttcaggttaaagtaagcttgcaaagggaataatttgaagcataattcatcagatcttttctatttaacttttcacatttattttttcatattcagttttaggaagtatgttgtatggattacatttccttccatcttagggaagaagttaaataaatctcaagctcaaaaaaaaaaaaaaaaa

SEQ ID NO: 13939 - DNA, 451 bp, Homo sapiens
  misc_feature 386: n=a, g, c or t
ttaaggtggggtcccagacacctagaataaataagcttagaatatccaagaagtgccaggggcggtagttcacgcctgtagtcccagcactttgggaggccgaggcaggcggatcacctgaagtcaggaggagaccagcctggccaacatggagaaagcccgtctctactaaaaatacaaaaaatagactggcgtggtggcgcatgctgtaatcccagctacccgggaggctgaggcaggagaatcgcttgacccgggaaggggaggttgcagtgagccgagatcgtgcctttgcaccccagcctgggcaataaaagtgagactgtcccaaaaacaaaacaaacaggctgggcatggtggctcacgcctgtaatcccagtagtttnggaggccgaggcaggcggattacctgaggtcaggagttcaagaccagcctggccaacatggtgaa

SEQ ID NO: 13940 - DNA, 413 bp, Homo sapiens
cccgtgtccggttcttcctcccaaaatctgcccgagcttctttgcccagcagatccccggcagttgcatccccaagcgcccctccccagtcgacggttctcacccaattccgccgccccatcgacgggttcgcaccaaatcagccgcccccgcagcggtgcgggagmggcgccgtttggaagctttcccgctgaaatctcccgacagtgtctcgtcattttgacgcctgagctttatccgggtggaaagtttggatcttggtgcttgcggagatggcgagtacgggggcgggtgctgttcttgctgtggtagttttggcttgtgcactgggagccagagctgatggctctgatcataagtacaaggaaggggatcatgttcctctctacgccaacaaggtcgggcctttccac

SEQ ID NO: 13941 - DNA, 426 bp, Homo sapiens
aatccaaatactttgggaggccaaasccgagatcacttgggcccagaagttctagactagcctgggcaataaagtgagaccgtgtctctaccaaaaaaaaattagccaggcttggtggtacgtgcctgtgatcccggctgcttgggaggccgaggcaggaggataccttgaatccagcggagtagaggctgctgtgagacatggtggcatgtgcctttagtccctgctctttgggaggccgtgacagaaggatcccttgaggccaggagtttgaggctgcggtgggctgtgatcgcaccactgcactccagcctggatgacatagcgagaccctgtctctaaaggaagaaaagaaagaagtacggttagggttataagatattcatgacatgctgttaaaggggaagcgcaractgaagaatagca

SEQ ID NO: 13942 - DNA, 218 bp, Homo sapiens
ttggaagattcaagattattaaaatactattctccccaaatggctctatagattcaacataatcccaatcaaaatcccagtaggctttggtagaaattgagatgttggttctaaaatgaaataaaatgcagaggacctagaatatataatttcccttaaatttgacaaagaagaaaaacatgattgggaagctcacctaatttcagtgtaatatttac

SEQ ID NO: 13943 - DNA, 395 bp, Homo sapiens
  misc_feature 27: n=a, g, c or t
aatgtccgtttctcggagcgcavacancctgtcccatcgagaagcctcgggtggacatggactccatggaagcctgagctgccaggggcttccctggggcagcactgcttcgcgtaggctcacgagaaacttccagggttcctggcgccastttcaacagagcagcacattatgcctggataagactcaaagagcagcttaatatcaggttctctggggctgtaatcatcggttcaggatggagcagacacagccgcagcaaggcctctgtgcagcccccggcttaaaacacatcaacgcatccgtgggcacttttgtgagttaaagctcaacttacacatctgcctgtatccataggaaatgaatgaaaataaacaaacaaattccttgcaaaa

SEQ ID NO: 13944 - DNA, 507 bp, Homo sapiens
  misc_feature 411,458,461,485: n=a, g, c or t
tgcactatagaacaactggacctaatagatatttacagaacatttcatccaacagctgcagaatacatattcttctcctctgsacatggattattctcaaagatagaccatgtgttaggtaacaaaacaagtcataaaatatccaaaaattggaaataatgtcaagaatattctctgaccacagtgaaataaaactataaatcagtaacaagagaaattttggaaaacacatgtaaattaaacagtattctcccaaatgaccagtgtatcaatgtataaattaagaaggaaatggaaaaatttcttgaaacaaatgataatgtaaataccatataccaaaacctataggatacaatgaaagcagtaggagagaaattgtagcaatatgtgcctacatgaaataaaaacaanaacaaaataacttcaaataaataaaacctgtatcttaaagawccagnggncaggcaccatagctcatgcctgtnatcccagcactttgggaggctg

SEQ ID NO: 13945 - DNA, 487 bp, Homo sapiens
  misc_feature 118,132: n=a, g, c or t
atttctcctgtcaacttccacagccctttatctaggcttctcttcaaatatactatttttgtgccctgaacattatttttatgcatgttcctatgccttcccctctcacacacaactntaatagtcccttgntacataacaggctcataatatagattaatgaatccagaagtgaaagtatcagggactaatttgtaacgtaagactgaagaataagagcttgaggaaacggcagggaaaaaaaacaacagaattgcattatatctttaggaagaagcactaattcccatgtttaccattactctcatctgccaattttcttgtttaagtagaaaaacatcaggttcatttttctgttctcttttgttgattaactatatctatgatatcccatgaggactcttacttctttaaaaaactggtttcctcaaatcactgaagccgtaacacaagtttctaaaagtagtagtgccggccctaaagctgt

SEQ ID NO: 13946 - DNA, 223 bp, Homo sapiens; identical to SEQ ID NO: 10080

SEQ ID NO: 13947 - DNA, 456 bp, Homo sapiens
ggagagaggcgccagttgggggtccggtcggccacgccacctacgccgggacgtgcctccgcggcgcgacgctcccacggacttagctgggatgcagaatagaagctgggcctttgtctgactaccctgcaacagtcagccacagacgggaaggcagcgcaggaaactgaggccaaaggagccgcgcttcctcatgagcatgaagcggcaaagcctgaactagaagcttctaacgcctaaccgtcctcttgccgcaccaggacctacctctgcaaggcccttcctgactttttccttagaatgtgtgtatatgtgtctttttccttttctgatgctaagacacctcagaaacaccaatgttaagcagatttccatcgttggaggttaaaacacccgaatacaagtgttttcttgagtgtggcatctggtcagatgttttatgggttggtttgtttt

SEQ ID NO: 13948 - DNA, 395 bp, Homo sapiens
cttgccgcatagstttttaaaggtgctttcacatagcacaggcattacccgtagtcgtgtcaaatagcagttggtgtcttcattttatgtatatttatcatataagtctgatttttttttttaagcgtcttgaatggttttctggagagacagcattggtaagtggcacatgacggtatcccagtcataagagggttgcatgattcctttgagtgtttgatttgaaaagcctagtcttgtctctcaagagcatctcggacccagaacattctccagtagtgcattcagttcaacacagcaagtgcttcattgcatggaaaacactttgaagacaaaaaagaaatcttatttctttttttgtagccttcctgatatttacagtaataccattaact

SEQ ID NO: 13949 - DNA, 488 bp, Homo sapiens
ggaacgttctggaaggttgaatggggtagaaggcctgttgtggagggaaaccacccatcctcctgcctcccaccaccaccatcatcctggctggacggagagggtgacgggggctgggaaggggcagctcatgttcaggtttccaggaggggctacctgttgactgtctttgcaggaagaagaaaacacctgagtgaccagatgtcccagctccaggtgccttgccagatggccagaaccacacctcttgaagagtgacagtgctgtggagcatggtttctgcacacctggaatgactggaaccccaaagactcaagaaggagctaagatcttgaagtagacatgaataaaacagaagttactcccaggctgtggaccacctgtcgagatggagaagtccttctgaggctatccaaacacggaccaggccatgagaccccgatgaccatccctgaattttttcgagagtcagtcaaccgatttggaac

SEQ ID NO: 13950 - DNA, 508 bp, Homo sapiens
ataagtagatctgtgcagttcaaatccatggttcaagggtcaatgtagtccctaaacatgtctagtaaataacatttaatttcattgttttctttatctccattagccggagcaacttggaggcaggaaacgtatgcattggcatttccaatacctagtagagagccctgtgcaaattggaatggcaatattttttgagtgaataaaagccaaaccagtttcctttgtgtttccatccagaagttcgttctcctttcaccttcattctcataatctagtcatccttatagaagccctttcttcccaacactctgatagggaagcaattgttttattctcttccctccctttatcaagtagagctttctcagagtttgtgggagaaatgattaacataccttgccttcatatagcaaggacagatgtggtggggttgaggtatgaactttgctcccataaaggtctgtatctgtatccaggtcttccatcttctagcttgatcatcatg

SEQ ID NO: 13951 - DNA, 443 bp, Homo sapiens
acctctggtacaggtgggcaagtttttctttgaagaaatgggttattgactcatatgtcataaccttgagtgttactctcccggtgtccagaggtcacattcatgttgcggggttggtatgaaattaaatcttggtgatgtgaccctacattctcttctggtccctagaatcggcttctggtctcctgataactgaagtaagacagaagttgagcctgttgcccaggcaaactaaagctgcttttgttcttcggaatctgctttgcctccgtcagcctgcttccttccccacacatgctggccgcactgtccccactccagacctctgctgtgtgtcctgggcagggccgcgttttggcagtaccctttcaactcatcctaagcttcgtgtagattactttagtatatattttttataaaacataaagcctttcctctcgatg

SEQ ID NO: 13952 - DNA, 449 bp, Homo sapiens
attgatctgttcacagatatgcctgcctctatagcacccattcagaagtctgccatatagaggcttttttgaatgagcacacatgcttttatagttatattgttatctggaatccagttcataatccatgtattttgatattgagtctgaaatttaaaaatttttgtttgcagcattgatggcccatgtagaagacctgatcattaagactataatctctgctgaactagctattgctactgcctgtaaaacctttgttcctcatcgcagcagttgttttgcaagttactctaatcctgtttcctcaactataaaatggcagtaatggtggtgtctacctcctgagaataccatgaagatcaaatgagatgatgcacgcaaagcacttgacacaatgtctggcccttacgttgtactcaataaaaattatttgttatttttgtaaaaaa

SEQ ID NO: 13953 - DNA, 89 bp, Homo sapiens; identical to SEQ ID NO: 10118

SEQ ID NO: 13954 - DNA, 511 bp, Homo sapiens
caatacaggaaagtagctgttaaccatatctgcttaagaggtcagagtctgaagtaaasagctttgtgtatgtgataatcaggatttgcttgtgagcaacttgttcattttttttttaaggaaggcataatcaaggagcattttcttcataaatgttgagatctgttgactttaaaattttgagtttcacatgccttggtgtatggcagaaagaatcagcactcgtaagctagtgtattttatataagaaatgtaacggggttgctgggagcggtggctcacacctgtaatcccagcactttgggaggccaagacaggcggatcagctgaggtcaggagttcgatactagcctggccaacatggcaaaaccccgtctctactaaaaatagaaaaaatttagctgcgcgtggtggcaggcgcctgtaatcccagctactcgggaggctgagacaggggaatcgcttgaacccaggaggcggcggttkcagtgagccaagattwgtgccactg

SEQ ID NO: 13955 - DNA, 347 bp, Homo sapiens
  misc_feature 70: n=a, g, c or t
ataaaggggccttcggaaccccaccagagtcacagccagggagggcagcggggcgcaccaggccgamkcnacgccacagggagggcagctaggacatggggggaagcgcgttaaaccagggagtcctggaagggacgacgcccccggccagtccctgtacgagcggttaagtcagaggatgctggacatctcgggggaccggggcgtgctgaaggacgtcatccgagaagtagctggagacctagtggcgcctgatgcttcggtgctagtgaaatactcgggatacctggaacacatggacagacccttcgattctaattactttaggaaaactcctcggctaatga

SEQ ID NO: 13956 - DNA, 200 bp, Homo sapiens
  misc_feature 133: n=a, g, c or t
gtgggatcgctcccgggggccgctcctctctcgggcactggggtcgcgggagacgtcgtcggagctcggtttctggaggcccttccccacccggcctctgcctcctccactcccccgggctggacggaacggngcccagcgcgggatgcgagaggtatgatttcgctctgtcgcccaggctggagggcagtggcgcaatc

SEQ ID NO: 13957 - DNA, 330 bp, Homo sapiens
atcttagatgcgtgcaattaagggctttggcgggattggctccgcgtttgggctggtccgctgctccccacctaccagggtcggatccggagcccttccccgcggggcggacctccaaacaaccgactcctttccaggtgaagggtgacttggctgaagaaacacttaaattctggaaatagcgactcagtatcatggccagcagccttaatgaagatccagaaggaagcagagtgcgtaacaactattgacttattggtgaactgaaattcgtaataatcgaggtcaaaagcataaacactttttaattaaattaatgattgcacaaaa

SEQ ID NO: 13958 - DNA, 94 bp, Homo sapiens
aaacatgaaacaggataatagaatgtggttgttgacaggaaccatgaaagtcatccggtccagctcccccttaaccaaggaaacaaatcctatt

SEQ ID NO: 13959 - DNA, 399 bp, Homo sapiens
acaaaaaataaataaataaataaaaggaaaaaaaagaattttgatggttagtcacccaataaatgttctggttggccgggcgtggtggctcatgcctgtaatcctagcactttgggaggctgaggcaggtggatcatttgaggtcaggagttcaagaacaacctcgccaacatggtgaaaccccatctctactaaaaatacaaaaattagctgggcatggtggtgggagcctgtaatcccagttacttgggaggctaaggtagcagaattacttgaatctgggaggcagaggttgcagtgagccaagattgcgccactgcactccagcctgggtgacagagtcagactctgtctcaaaaaaaaaaaaaaktycgggttttaaaaatttaaaaaaaaaaa

SEQ ID NO: 13960 - DNA, 441 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttasccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtgasactgtgcctagcctgagccaccacgccggcctaatttttaa

SEQ ID NO: 13961 - DNA, 512 bp, Homo sapiens
aaagatagaggagaagacacctaagaaatgtgtttttctggagttatattagtatttttgttgccagtatctaatagtgtttccagaactattctggaagcaagccagatctcctaaacaataattaacagagctttttacctagctttattcattagagtaactaacaggagtttctatataaacaactccaaaaccctagtggcttattaaactgtagatttttttcctatataaagttcagtgcagataaagggggtgtttgttccataaatttattcagggacccaggctctttccatcttgtggttctgtcctcccgcactcaattcattcaagctggtccatggggaaagaatgagattgggccaggactacaccaggaagtgcacatcacttccactctcatttcattagccaggattgagtcacaagtaccacacctacctacaaggagggctggacaaaggtatagttggggactcaggaagaagagagtattagtgactgtt

SEQ ID NO: 13962 - DNA, 526 bp, Homo sapiens
  misc_feature 289,443..444,449: n=a, g, c or t
aaaagaatggaagataacttccatctcagctaaccaatggacttttccttagatacaaattagtcgtgttgctgtttaatacagacctcacatctgtattagtaaacatacttgccagctctctcaattagtcagactttcctgccatatttaaagaagagagtaattgacttgtttgttattctcaaaaataatgtgtctgatttagaatatgtagtttctattgatggtttttaagggttggcacgtatgcgttaagatttttataatagcatcaaactgtcagctnaaagataattttcagctctttttaaagccgaaattcatatttttatggtatttatgttgttgttttcattaagaaaatgctaatcgttgggtgtctatttcaccagttaaatttttgatatatggcctctgcgtttaatgaagacataacaagnnawbcnaaaagtctgattcacggcttgcctttggttcttgtagtctaagtttaaaactgacaagtgttacagttggtcagcac

SEQ ID NO: 13963 - DNA, 62 bp, Homo sapiens
aatgagaaaaacaataaagaaattcccatcactggcaaaaatattacagatttaaaattcca

SEQ ID NO: 13964 - DNA, 510 bp, Homo sapiens
aacgctaaagagaaatctcttctagaatgaaaaaccatggatacaggtaactataacccaaatcagactacctgatttggatcacaccagatctattttataagcatcaaagggtattttttttttaggtgaggaggctccgtggagtgtatttgtcatcactacctccactgatgcctgtgagtggcasattaatttccctgaaatccasagcccagacccacctgcstcactcaggcccastggggaagggctgggcccatctacctcagtaggtggttgccagcatctaggcagatccastgcctggcctggcttctgaccagaataagactttgctacaagccagtgagtaattcctggtcctgattgcacatcagaatcacctgggggccttataactaccaagggccagagccccacccagatcaccagaccagatagatactccatggatcgggccagggtatcagtatttttaaaagcttccaggttgttttctatgacgtt

SEQ ID NO: 13965 - DNA, 112 bp, Homo sapiens
aatttttataaacttttgttctttcttgtaactttttatcagtcagctattccaatgaagcaaaatctgataatatattgcttttatactaaaaaaaaaaaaaaaaaaaaaa

SEQ ID NO: 13966 - DNA, 288 bp, Homo sapiens
attgccatatgttttcttctaagagttttaaaagtttaggtcttacatttaggtatttgatccattttgagttaatttttgtcgatagtgttaggtaagagtccaactttattctcttacatgtggatatccgttttttccagcactatttgtttaaaaaacaaaaatcaaacaaacaaaaacctgtcctttccccattaaatggtcttggcattcttgtcaaaaatyaggctggagtgcagtggcatgatctckgctcattgcaacctccaccttccagattctctt

SEQ ID NO: 13967 - DNA, 422 bp, Homo sapiens
  misc_feature 77,131: n=a, g, c or t
ttctgtttgggatgaacaaattctggaaatggataacgatgatggttgctcaacattttgaatgttaatgccactanattgtacccataaaaatggttaaaatggtaaattttgttatgtatattttatcntaatttaaaaaatatatstagaatgggcaagaaggattctcctcattcstctcttgacttgagaatgatcagtcaataggccctgaagtctgaatttgtgaaaatttccttgggtgacaaacttgtttgattactctatttagtgtatcccaaagttattaccacataatcttttaaacaataaaacaaataccccttagaaagtcttctgcaaacccatttctgaaaatggtacattatagggtgggtatagatgcatagatatgggattatgtatgatatatatatata

SEQ ID NO: 13968 - DNA, 512 bp, Homo sapiens
agatacgaaggcacttgtcagtttaggctcctaggagacttgattctggctgacgtgctgcgactgtcatctttcagatcagagtaactctgagtctggtgggagtgtcttcccccgacaccccgtatacctccgctttaagatgagagaatcttctgtcggtgctagcgttcagcgctaacggaggaggcttgactcaacctgccggacactaaaggacatcactctgagcctgagggaggggctctcctttggtctccctcttttgtccagccttgccccaggatatttttctaagctgagttagccactaggcactccacatcgctgcccgcatcaccacgctgcggcatctgctgttgcatctgcgatccacaaggcctacaccattcgccatcgcacctggctgtttgttgcagatatttctcaggaggctaactcatcctgccaaccccgattgacgtcactacaccagtgatagcgtctcatccatcgatctttcaccattagat

SEQ ID NO: 13969 - DNA, 485 bp, Homo sapiens
ataagaagccacagtaaatgaaagaaacggttatttaaactgctcccttgatagtcataattatccagttgaggtgtttctttgagagaagaatatagacaccaggcccacgagggtctccgcatttattttcaaggccaaaggaagtgacccctcggaaaacaccctcgcacaacaaagggcttccagaatctccctggaggaaaacaagaggggtagggtgtggggtcagtgttcagcattaccactagtgaaatggaagaaattctgcagcatttaatatgcagttaagaccaaccttgacttaattgaagatagtgctttaattttaaaaattaaaatgtttggaaatattttaatatttttgaattggttcacttggtttatttatgagccagtgaaaatcgaagtgaaacttgtacatgttatcagctaattttgagactattgctctgcttttggaaaggaaagtctcctgtttattt

SEQ ID NO: 13970 - DNA, 178 bp, Homo sapiens
atttaggggcggttggctttgttgggtgagcttgtttgtgtccctgtgggaggacgtggttggtgattggcagttttcgcattttttttttttttyctttttttttaaagttgggaaataatttwataagtttttwaakgcataaatccaaacatatattkkgtactgaatatttaat

SEQ ID NO: 13971 - DNA, 435 bp, Homo sapiens
aacaactactcaaggacatgtctgaatgagtcactgaaccatggctctgtgaggtcagctgctctctgatccactcgctcctcagcttaaagacatggtcaaagatagtgagacaaaaaggaattgctcaaatactgagatgcatgtcaactcttccaacaacctccagaatttactgagcctgtaacacagcttttgtaatccttttctgtgaaatccagtactgtgtcagcttcgttagggtctaaagtgtacctttcataaaggacctcaagatttattttcctgagctttaaatgagtgaaaatgtgttttgttgaaacttcccaagaagtaactgcattttctatggaatcttccattgtttatgggcctgatgaaagcatttggcacttaatgattcccagactatttcaactttataaaaaatcaaga

SEQ ID NO: 13972 - DNA, 542 bp, Homo sapiens
  misc_feature 484: n=a, g, c or t
aagaccagatgagctggtttcttgggacttccaccaatacaattcttgtaggatttttaatcccatcttggcatctgcttttgggaggacctggtctaacagaatttcttaaagtttagactaaagttgccattgtctttgctatttaatctttgtagacattttttcaagaaacttaaaaatgcatttactatatagacagacacatggcataatatttttattgtcatttcaacatgcatgaatgttaccaaaagattctacagaaaaaaattccggagagtgatatgctctatggcaacgacttcagtggttcttagcctcatttcttcagaattaagagtcagaatattctttttcaataatatcaattaacttttctataagtttgttttgatttatttttaactaccagtagtttcccctgaactaattgccctcaggaaaaaaaatacctggcataatgtcaaatgataaagtggtngtctcaagaaattagttcatttgacatttaattcctacctattcataggcatctcagt

SEQ ID NO: 13973 - DNA, 491 bp, Homo sapiens
ccgaatcagatcaatgaaatagagtttctagcagctgcactgtgaataacgtcctgaaagatgctgctgctggaactcgattccacagctatgagtgtttgttggaaggcacccaaaagggattccaagggccctgcctctactgactgccgtttattcttaaagcactaggctcaacagttgagctttgtgtggtattgagtgggttttatgattacttgtttgccattgttagtgtcagcctgtcaacaccttgaagggcagagcatttttgtttgttttgaaaattactcaatagcaaatccttaattatacagcagtatggctttttgaaaggttgagtgatgtactgctgttgttttagatttctttcatgctaaatcttatgaggtgcatagccttcaataactaaatgcaaataatgcaatcgaatcccacttgagcctgccattaattatctcacatttatctcattccaggctggtgatatg

SEQ ID NO: 13974 - DNA, 55 bp, Homo sapiens
actgggttttggacgcagcttgagataatttgggaagtgcatatgctgtgtaggg

SEQ ID NO: 13975 - DNA, 180 bp, Homo sapiens
atataaaaaattcgccgggcgcagtggcgggcgctgtagttccagctactcgggaggctgaggcaggagactggcgtgaactcgggaggcggasttgcagtgagtcgagatagcgccactgcagtccggcctgggcgaaagtgcgagactccgtctccaaaaaaaaaaaaaaaaaaaaaa

SEQ ID NO: 13976 - DNA, 77 bp, Homo sapiens
tttggcaacccgctcgagtccccttccacgctgtgaagctttgttcttttgctctttgcaataaatcttgctactgc

SEQ ID NO: 13977 - DNA, 296 bp, Homo sapiens
  misc_feature 54: n=a, g, c or t
acttcctgcgaggcccctgcagcagcagcggcgtggtcagagcgagcttcgganavagtggtgggttccatgtgatggtggagtaggaggcaggtctccgcggaaagaaaaaagaagaaaacaaacctccatacgagaatgggtctaaaggaacttcccaaacctccatgattttgcaggaaacaagataaagctggttggtggagaatttgaactggagatgaactctattataggatgctgagagtataatacgcatgacagagcttttagagcactgtgatgtaacatgtcaa

SEQ ID NO: 13978 - DNA, 327 bp, Homo sapiens
gtagaacactgggaactgtcaccaggaaggatgtgatacacactgcccagtgaagggtatgggcagagagtggtatgaagtttgtctacaaaattgtgggtagagtcttctaggattaactcctgacagaagaggagaaaaggaggaacaatttgaatcaagtcctgaaagaataggtaggctggaaatctatctactcatctgttgcaacatctcagattccagataggaaaactgccctcagtgttgcattttgagctatgcaaacatttgaagaacattcatttttcaattagaaaagtaaaatggttgctctcattaaaaaaa

SEQ ID NO: 13979 - DNA, 387 bp, Homo sapiens
tgtagtccctcctcaagaaactggagagagaagagtcagttaaatctaaggtgtggggaaggttgaactgctacccagggtccagttcaaaccagaggctgcgtgttcttccctggacgctgccacaccacgcctaattcaggaggaaagccacaccagaaggacgcagcctcagaccgagagccttgctaggctgcaaascatatttttcaatcagtaaagtatccaaaaagaaaagtcacacgtgccgtgaaaatataaaagaaacacttgtcaaagaccaactcaacagtctgcgaggggagcagtaagatgttacgaccgatggagagagcggaggagctggtggtcgcaggcggtgggacaaggctgctgggtcaggtgccg

SEQ ID NO: 13980 - DNA, 339 bp, Homo sapiens
ataaaaaatgttatattaggttggtgcaaaagtaattgtgttttatttatttatttatttattattttttcctttgagacagagttttgttctggagtgcagcggtgtgatctcagctcactgcaacctccgcctcccaggttcaagtcattctcctggctcagcctcccaagtagctgggattacaggcgcgtgacaccacgcccggccaatttttttttgtatttttagtagagatggggtttcaccttgttggccaggttgcagtgagccgagattgtgccatgcaccccatcctggcgacagagcgagactctgtctcaaaaaaaaaaaaaattg

SEQ ID NO: 13981 - DNA, 58 bp, Homo sapiens; identical to SEQ ID NO: 12458

SEQ ID NO: 13982 - DNA, 417 bp, Homo sapiens
ctattaaaaatgcacttgttccttaaaggaaagtttcatttggccgggcgcggtggctcatgcctgtggtcccagcactttgggaggccgaggcaggtggatcacttgagctcaggagtttgagaccagcctgggcaatatcgtgagaccccatctctacaaaaatacaaattaactgggcatcctgtcatgcgcctgtcatcccagctacttgagaggctgaagcagaagaatctcttgagcccggaaggcagaggttgcagtgagctgagatcgtgccactgcactccagcctgagtgacaggagttaagccctgtctcagaaaaaaaaaaaacaaaamcccaaaaagtacttaaagtttcatttacttagctaggagaaagasttgattctcaaaaataataccttttaagatt

SEQ ID NO: 13983 - DNA, 481 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtgasactgtgcctagcctgagccaccacgccggcctaatttttaaattttttgtagagacagggtctcattatgttgcccagggt

SEQ ID NO: 13984 - DNA, 241 bp, Homo sapiens
ggaggaaagaaaagccagagtgaagcagaccattagcagataattgtcataatcttgatactaaatggagaccagaattaagggcaccagcagtgtaaggaaggctatttgtaagggatttggcattgtgcctgtcagtggacttcagtgagtgacagcagggtcagtggagtgacaggtagtgagggctttgtagataaaccaggctttcaaagaattgaatgaagcccatccacactgg

SEQ ID NO: 13985 - DNA, 447 bp, Homo sapiens
aaaaagaatgagaacataatgatttcatacagcccatacgtttcccaaataagtaaagggaagctgacttacggcaatgagaggcggtgtggtaacccggagaaactaggctgtcggtgggacacatgggtgtgaatcagctctgctacttacatgctctgtgtgtctccgcagacacttaacctctttgagccttactttcgtcatctggaaatcaagagggttgccctagataattctaaggaccggcccagctgaagggcctggattctgtgctttcagagtatctttgctcttgttctgtgaccttgtctataccctcagcaaacccagaagctccataagacccagcaattgcacttctaggtgtatatccggaagaattgaaagcacgtgttcactcaaaaatatgcacgtgaatattcatcttagcattgctcataatag

SEQ ID NO: 13986 - DNA, 145 bp, Homo sapiens
attcctgtaatcccaacactctgggaggctgaggtgggagggtcacttaaggtatttgttattttttgcgtacaaatatttaactaacttaaagtaaaataaagattaaccgcacacaccaaaaaawaaaaaaattgcgaaaggc

SEQ ID NO: 13987 - DNA, 100 bp, Homo sapiens
atttttttccaaagccatggtgaaacatctctgtgctaatttcttttgttttgtttcctaattttttttttttttggsaggtggtaggaaataatctttg

SEQ ID NO: 13988 - DNA, 499 bp, Homo sapiens
atcatttgatttctaaaaataccatgacctttaaaaattcttttaatagatcatgttattggcagtatttatataaaaaccatggatttagaaaggtatatttagctttattataatagatacgttactattttggaaatatatatattttcacacctgtagtactcttccccatttcctctgacactcatgcagaatgagatcaggcatatttgtggttgacatactctagatagcttttccaacaaatctttgaaaagcaatcttggaaaggaattcattaactaaatggggtaaaaggtttctttttctttgagagttaagtccttcctcaaaaaattttcttatgctccataaaattgaggtagaatattttcattattcttgcagctaagcaagacagccatatgatgcaggttatgcagtgccttcatatctaaaacttttgtactgcactttttaaagcttttatgttgaggaaggtaaagggcatttgtct

SEQ ID NO: 13989 - DNA, 150 bp, Homo sapiens
aatcagttcccaagttctaggcggaagaggcccaagagacaccactttctcgctttcagacgtgtctacataagaccacaaaagaaaccgaggcaaaaacaaaaaaaaaaaaaaaaaaaaaaaaaaaawaaaaaaaaaaaaaaaaaaaaa

SEQ ID NO: 13990 - DNA, 459 bp, Homo sapiens
ctgaatgtttatgtccctcccaaaactaattatgttaaaatcctcaccatcaatgtgatgttacttggaaatgaggcatttgggaggcaattaggattagatgaggtcatgagagtggagccctcgtgatgggattagtgcctttataagaagagacatcaggctgagcccggtggctcatgcctgtaatcccagcactttgggaggccaaggcgagtggatcatgaggtcaggagattgagacaatcctggctaacacggtgaaacccgtctccactgaaaaaaaatacaaaaaattagccaggcacagtggcatgtgcctgtagtcccagctactcgggaggctgaaggagaagaatcgcttgaacccaggaggcggaggttgcagtgagccaggataacgccactgtactccaccctgggcgacagagcgagactacgtctcaaaaaagacatcag

SEQ ID NO: 13991 - DNA, 501 bp, Homo sapiens
aacagagtgaagagacaacctacagaatatgagaaaatattggcaaaccatgaatatggtaaggagttgatatccaaaatatataaagaactcaaaagtaagaaaacaaaatacctgattaaaagtaagcaaaggatgtgaatagacatttttcaaaagaagttatacaaatagccaacaggtataaaaatgctcaacaccacctatcaccagggaaatgcgaatcacaaccacagtaaggtatcatctcacatttgctagaagggctattatcaaaaacttgaatgacaacaagtattggtgagaatgtgaagaaaagggaaatctttttaactgtttgtgggaatgtagattggtacggtcattatggaaaacagtatggaactccctcaaaaattaaaaatagaactaccatatgatccagtaattctaccacttggatatatttccaaaggatatgaaattggtatgtcaaagagatatctgcactgtcctgttcaa

SEQ ID NO: 13992 - DNA, 132 bp, Homo sapiens
aagaagaggaaagaggaagaagcgctcagatgctccgcggctgtcgtgaaggttaaaaccgaaaataaaaatgggctagacaaaaaaaaaaaaaaaaaaaaaaaaaaaaaaaaaaaaaaaaaaaaaaaaaaa

SEQ ID NO: 13993 - DNA, 376 bp, Homo sapiens
caaacaaagatttctggaagtattttgccaaccttctggttgagctgcaagaaaatatttatggtgagaacttttctgtttcccgttattgggtttttggttggtttttgtttgtbttttactatgctttggtctgtaaaaatatgcaactggactacattcagaaggaaatattgtctacatagaatattatatgaagttggtacataattctgatgaggaaaaaaatctttgcaattctttaagccatattgttgtttttctgtgttgttttccctggatgaaaatatcagtattaagtagacagcatattattcaagtgtttagacttattaatatgttcttgtcctgtatttatacatatgtgtatttttgg

SEQ ID NO: 13994 - DNA, 480 bp, Homo sapiens
  misc_feature 19: n=a, g, c or t
gacsattacstagaacawntaatcgaaactcattttttcttttatcaatgaacattattccgttatctggatgcaccacagtttgtgtcttcattcacataaagaagaacttcttggttgcttccaagttttggcaattatgaataaaactgttataaacatttgtgtgcaagtttttgagtggacatacgttttcaactcatttaggtagataccaaggagcatgattgttgaatactgcaagaataggtttagttttgtaagaaactgccaaactgtcttgagtggctctaccattttgcattcttgtcagcaatgaataagagtttctgttgctccacatcatcaccagcacttggtgtttttattgttctggattttagccattataacatacgtttggaggtatctcgctgttgttttaatttgcagttctctaatgatgtttgatttggaacatcttttcatacgcttatttgc

SEQ ID NO: 13995 - DNA, 485 bp, Homo sapiens
tatcagtgcccttttttaagtttcatcatccagaggattgagaagcatcctaattttctttagcagttttgacagttacaggagtcattttgtattgttttaatgtaaatttaaatcagtattttctgtattatggattccttaaagctatcactagtcagtattactatctgaatatttctgatttccaaaaagggaacattggaggcccagaaaaattaaagacttgttgaggtcaggattaatcagtcaagtacttctctttttagctcaaaactttttccattagattacaatacttcctaacaatgctgtttgcaggctggtctcttatttgtcaaaaacagtatcagatcttgtatttgcagttaatgacatggtaatgtttgaatatttaacattttcattgatgcttattttcagtaatcaactaccacatatttttagaattaacatagacaagtagatagaaaacactttccatt

SEQ ID NO: 13996 - DNA, 343 bp, Homo sapiens
ataaaaaatgttatattaggttggtgcaaaagtaattgtgttttatttatttatttatttattattttttcctttgagacagagttttgttctggagtgcagcgtgtgatctcagctcactgcaacctccgcctcccaggttcaagtcattctcctggctcagcctcccaagtagctgggattacaggcgcgtgacaccacgcccggccaatttttttttgtatttttagtagagatggggtttcaccttgttggccaggttgcagtgagccgagattgtgccatgcaccccatcctggcgacagagcgagactctgtctcaaaaaaaaaaaaaawtgcgaaa

SEQ ID NO: 13997 - DNA, 466 bp, Homo sapiens
atcatctggaatggtgggtccctgagaacagggattctgtctctccggttcactgccagtcctgagacacaaccaggatggatggagggaaatggacgctgaaggaggagtctctcattcctttattatacaccatgaacaagagagcaagaaaatgaaaaagacccagaactttgagcttggagaaatctagaaggagcatctgctgcaactgatgagatagctgagtttacctgagccgaaggaatttccaagagagaggatggtggtgcagtgcatattgcaaccccggatcagccagaagtccgtggatttgggaaagcacatgtaacaatgtcgtccagggtacactgcaaggaacacaggcttagagtcacaagggtctgtgcttgaacccaggaaggtaaggaccttgacaagagatgaaggtctgttatcacaagaagagcaagaacaaaccagctga

SEQ ID NO: 13998 - DNA, 499 bp, Homo sapiens
aacccactcgagtctccttccacggtgtgaacctttgttcttttgctgtttgcagtgagtcttgctactgctcactctttgggtccatgctgcttttatgagctgtaacactcaccacgaaggtctgcagcttcactcatgagccagcaagaccacgagcccacagggaggaccgaacaactccagacgcgcctccttaagagctgttaacactcaccgccaaggtctgcagcttcactcctgagccagcgagaccacgaacccatcagaaggaagaaactctgaacacatctgaacatcagaagggacaaactccagaggcgccaccttaagagctgtaacactcaccgcgagggtctgcggcttcattcttgaagtcagtgagaccgagaacccaccaattccggacacaatagtataaagccccccaaatttaaccatttctttggatcttcttttctatgaaaacctttgtgcatgtaaatattgaataaaattg

SEQ ID NO: 13999 - DNA, 479 bp, Homo sapiens
  misc_feature 364,430,437: n=a, g, c or t
atacagcgatggcccccacacctggaagactcaagctctgaatccagcaccttcaggaagcaagtgatggcatcccagaggccctatgcttgagacagactgacgaaaacaggtggatctaggtaaaatcagtctctgctaccctcctcatctaaaccctcagtgcagggccaccttggaagccatgtgttaacactgagtgatcctcctcagccaagtccctaatgcatggaaaagaacctcctgacccagtccccaaaggctggacttttcctttgcaagaaataaggagggtaaagttcaccataaatrcaaagtcatggagtcaagctgtcacaattggccaccgttcctaggcatttgnattgtatgcattgacaggaaaaagcaggaaggagtgaagacagaacaaggggagtatgtaacctgngttgganggtgtaatatttaaratgtatttgcaaacmtgttttgggcca

SEQ ID NO: 14000 - DNA, 467 bp, Homo sapiens
aaagggaaaactatagaaaatccaaaggcatgatttattaataaataaattcagcaaagttacaggatacaggattaaatatgcagaaattggttatctttcaatatagtatcaatgaataaatcaaaaatgatgttaagaaaacaatttaattttcaacaatggtcaagcttggtggcttgtgcctgtggtcccaacactttgggagtctgaggcagaaagactgctagaggccaggagaccagcctgggaaacagtgagatcccatctctacaaaaacaaacaaacaaaaaacaacaagcaaacaaaaaactctggatgtgatgacactcatctgtcgtctcagctactcagaggctgaggtgtaaggatggcttgagccccaaagttcgaagctgcaatgagctataactgggtcactgcaatccagcctggatgacagagttggaccttgactcaaaaaaaaa

SEQ ID NO: 14001 - DNA, 368 bp, Homo sapiens
actcctgacaatgcagcaggaatcacaagccttttgaatcaaatcctgtgattcaggtcttaaaacctgaacttgactgcctccccatgggagtcacaagttcagaactactggcttttgtaaaattagatcaatgaaaaccttgatacaatccttgtccacatcttcaaaaccagaagacctcatattccagtttgcctagaatagtccaggtttatgtctattgtccaagtttgcttaataagaaagtccctttactctcaaaattatctcagcagggataatacattatatggtcatgctattcagaaagagacaatgtgagacatggcatatgtagtagtacagagctgaacgagctcacaggg

SEQ ID NO: 14002 - DNA, 325 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcag

SEQ ID NO: 14003 - DNA, 115 bp, Homo sapiens
  misc_feature 12: n=a, g, c or t
cccccgcaaganacacgaagcatcaatgttcagaagcagcaaataaataaaataaatgaataaaagttaaaaaaaaaaaaaaaaaaaaaaaaaaaaaaaaaaaaaraaaaaaaaa

SEQ ID NO: 14004 - DNA, 447 bp, Homo sapiens
aacaagggcatgaaccccaagaggcaaggwtgacaggdgccatcttgaaggctggcgaccacagatccacacctaactccaaaccaccaaattactcggagtgtgtgtcgggttgcagaaaatgaaatgacccataataactccaagacagagcagaaggttcatctgagtcataccaaataacttcattgctgctaaagtaaaatttgaaaatgattgaagtgatttttatgatcagccttttggaagtcattcaaaagtgctgcaatgctacttcaaagaagataattcaaatttaaatgtcactcttcagtgttgtttatcaacagctgagtattaaaattggtgagcttgatttgtgttatttcacttcaccagcttataatttaaacactcttatacttattatttgaataaatggaataaacacaagtcaaactttaaaaa

SEQ ID NO: 14005 - DNA, 418 bp, Homo sapiens
attgccatatgttttcttctaagagttttaaaagtttaggtcttacatttaggtatttgatccattttgagttaatttttgtcgatagtgttaggtaagagtccaactttattctcttacatgtggatatccgttttttccagcactatttgtttaaaaaacaaaaatcaaacaaacaaaaacctgtcctttccccattaaatggtcttggcattcttgtcaaaaatcaggctggagtgcagtggcatgatctcggctcattgcaacctccaccttccagattctcttggaggctgaggcaggagaatcgcttgaacctgagaggtggaggttgtggtgagctgagatcttgccattgcactacagcctgagcaacaagagcaaaactcctaggccgggcgctgtgactcacatctgt

SEQ ID NO: 14006 - DNA, 492 bp, Homo sapiens
actggataaatattgtcaggttccctttaatttagggacagataatgttctaatgaaagaaatattacctgtcctaaattaggagggatctgacagatcttctcctggggagtgcttccacagtttgttttactcttcagttcttaactgtgtccttgggcctcttgattttactgtctgagatatctgtactatttcataacaaataaaccttgtttacaatgaggtaaaatatttagcctatttcctgtctataggatgttgaaggcttagagaactttcacaaacctaaaacatctcagttccttttagttcaagttggcggtccattgttgatacagctctctaaaaagctttatgaactttctatgtatcaaattatagtacagttcactttacagaagccacagatagtagttttttagcattcctctctacttaagccctgttttgtgtgctatactgttgttgagaactgccctttagatactg

SEQ ID NO: 14007 - DNA, 447 bp, Homo sapiens
ttcttatttttttttggagataagcccttactctgttgcctagattggagtgcagtggcaccttcatggctcactgcagccccacctcctggagctcaggtgattctcccacctcagctttctgagtaactaggacttgagtgcacaccaccatgcctgactaagctgttctttattcttgtttgtttgtttgagtgagactctccatcacccaggctagattgcagtggcagggtcctatctcagctcactgcaaccaccggctcctgggttgaggcgattcttgtgcctctgcctcccaagcagctagaattacaggtgcgcaccaccatgcccagcactttgggaggccgaggcgggcggatcacgaggtcaggagatcgagaccatcccggctaaaacggtgaaacccgtctctactaaaaatacaaaaaattagccgggcgt

SEQ ID NO: 14008 - DNA, 478 bp, Homo sapiens
gatatacattctgtatgaagctcagcatttgaatatcctgctgttcttgaatatgcaccttggttgtatgactttgatcaacattctcagatcctttacttctcagttgtctcccaaacatgacgaagagcacctcccaaggttgtcctgaggagtaaatgagaattaaacctacaggaggccgtcgcccacggaagtgtttcaatagccagcatagggttcaatgctgtcgttcagttggcgccttattgctgaggaagagatgggggcggcaggtgttgggacctcatgaaacgtcactgccatttagtgacatgaacctgaagccccactcccccgtagcagaccccaggcctcacagagagcggastaagcgacgttccccgtctctcatgactgtggccccagcatgctaaggccaggcatgttacatctgacagttcctctcgtcttaaacatcgccacaatagccgcctac

SEQ ID NO: 14009 - DNA, 336 bp, Homo sapiens
ataaaaaatgttatattaggttggtgcaaaagtaattgtgttttatttatttatttatttattattttttcctttgagacagagttttgttctggagtgcagcggtgtgatctcagctcactgcaacctccgcctcccaggttcaagtcattctcctggctcagcctcccaagtagctgggattacaggcgcgtgacaccacgcccggccaatttttttttgtatttttagtagagatggggtttcaccttgttggccaggttgcagtgagccgagattgtgccatgcaccccatcctggcgacagagcgagactctgtctcaaaaaaaaaaaaaa

SEQ ID NO: 14010 - DNA, 60 bp, Homo sapiens
atccaggtgtttgtttctaacttctgtaatacatacaatgcaaaaaaaaaaaaaaaaaat

SEQ ID NO: 14011 - DNA, 281 bp, Homo sapiens
  misc_feature 20: n=a, g, c or t
aactctgtttgggtctcmanccctttggatgttaatcgactgggtccgtgcacctaaataattaaataattcctcctmaatccmacggtctctctgattccttaattatcccaactgcaacactctgtcaacccmaggctggtgtgcagtggcgtgatctcagctsactgcagcctcaaacctcaagggctcaagggatccttctacctcaagcctcctgaatagctggactgcagatatgcatcactacacccagatgttgaagtgctgttttttaaagc

SEQ ID NO: 14012 - DNA, 524 bp, Homo sapiens
aaatacgagggtcaaccagggaccccggagaacaggtaggagtgttttgctggagtggtcctgatgtgggatgatggcggcccagatgagaggggtggcaaatgaaacaagcagaaaggagagatgtaagccatggaacagasagaagaggacatggccagtgagtgaatgtaggtgatgagggaggcaggaaatctgagacgatgcaggtttggggaaggggtgatttgggtagcaccattcgcagaaggcagaatcatgggctgattgatcagataactgatcaaaggcaagaagcaggagaataaagtcctgtaggagacaagagggaggattcagacgtatgttacttctagtccctgattcttttcaagggtagtctctggaccttctcatccattcccagctcctagtacgtgggcagtgagatgggagaggtgggtcactgccccactgcccaccatgcttttgtaatgctccctgctcacccgttctgtgctttagsctctacacctccacgtgaa

SEQ ID NO: 14013 - DNA, 529 bp, Homo sapiens
ctgaataattctccccaaactgcccatatcctaattccagaagcctgtgaatatgtgaccttacattcaaagaaactttgcagatgtgattaagttaagaaccctatgataagaagattatcctgtattatctaggtaggctcaatataatcacagtagcacttacaagaaaaagccaggaagtcagacaagacagataatgctgtgctgccgactttgaagatggaggaagggtccttgagccacaggatgtaggcagtatctagcagccggaaaggcacataaaggttctccctagagtatccagaagaaatgcagccctgaagacccattttagacccttcctgtcagaacttaagagaatatatttgtgattttaaatagataaatttatagtcattttatagcagcaattagaaattaatatagaactgtctgcagtacagttaattggtaagatttaggaattatgtctttttagtgtagttgttatttcaaaagtgtatcatgagaaggtgaattgtgtgaa

SEQ ID NO: 14014 - DNA, 343 bp, Homo sapiens; identical to SEQ ID NO: 13996

SEQ ID NO: 14015 - DNA, 231 bp, Homo sapiens
ctcagcatctggagtagctgggattacaggcacatgccaccacgtctggataatttttgtatttttagtagagacggggtttcaccatgctggtcaagctggtctccaacktcctgacctcaagtcatctgcccgtgtcggtctccggaagtgctgggattacaggcctgagccaccacactccacccctaatcaccccttctaataaagacacagctcatgtaggatgag

SEQ ID NO: 14016 - DNA, 518 bp, Homo sapiens
acttctgtgagttagaaaccctgcctctgtattcccatagcctgctacagacctccacgacatcacatgaaagtgacagctcacttgattcatttttgagaaaatgtctgcaaaatatccaagtctgaataaccagagttcatctattagtcctttcaagtacaaatgacgttccctgaaagaagtacgcagttcagcttccatctgaaacaaggccactgggattttttttcccttcatcacaaccattatgcttcagtatgaaacagacatttatgtgtacatcacactgtgcacacagaatattaaaaaaatgttcactcaacgatgaagatttaacaaaattattattattttttactgctccatcccaacattttaaagtaaaacctgtgtgatgagcaaggggtagtgaataacataatggctaatacagttttgtgtccctgccttggtttgtacttaaggaccagcagttttacttacaactgctttttacaccagcaatgcaaatgtca

SEQ ID NO: 14017 - DNA, 57 bp, Homo sapiens
wasagtgttcttagaggtagcyacacctcagcaagggctttctaacttagaacagca

SEQ ID NO: 14018 - DNA, 440 bp, Homo sapiens
tgacttttgaacttagtttcctcggtttgaggatgtctttgaatacaggtagatgtttgagtccattctttcttttttcgctctgtagcccaggctagagtgcagtggcatgatctcagctcactgcaacctctgcctcctggttctggttaaabcaattctcctgcctcagcctcctgagtagctgggattacaggaacacaccaccatgcccagctaatttttgtacttttggtagagacagggtttcactgtgttggccaggctgttcttgaactcctgacctcgcgatccgtctgcctcagtctcccgaagtgctgggattgcaggcgtgasaccacgcctagcccactctttcttctttctacagccttaatcgaaattgtatcgattytctagtgtagcctacaccttccctaatacagtaggatgttgcaagg

SEQ ID NO: 14019 - DNA, 496 bp, Homo sapiens
attgtaggatggatctgaatgagaaattaatctctgacttcttcaccaaatatttgattctcagcctgattagacctctattttgatacattcattcaacatatttatcaactgcttgctatgtgaaaaatgctatcctaagtactagtcatggtctgattggactctgcaactgataactcaagcgctattgtgtaaggataccagatttagatgagactgtcagcagccctctgggtcctcactgctcgcagtgtccacaggcagcagcagcagaatctgggagtttattagatatgtaggatggcagatccactgcaggcctcctgagtcagaatctgtcctttaagaagatccccaggtagtgcatatgtgcactgaggtttgggaagcaccagtctagtccattctctctgtcactagaataaactgtcctggcctttttcctaagcagatttcttttcagattgttccaaaagataatatggaaaaaaaa

SEQ ID NO: 14020 - DNA, 499 bp, Homo sapiens
aacagagtgaagagacaacctacagaatatgagaaaatattggcaaaccatgaatatggtaaggagttgatatccaaaatatataaagaactcaaaagtaagaaaacaaaatacctgattaaaagtaagcaaaggatgtgaatagacatttttcaaaagaagttatacaaatagccaacaggtataaaaatgctcaacaccacctatcaccagggaaatgcgaatcacaaccacagtaaggtatcatctcacatttgctagaagggctattatcaaaaacttgaatgacaacaagtattggtgagaatgtgaagaaaagggaaatctttttaactgtttgtgggaatgtagattggtacggtcattatggaaaacagtatggaactccctcaaaaattaaaaatagaactaccatatgatccagtaattctaccacttggatatatttccaaaggatatgaaattggtatgtcaaagagatatctgcactgtcctgttc

SEQ ID NO: 14021 - DNA, 428 bp, Homo sapiens
awaggtccacttgcagtgaaataaaccagaggtttgaatcatggcttgatacgaaattattggaaagaatatggcgatgacatccacaatgccggtaagaagacgaaattacaagcaggatgaaaaatttgttcaatgaaacacagctattaagtggctgacctaataagtgttatgtataagtgactcatccattgtagcttctgggactcaactttaggatcatcgtcatatgcagcctggagctagccatatttgaagagctaggaaggaggcacagtgattgacaatctcctttctcctcaactagaatgtcatttccttttttaaaactaatttaaatcccatctacattcaattgcttgtctaaaataaaacccaactcctctcttaaagactttaaaaatattatatagcagagttcatcc

SEQ ID NO: 14022 - DNA, 387 bp, Homo sapiens
aactttctcattagaaatagcccatttatacaggggactggctaatgtttttctatgagtatcattagccagtgtctcaaagtggtgaagagtaagtatatagcatctttcaaaagactgcaacctggaacaaggagagacaaagggaaggaggagtctggagccatattgaagatgaaattgagatatggactaggtggtggatcgtttttataagaggacataaaagaggatgctaaagctaattgccacaatcagaactcaaagacctagcaaatgcaaggtggtatttattccaaactcagcaaagtagtagaaaaatagttttgagaacagttttaaggagactagggtaacagtgagaaaatagttcatggctagtctgga

SEQ ID NO: 14023 - DNA, 382 bp, Homo sapiens
  misc_feature 162: n=a, g, c or t
atrgcttctcmatcttaaggttgttaatcacatctgcrgaatgcctgtrgccatataagttaacatattcacaggttctrggaagaaggacatggacatcttccaggaagcattattctgtctaccacagcagttctttcaaactgtatgtttcccagacmnttcatccttccctgcacaaagtcaagttcatmaacgttcttactgaaatgtgatgttgtttatcacgaatatatataaagcaaagactctctaatcctgtactttgcatctggcatttcaaaatgaagtctaaaagtgtacaatttctactcctatgcaagtttcctcttcttrgatttgacctcctattctggactatgaagagaaccctgactmatac

SEQ ID NO: 14024 - DNA, 87 bp, Homo sapiens
attcctgtaatcccaacactctgggaggctgaggtgggagggtcacttaaggtatttgttattttttgcgtacaaatatttaactaa

SEQ ID NO: 14025 - DNA, 255 bp, Homo sapiens
cttaaaaaaacatctggtaaagactgggtgtggcagctcacgcctgtgatcccagcactttgggaggccgaggctggatggatgattgcttgagcgcaggagttctagaccagcctgggcaatacagggagaccctgtctctatttcaaaaataaataaataggccccggtgtgtgatgttccccttcctrtgtccatgdgttctcaaaaaaaattaaaaaataaaaataaaaataaataaataaaaaaaaaaaa

SEQ ID NO: 14026 - DNA, 502 bp, Homo sapiens
ataaaagacaaaaatggaggtccaggtagatgtaattcacacagactgaaagtgagttcgggctagtgtaaaacacatgagattggatttgaccccttggctctcaagtgtccccttagatctagaactgctccttggtggccattagatcgagtcagttttgatctgcatcacttagttattgggaatttctttgttggaaacaggaaaatttttttagattatttggtgtacggttttgctcacaacaataggtggaagttgctagtgcagtcttggtctgatggctgtgtgcatcgcacattcggcttggtgaaatccttctctaaagcctctttttgtatttttataactaaacagaggaagtcttcagaagacctcgctttaaaacaaatttgtgcaaacactgctagagtcattttgaagctcaagcattttcactttgtttcttacatgtgtactttttttgtttacttgtgaaaatggccatctttaagcatat

SEQ ID NO: 14027 - DNA, 317 bp, Homo sapiens
agtattgccagagaacaggagaggaggagagtatggtataagcatgtccagaaataaggagaacttgaagcagaatggctgcaagatgtgggtttatcaactctgatctcaggtgatgaagaggaagatggcaaagccttgctctccacattgactcgaacccaagcagctgccgtgcaaaagagataccatacctatacccaaaccatgaggaaaaaggataagcaatctatcagggatgtcgtgacatttttggagtcagtgaatctcctcctcgtgatacctgtggcaaccacactaatcagctggatggcacc

SEQ ID NO: 14028 - DNA, 119 bp, Homo sapiens
  misc_feature 69: n=a, g, c or t
aatttttataaacttttgttctttcttgtaactttttatcagtcagctattccaatgaagcaaaatctngataatatattgcttttatactaaaaaaaaaaaaaaaaaaaaaaaaaaaa

SEQ ID NO: 14029 - DNA, 399 bp, Homo sapiens; identical to SEQ ID NO: 11121

SEQ ID NO: 14030 - DNA, 228 bp, Homo sapiens
  misc_feature 60,83: n=a, g, c or t
aaaaatctctttgctccagccagggttgtgacttaagcctataaattttkggaggctgangtgggcagattactggaggccangagttcaagaccagcctggccaacatggcgaaaccccatctttatgagaaatacaaaaattagctgggtgcattggcacatgcttgtdattccagctactcgggaggctgrbgcacgagagtcaccatgcccggcatatatgaag

SEQ ID NO: 14031 - DNA, 483 bp, Homo sapiens
ttaaaagatcaatatttcaaaattatatttccgtcaagtttgacctcaaagacgagtaaaaaaattgtgttttgatgttagcatttttttttagcacagccatttaatagatagagtgagaaaatcattcaaaagacaaagctaactcattggaattggtggtgatctctggggatgtagagtaccagagaaactgcactattcatgcatatcctttttcattttaggccttattgaccacatctgtgtataagttgcaaaagtgagttcacattcactaatttctgaggaatttggggatctgggaaggcccagctagagtaccatgagtaacaggggaagacaggaaagctgacctcatcctgtgggccaggccatgcacctggctcatggtcgagtagcatcatgtggtctttaaagtgggaaaaggctggaagtggtgactcacacctgtaatccctgcacttcttgaggctgaggcag

SEQ ID NO: 14032 - DNA, 89 bp, Homo sapiens; identical to SEQ ID NO: 10118

SEQ ID NO: 14033 - DNA, 77 bp, Homo sapiens; identical to SEQ ID NO: 10181

SEQ ID NO: 14034 - DNA, 458 bp, Homo sapiens
aaattaaagaaggatgtgaaggttaggctaagaagtgtgatgacctttatttaggtaataggcaatgaggagaaattgaaacatgaaggaacataatttgaggtgtgattatttgagtttttaaaatattatcactgtgcatcagaatgggttagggaaggcttaaatcctggatgctggctcagcacctattagagcaattaaaatgagaaatgatgcagactaaactataatttcaggtaaaaatgggaaaaataggcgttaaaaaatggtataaacgttaaaaaactacacttgactgagttagaatatggaggaaaaggaagtatggagatcaaaagaaaacatcaggatttgggagcttggacacaggggaatgacaacgtaaagggattatttcaaagataatttggcatagacacttctagactctcctcttcatctgtgtgtgggtactg

SEQ ID NO: 14035 - DNA, 440 bp, Homo sapiens
  misc_feature 101,157,257: n=a, g, c or t
cagggcagtggggtctaatccccctctgtccccagagggctgtgcttggctggcacacctgcttgcgggtggtgatgacctgccggatggcactgacgaanccgctctggtcgtaggggatgaggcccatgaagatcttcttcttggacgagtacangagcatgagcacgcgcacctcacagggggagatgtgggggaacagcatgcagcccgcctgcgggggccgcgggtcaggaccctgtggtcactgcccgkgnccactgtgcccccaccaccctggaccgccccacctgtaggggatgaagggagatcatcggtggacagaggcccccacagtcaaggccatggccataggtgaggggcctctgagagcccgtgcagcgcccatcggcatcccccgaccctgccatggctgaggtcagagtggcacccggcaccca

SEQ ID NO: 14036 - DNA, 312 bp, Homo sapiens
aaataatcttgagcaacaagaagaaagctggaggcatcacactaccaaactttgaaacagcatggtactggcataaaaacagaaacatagaccaatggaatagaatagagaactcagaaataagtatttgtatttacagccsaaagaacctttgggatttttaacaaaagcaccaagaacatttattggagcaggacagtctcttcaataaacgatggtagggaaactagatatccacatgcagaaaaatgcagctcaacccctatctctcgctatttacaaaagccaactcaaaatggatcaaagacttaa

SEQ ID NO: 14037 - DNA, 489 bp, Homo sapiens
tgatctcagccccaaggatactagacaagcccccaacatttctaaattttttgtagagatgggggtctcactatgttgcccatgctggtcttgaactcctagcttcaaacactcttcccacctcagcctcccaaattgctgggattacaggcacaagccactgtacctggctctattaaaatttaattaaaaatttgaaaaagtgaaaattcaggctgggtgtggtggctcacaacccagctggctggccaacatggtgaaacccggtttccactaaaaatacaaaaattaaccaggcatggtggcatgctcctgtagagccagctactcgggaggctgaggtgggagaatcacttgaaccccggaggcagagattgcagtgagcaaggatagcaccactgcactccaggctgggagacgcagtgagactccatctcaaaaacaaacaaacaaaaaagatgcggtggctcacacctgtaatcccagcac

SEQ ID NO: 14038 - DNA, 490 bp, Homo sapiens
ttctggaccaaaattcgtgctacacatatgtctgatggcctttaccttttcaagaaaacagttgcaattttgagcaaaattttcctagttgtaatattttaatagtgttatgtattggaaaaaatttagaaatactcctaagagttttcaatttcaagcagaaatgcttctcttctaaataaataccacttaattgatagacctttagcagttcttgtgctaggatttatacatttttgcttttctggaaaactgctttggcgcattaacctttctactgcaacattttctcttcagtagatatatgagtaaacatgatgagttaatgttacacagcatacccagttaggtctcttattcttaaagcatctttctttagaagtctgcacatattttcaaatgcatcatattaaaggcacaagtcaagaggaggtggagttgcctacttcagtggcctttattcccactatacccagttctcagtcttgat

SEQ ID NO: 14039 - DNA, 475 bp, Homo sapiens
cttccctgttgcggastctgaagcgggctccctgagggcgctggttttgaactggtcttgtgcggtttgcgctttctcttagtggttacagttggcgctgtctccgctttcctgtttcgtggcgggcatcttggccaaaacactctccctgccaccttattcctctagggttgtgatttttttctttcaccaagaaatatcactcgctggtaatttgtcaaactgaagaaacccctgaagaagcagtggtgggcaggcgccgacgctgcggcttccagagcattttggcaaatcaaagccagggaccgttgctgggcctcatttccgcaacttttcggctccgaactgctgtgagtggaagacttttggtggttgttttgatcaggctccttctgtaactagagactatagcattttgaaagaaatgagattctcattcatgtcaagaacatacttgtggatttttgagtgttaa

SEQ ID NO: 14040 - DNA, 478 bp, Homo sapiens
attcatgtttttaaaagagcttgtctacagatggttccacacttgaaattgtgccctgcgagttgcatagctggaagttcaatgctcagtcctaccttggctcccattaaacatttggtgctctgtggattgagttgaacgtgttgaggctttgcaatttcacttgtgttaaaggctctggcatttttccatttctatgcaaatttctttgaagcagaattgcttgcatatttcttctctgccgtcacagaaagcagagtttctttcaaacttcactgaggcatcagttgctctttggcaatgtcccttaaccatgattattaactaagtttgtggcttgagtttacaaattctacttgttgcattgatgttcccatgtagtaagtcatttttagtttggttgtgaaaaaaccctgggctgaagttggcatttcagttaaaagaaaaaaagaaactagtcccagatttgaaaacttgt

SEQ ID NO: 14041 - DNA, 510 bp, Homo sapiens
attaatgcacagaagggatatgtgtgtctaaatgcttatatttgcttgctttgtcttaggtttggtgtgtctttttaaacttgggaatctaggtatatgctcttaaaaagtacttcttggggaattagaaaagatttctaagataagacattgattttgttatcttagcagtgtaatcaaaacaaatattataacctcaggactaattcttaatgaactttgctgaaattgaaagttgttgctgacaacttaagagcatttcttctcatcctcatcagccattgtgaacgcccttgttttcttgctgtcagctgtttgagattgtcatgatgatgttaaattatgttcagtcttctgagtgttttgttgattaatttgtgttactactcttttattaggatttatgttgtctggtgtattgtagcatctgtatttctgtcaccattgaaaatcagttagaaaacatcagtaacttattttgttcacttggaaaacctttccaagttaaca

SEQ ID NO: 14042 - DNA, 472 bp, Homo sapiens
cattgataatttttcatgtttatttactccattattttctatctccttttacttaaaagcaagctctgctaattcccctcctcttcagtgtggtgggcaggacttagtaacttccttccaaagaaaagcaaatggaaaataatatcttcacagagaaggaacctggcagacaccacctgggccaagtgatcaaagctaactgcaccagggacgtcttgtggatattgggtactctgatgcgaagagaagggcactttcccctgtgatatgtatccaaaaatccataagcccagaataattgtaagagagcatcagacaaacataaactgagggacattctacaaaatatctgataagtacccgtcaaaagtgtgaagatcgtgaaaagccaggraagactgatgatctatcacagattkgaggagactgaatagagatgacaactaattgtatgtgagatcctggattatat

SEQ ID NO: 14043 - DNA, 535 bp, Homo sapiens
aagaagaagaagaatataggctatgagtggtggcatgttcctgcagtccaagctactcaggcagttgaggtgggaggatctcttgagcccaggagagattggtagaatgtattaaatgaataggtggatgacagagccttgggaaatgtaaaaaaattagttaaataaaataaaacatgatccatctatatactgtctataaatacagacttactttagatacaaagacacaatgagattgaaaacaaaagaatgaagaaatgaattccatgcaaaaagtaaccaaatgaggccaggcttagtgactcatgcctgtggtcccagcactctgggaggctgaggcgggcagatcccttgaggtcgggagttcaagaccagcctgaccggcatggagaaaccctgtctgtactaaaaatacaaaattagccaggcgtggtggtgcatgcctgtgatcccagctacacggtaggctgaggcaggagaatcgcttgaacccgggaggccggaggttgcagtgagctgagatcgtgttatt

SEQ ID NO: 14044 - DNA, 319 bp, Homo sapiens
atctgccacgaaggaagcgccacgctcgccaggccagcaggggcgtcgttttgttgccattttgttgaacgttatgggtttatgggtgttcctggaacttgtctttgtgcattcgttgctgtttgtgttaccctcactgtccccatgtcccacccacgtcctacggcactcaggaagcacttggtgaggacgagccctcacccttcttgtcttccttcccagcagcgcccgsagcgggccatttacacgtcgaggctggcacctggcgcgctcgggggccactgtagcgtctgcctgctccctggactcgcaggcctcg

SEQ ID NO: 14045 - DNA, 479 bp, Homo sapiens
gcagaggcctcggggtgggggagctacaaagcacaacaatgtacatagtgtagaaacactaacagctgggagaggggagccagctgtccagccagcatgttcctgttgtacagcccggtctccctgcgcgctctgctccttcccatgtgcagacagatcagggaggaacctccaatgggtgggggacagtgagcttcggcctggccgaggtgggtgggtgggctctcagattcagctctgtgtaaagattctctagcgggctgcgctcccaagttccccttctctgtgaaagttaagaattagtacagctgtgttttttaaagccacctctctgtctccaccccatgggcccacacccaggtgggggaggaggaagccactgcatctgttggctcagggccccagcctgtgcaagcaggggcgcctgggctgttgtgtctcctgtctgtgccgatctctattaaaggactccctcttgg

SEQ ID NO: 14046 - DNA, 485 bp, Homo sapiens
ctgaaaaacaaatctgaatctatttgttattcttagcgtcactggtctggctttcagaattaacatacaaggttgccacacctagttctgcccagctttatgtcttttattccagtattccaccaaagtttgttttcctgcattccagttctcaagtcttaagataaagattgtacttgacagtttagtatatccataaaactatttgaggtggttaaggttcttgggttcattttccttaatactttgctgaatattgtagattgtaggcaatgaaaaagtctactaaattaggaaaaccttgaataattaggtatcctaggtaagagcccctaaacatcaagcaatctgtgagtctgtaaagaaataaatattttttggattattcttatctaattccacccctgttggaagatgatttctttgttctttgcaactatggaagctgtgaaaatcatcacaagtgcctctgaaagcgagtgtta

SEQ ID NO: 14047 - DNA, 443 bp, Homo sapiens
ctacctatgtagacaggtatgaaattaagttataattttcatgagacattttcatcactgttgacacagtttcaagcattccatcatgttattttgactctttttctttttttttctttaaaaatatatttttaactagaccaggccccactataatatcacttaagagagtcagggcaaagtttttgcatttatgaagatgtgttcatgtaagggtgattgtaatggagttcattggtaatagaagcaaaagtacagtaacgaagtattgaaaagaaaattttggagacattggagcatattatatatagcttgtggaaagacataaggctacagatggaatggaacattcctgttttcttgaagaaattcacatacacatagctgacctgactagtacttcagctcttccacagccttctataaaggttctttcttctgca

SEQ ID NO: 14048 - DNA, 371 bp, Homo sapiens
  misc_feature 28,75,115,217: n=a, g, c or t
ctaaccaaccctgagaggcttgttcctngttcccatacataggagactcaatttacgagttgtctgatgttgtcntatachtttcccaattgatttaaccaaaagcaacvttttncatctaaggctaaacaaattcttccctgtgctgccattaacgtatgtactccttggcgatttgggaggactatggctgctgacgagtcaatttgttcttgcnagctattaaggttttagttgtggcatcaatgttgttggctatgtctgttgagagctggtcaaggaggcttctgtgactctggcaattctggttcccatactggatataatgccacatctagcaagaagtsgaattaattggmtagccckcwtca

SEQ ID NO: 14049 - DNA, 473 bp, Homo sapiens
ctagccccttctttagggccmaagagaattttgagcactagccgtctctgggtcgccggctaataaaggactcctgaattcgtctcagagtgtggtttctctataagttgctcggttacaacaatttggttgtccaaaactttgattttcttgaacttttttaagagagtttgtgtggctagggagcaggaccactgtaaaacgaggcaccttccctggtttgtcctaaccctttctctcagccagccatctggatggaatggagtcaattatcagaaagtggagagttaagaattagccaggtgtggtggctcacacctgtagtcccagcttgagtcccaggagttcgaagctgcagtgagctgtgattgcacccctacactccagcstgggcaaccagagtgagcactgtctcttaacagaggccaagtgcggtggctcacgcttgtaatcccagcattttggdaggctga

SEQ ID NO: 14050 - DNA, 111 bp, Homo sapiens
ctgtaatcccagctactctgaagactgaggcaggagaatcgcttgaacccgggaggtggagtttgcagtgagccgagatcgtgccattgcactccagcctgggcaacaaga

SEQ ID NO: 14051 - DNA, 499 bp, Homo sapiens
gaggagtgggtccggaagcggcgccggagctggtccggaagcgggcggtggagaagtccagttgccccaaaattcttagggtgagcgaaccgattttctggcggggtgggtggtcccgcggcccaccaagggaacgtctccgcagcctcgcctcggcgacagstcctcgctccttaggtgtcttccgcctcactagttaggatgcgcggtcttcagacttgagacaaatctaaccataaatttgcgcggccgttattttttaagcaaaaatgtgagctatttttacccagacatcatagttacgagagtgacgaagactctggcaggaaaccaaatatcacctgttttcctcaaaaagcagcagaagagtgacaagtgaaaaaagttcctagcgggagacgtgcttggaaccggagataatctgtgtctaccgctggtcttcaaggtgcttaatttcgtgcccgctctacaggaaaataacgtgcgcggcggaggagcc

SEQ ID NO: 14052 - DNA, 70 bp, Homo sapiens
atatatattgataatagattgattagcaacgttctcaaagatctcatatactcttttttttttttttttt

SEQ ID NO: 14053 - DNA, 333 bp, Homo sapiens
ttcttttggactggtccaggaggtagggtccttcctcagtcgactcctgcagaggtcacattttgtgtgcgggtttgtccccagcgtttgagaagcgctacaaagcagccactgtgcttactgaacggcctccccctgtatcgcttaattgagaaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgtgagaggtgggctccaccctgtacacta

SEQ ID NO: 14054 - DNA, 486 bp, Homo sapiens
taaatgttcaaggtgtgtagagaaataatatggaattagcagctatgactccaacagacaggattgtgtgagcagctgaaaggagcaaaaaagaactcagtgtaagagaaggcacatacatagttaagaatactaaagtatttttaaaaatcaaggaagaaataaatgttacacaatttgcattggaataaatagatctatttagtcctacaaatcaggagtggtgtagagacatccaaatttaaagaaaaaaaaacacaaaacagaatgttaaaaatgtatgcagatttatggatattatcaatgagaagacatagcatgtaacttctcctatatctctactgtccagcatgtattgttccaaatatgactccctaaaatatatacactttgcagaagctctaggccctcacctcaraccttgccattggttgccgtatttcaaggtcatatagtttccctcactttacacaatcattattcttc

SEQ ID NO: 14055 - DNA, 513 bp, Homo sapiens
cagtggttggtgaggcagtgcccacaaggctcatgttgtatgcctttgataaggccatcttggctttgagtagcagtgttcctcgtcacccatttccccctcaggattacaacacctgctatcaaatcatctaagctgaaaacatgagatgcgcttggaaaggcctagtcagaagccatttcctcttatcatttccctctcctatgcaccagtaaggcccgtccagagccccagcagggagtgggccctgagtccacactgtccctgagtgatccaggaggctgcacacatccccacatgtgcactgtggttccagtgtagctgctgtgagcccactgccactgcctcagaagggagccactgtgaacctctcgagtggctccaaagagcagtggctttttgagaatggcccatacttctggcccggctggatgaagggaatgccgaccctttggcctctccccctccttccatctcttctctctcttgccctatctctctttctacttcaaa

SEQ ID NO: 14056 - DNA, 383 bp, Homo sapiens
gcaaccttccctcggaaggagacaattcgaggtgctggtacatttcccttgttttctatgttcttctttctagtgggtctcatgtagagatagagatatttttttgttttagagattccaaagtatatatttttagtgtaagaaatgtaccctctccacactccatgatgtaaatagaaccaggaataaatgtgtcattgtgataatcccatagcaatttatggtaagaacaagacccctttccctcaccaccgagtctcttggtctgtgtctgtgaaccagggcaggtaattgtgacactgcatctcatagaactctgcctgcccagatttttgtgtgctcacctcaatgggtgaaaaataaagtctgtgtaactgttaara

SEQ ID NO: 14057 - DNA, 485 bp, Homo sapiens
tattaaactccccattttgtacacccctcaagaagaggacataatttcttaacaccagtgatcacagctcagaatcaatttaaaagtcactaagtgtctcccatacatccccctgggactcctacagcttacaaaagaggaaccctccaaccctatggttttgctttcaaacgttcttggcaaagacggttaacaatgtcttatctcgatgtagtcctcccagttgggctagaagcaccatgaactttaaaaatagtcatgctcggctgggcgcagtggctcacacctgtaatcccagcactttgggaggctgaggtgggcagatcacgaggccaggagatcgacaccatcctggctaacacggtgaaaccccatctctactaaaaaaaatacaaaaaaattatctgggcgtggtggcgggcacctgtagtcccagctacttgggaggctgaggcaggagaatggcatgaatccgggaggcggac

SEQ ID NO: 14058 - DNA, 201 bp, Homo sapiens
aaccaaatagacctaacagacatatggaaagatatccatctaacaagagcagaatatatattcctctcaagtgcacatggaacattccccatgataaatcatatgttaggccacaaaacaattctcaataaattttaaaaggtcaaaattatacaaagggccaggtgtggtggctcacggctgtaatcccagcactttgtg

SEQ ID NO: 14059 - DNA, 322 bp, Homo sapiens
agtatttggtcaaagttgcaaactcctcgggaggaggccaggcgtggtacctcacgctgtgatcccagcattttgggaggctgaggcgggaggatcacctgaggtcgggaggtcgagaccggcctggtcggcatggcgaaaccctgtctctattaaagatataaaaatgagctgagtgtggtgatgcacgcctgtggtcctagctacttgggaggcttgaggcgggagagtcgcttgaacccggaaggcggaggttgccgtgggatgagattgtgccactgcactccagcctgtgtgacaaaacaagactcctcctggaaga

SEQ ID NO: 14060 - DNA, 176 bp, Homo sapiens
cgagaaatcgacgttgacaggtctggtaccatgaattcctatgaaatgcggaaggcattagaagaagcaggtttcaagatgcccttgtcaactccaccaagtcatcgttgctcggttttgcagatgaccagctcatcatcgattttgataattttgttcggtgtttggttcggctg

SEQ ID NO: 14061 - DNA, 129 bp, Homo sapiens
tggctcatgcctataatcccagcactttgggaggccgaggcaagaggatcacttgagcccaggagtttgagagcagcctgggcaacatagcaagaccctgtctcccaaaaattaaaaaaaaaaaaaaaa

SEQ ID NO: 14062 - DNA, 421 bp, Homo sapiens
  misc_feature 106,340: n=a, g, c or t
agtcccgcgatasttcaggcctggcggcggcttccaagctaaggaacggtttggggcagtgtcgttcccggagtcggccgcsgttacccgctcaccagctacgcgncgstacaggtccgcggaggcgcggctcggggcgcctgcgggacggtgaggccctgctgaggactccggacactgcccatctctaagataagaacctggaaaggggactctgttggccattggaaattgcagaataatgtctcaggtgacatttagtgatgtggctatagacttctctcatgaagagtgggcatgcctagattctgctcagagggacttatacaaggatgtgatngtccagaattatgagaacctggtctctgtaggtcttttccgtaactaagccatatgtgatcatgttattggaggatggaaa

SEQ ID NO: 14063 - DNA, 309 bp, Homo sapiens
gtttaatgaatagtagaggtgtcaagggactatgtatacatgattagggtaagatagaatgtattatatatatatatatatacacacacacatatatatagctgaatctttggtgtattgaaataggcagcactctgaaagacagaagcttcgtccagccactcttcagcacattcctttactaagcagtttaaagccgtcctagtggagcaagccctaaagcagatttaatttttgccattttccaagaatgacggtggtggcttttagtcagaaaatggccttctgtgctttcaaaaaaaaaaaaaa

SEQ ID NO: 14064 - DNA, 444 bp, Homo sapiens
tgaaaaaattaagtcagctcagcacgagttgaaattgactacattaatttctttccacctagaatcaacaggatgtttatttcctatgctgattctggaggagttaacctcctgcaaaaaaggcatcttgtccctacatcttctcttctgactttggctacatctcatagtaagttcagagtagttcatgataaattgaaaatataatggtcattgcagaaaatgattgatgttgtaactgtccacccaagtaagaagtgtatctgcctttccatcttttggttttcatttgggcatgtgctattaccagaaacaacaaacttatatttaaratacccttcatttgacacagtttttaatgagtgatttaatttcctctgtatttgtatgtttagaagactgcctaaaacatgagcactgtacttcataaaggaaactgcgtat

SEQ ID NO: 14065 - DNA, 477 bp, Homo sapiens
ttttttttttcatagtttaggtgtcattgttgccagcacctttagtgcycagtcttcagtgaaaaatataaagtgccaaaaaaatcttgcaagacagaatccatacttaacactctttccaagacactgtgaccatgtacagwrgctatttcctgatgaccaaatctctcaacgaatcatgttattaataaatatttttagcactcatcagtattctccaatgtgaccttctcattggagtacacagaaggaaagcaaagaagagcatctgacttctagctctggcttacagcctctctaccaggccgaagcaagagacccgcggcagcagytccccgcmactcagacctgggtggtgataacctcaaagaatggctctgttttctattgacagaaaacccacttgattttgcttctgagttagcagtcagaagmccctctaagtacaatagaagtgctcttaacggactctgcctg

SEQ ID NO: 14066 - DNA, 508 bp, Homo sapiens
ctattgatgggattttcagatcttttcatgagaactggaaatgtagctgggtggcacctacctaggttgctacgtagtgagtagactttctcttgggtatagtaagcctcagacagctttcacttttatctactttacttgtggaaataaaacagtcattttgttctgaaagaataagatagctttctgtagagaaggaattcctacctctaaaagctgccttgagaactcagaactggcagttttctgaggtgatttttaaatttcagtattagggagagtccagcatttgctgacacagattctacataactaatgtatgatagcaaatgcaaaactattataatgtggtgtatcttgcgcatacacaggttagaacaagtagactctggcagcagatctccagagacccaagtttaggttctcatagtgtatttgaagtagttatactcctggcttaagtagtttagtgcctgggagaatccattactgaaaagcatttaactta

SEQ ID NO: 14067 - DNA, 170 bp, Homo sapiens
ctataattctatcatatgtaataatgttttttttgttttgtttttraracggagttcgctctgtcacccagactggagtgcagtggtgccaacgtgactcactgcactccagcctgggtgacagacgagactccgtctcaaataaaaaacagcaaaaaacaaaaaaaaaa

SEQ ID NO: 14068 - DNA, 242 bp, Homo sapiens
tttactggggaaaaaagtttctagagttgtaaactggcagtcagcaatagttgaaacaaatatgtaggataatgagtggatcgataagaagtctagaagacttacatggtggcgtttactcagaacctattcattgagttcttctaatcctatataatctctttgctaccaccaccagctttattgaggtatagttaacaaataaaaattgtatatatttatggtgtacaatgtgcattttt

SEQ ID NO: 14069 - DNA, 484 bp, Homo sapiens
gagtagctgggattacaggcgcgtgccaccacgcccagctaatttttgtatttttggtggacacggggtttcgccgtgttggtcaggatggtctccaactcctcaccttgtgatccgcccgcctcggcatcccaaggtgctgggattgcaggcatgagccattggacccggcctgtattggcttttaatttttaggaaataacacatggctgtgacctgacaacttcatagtggccgtaggtagggcactgttgtcattattcctgtcactgacaatgtcagccccacctgcagatgtaggagagtagatggggaaagtagtagtggagagtagaggtttcccttacsatccttttaggaagtaggcttttaaacatgatatgtaagtttatttagaagatgaaaattaaagcttgaaatgtaatatgagaggaattggcagcggatgtgagtcagatcctcacctgtcagagcaggaagttag

SEQ ID NO: 14070 - DNA, 482 bp, Homo sapiens
cttcatgactcctgaagttataggctgactcctgggctgggggtgggctgggaaactcacacctttgtcctgcaggtggccatccgagaggcctatgaggcaggtctgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtgggtaaggcctggcgtaaccctgggtcagactgtgtcctgtgacacccgggatctggctaggctccctttggattgttcttagggatttctgagtggcttcccggctggggccagatagagagtaggctggcaacaacacacaggctcccccagggccgcctgctgtccctcctcctgcctcggtccccgccgcaccagtgctgctctgtggctccacc

SEQ ID NO: 14071 - DNA, 487 bp, Homo sapiens
agtctccgttccagacgcgacctggcggcggcttggcacggtgtggagggaagacgccggagaggccgcggtctcggggtccgtgtgctcccggagaggaggcgggtggccgaaagcagggtcggagcacgcgttcctctctctcccgggccgagcgttcccagatcagactccgcgcgccgtggattgcagtggaaggggcgagttgacttgcggtcgcacagcccccaccagtccaggaccggcatgccgcaasscagtggctcacacctgtaatcccagcactctgggaggtggaggcaagcggatcatctgaggtcgggagttcaagaccagcctgaccaacatggagaaaccctgtctctacaaaaaataaaaaaaattacctgggcgtggcggcacatgcctgtagttccagctgctcgagaggctgaggcaggagaatcgcttcaacccgggagtggaggttgcggtgaccgagatcgcg

SEQ ID NO: 14072 - DNA, 243 bp, Homo sapiens
atttctaggtcagcatttcatatgcctgaagagtatgaggatagtttgaaaaatcagaaggaagatgagagagggctttgctcttttttaagatcttgctagcagttttgtttgttggtaatttttgctgtctcactgacgccaagagtcctggaattaaaccccgtggccagcaggctgttagttcgtcaggaaattccaaatgggtataaataaattctctgcaacagcaaaaaaaaaaaa

SEQ ID NO: 14073 - DNA, 289 bp, Homo sapiens
ccattccttaggattttaaggtcacattttattcctggatgctttatgtccccacctccacctgagccctcatcctctgttccctactatactcccaacttctactctttgttttatccacctatccctattacctgaccctttgtcttccctgtctcccatccttggggggacatgtagccctgtggtcatggttctgatgacatcatcagggcagcccccctgcccaggtattatggcctgtcagcattccctgtgccctccaaaccttaggcctagaatgcggast

SEQ ID NO: 14074 - DNA, 439 bp, Homo sapiens
  misc_feature 74: n=a, g, c or t
attttcagcgctggaacgtctacccgctgcgccaaaccaaaactttgcagtaatagttgatgctgtttcctgcnstttggtggagatttgcaccaggcgctggagaccgtcccacctggccaatgcccacctcccggtgaacacagagacccaactttgtgcaccgccagtcttgttatcaaaaaacaggctagtgccaggcgcggtggctcaagcttgtaatcccaacactttgggaggcggatgcgggcggatcacgaggtcaggagatcgagaccacggtgaaacccgtctctacaaaaatacaaaaaattagccgggcgtggtggcggggcgcctgtagtcccagctactcggagaggctgaggcaggagaatggcgtgaacccggtaggaggagcttgcagtgagcagagatcgcgccaaatgcactccagcct

SEQ ID NO: 14075 - DNA, 468 bp, Homo sapiens
gaaatttcaaattgtatatgcatattttgaatttggtttatattttgtggtatctgaaatattccctggactagaagcaaaaccacagaaacaaaactttacatttagaaaaaaatttcaagacttctattgctaactttattacattagtggtttttagaagttatttagagcagtcttgtctgatagaactttccaccatgatggaaatgtaaataaatataccacattaaaaatataaatttgcaatgtccaataggctcgtatggctattgagcatttaagatgtaattaattagacagaggaagtaaatttaacattttctctcattttagctaattagaatttaaagtgaaatagccacaagtggatagtggctactgtgttggatggcacagttcaaaatgcctcttatttataaaaaaaagtgtttaaaagtggttccatggcttgaagaggaataatat

SEQ ID NO: 14076 - DNA, 298 bp, Homo sapiens
  misc_feature 276: n=a, g, c or t
acccagggtagcagagaagagactatagaaatgtagtgcagagggaagacaagtgaggaattatggcagccaaatgtctcccaaagtgaaagacaagaaaaatgggggcttcactgcacagtaggctggagattctacctaacctcacaggactcctagcatggctggtttcaaaactcgtttgagctataggaataggccattcgtggtggctcacgcctgtaatcccagcattttgggagacctcacaaggatcacgtgaggtcaggagttcangaccagcctgtccagcatggcg

SEQ ID NO: 14077 - DNA, 258 bp, Homo sapiens
tttgggaggccgaggtgggcggattgcgaggtcagatcgagaccatcctggctaacatggtgaaatgccgtctctactaaaagcacaagaattggctgggtgtggtggtgcacatgcctgtagtcccagctactcaggaggctgaggcacgagaatcacttgaacccaggaggcggaaattgcagtgaaccgagattacgccaccgcactccagcctggcgacagagcgagactctttctcaaaaaaaaaaaaaaaaa

SEQ ID NO: 14078 - DNA, 314 bp, Homo sapiens
  misc_feature 85: n=a, g, c or t
gtatagaaagaggaacacagagccaggcacagtggctcacacctgtaatcccagcactttgggaggccgaggtgggcaaatcacntgaggtcaagagttcaagaccagcctggccaacatggtgtgaaaccccatctctactaaaaaaaaagaaatacaaaaattagccaggcgtggtggcgcatgctgtaatcccagctgctcgggagctgaggcatcagaatcacttgaacctgggaggcagaagttgcagtgagccaagatcgcgccattgcactccagcctgggtgacagagtgagactccatctaaaaa

SEQ ID NO: 14079 - DNA, 509 bp, Homo sapiens
ttcgctggtattacatctttttaaaagcctattataacatggttagcctataaggcagtgttggtccccttctaatattggcctcataaaggggttccactgtactttccgcatattactgtgttgttgttttcctttgtggatatataagcaaattgagcttgggtgatttttatggagacaataattagacaatactgtataattagttttacttaatagattatcatcttgtgagaagagatgtttaaacgtggtaaatcacttcatattacaaaacagttbtacacttaatatgttaacattgggtgcaataatttagtagcattagctttagttacaaatataactggatctttctgctgacaacttaggttgtatgagttatgcttaaaagctttaaatctgatgtttcctgtacctgccacactatgttagaatgtgtccttcaaacatatcctccttgcaacttctcaaactgtactaaatttggatatttcttgaagtct

SEQ ID NO: 14080 - DNA, 489 bp, Homo sapiens
tttaaaaattgattaggcttttctttcctaatctctacataaacatgatagcttttttacttcattctttattgattcattgattgattgatattcaatgacagaagtcattgagtgactctttctgccaggtactgttacaggtgctggaaaacagcaatgaacaaaaagacaaacagctatgctgtcatatagcattttatttaagagtgagaaagtggtggtagttttaaactgggtcttaaaaaagaaaagaaatcagccgggcgcagtggctcacgcctgtaatcccagcactttgggtggctgaggcgggcggatcacgaggtcaggagatcgagaccatcctggctaacacagtgaaaccccgtctctactaaaaatacaaaaaattagctgggcatggtggcaggcgcctgtagtcccagctactcaggaggctgaggcaggagaatggcatgaacctgggaggcagagattkcagtgagc

SEQ ID NO: 14081 - DNA, 497 bp, Homo sapiens
ttagaggatggtaacaattggagtgcctaaattaatgagtcaaaattaccgcgcaaggccagctgtggtggtccacacctgtcagcccagcactttgagaggctgaggtgggaggatcacttgaggtcaggagtttgagaccagcatggacaacatggtgaaaacccatctttactgaaaataggaaaacaattacctgggcgtggtggcacgctttttgggaggctgagacaggagaatcacttgaacccaggaagtggaggttgctgtggaccaagattgcaccactgcactccagccttgggtgacagagcaagacgcccactccaaaaacaaaatactgcttaaaaaggttcttttagccagatgcggtggctcatgcctgtaatcccagcactttaggaggccaaggcgggcggatcacttgaggtcgggagtttgaaaccagcatggccaatatggcgaaaccccctctctactaaractacaaaaattcg

SEQ ID NO: 14082 - DNA, 204 bp, Homo sapiens
caaaaacaaaaacaattagctgggcatgatggcacacacctgtagtccgagccacttgggaggctgaggtgggaggatcggttgagcccaggagttcgaagctgcagggacctctgattgcaccactgcactccaggctgggtaacagaatgagaccttatctcaaaaataaacaaactaataaaaagcaaaaaaaaaaaaaaa

SEQ ID NO: 14083 - DNA, 392 bp, Homo sapiens
aacactgcaatgggataccagctgcagcgyctgccatggcagggctggtcccaccggagaggcaccctggcacccctgactcccaggatgagtcccagggaacaccagggtggagtcaggggcagggagactcttggggactctgagggagccacaggcccagggagacctcccaagaagacctcccaaagaatcaagcccagcctgtggacctggggtgctgatcactcatggggaagaaaggggtgttaccagcactagaaaatccgacatcttttcttttcaccattcctagaggtgcccccaggccacatgtgcagccctcaaacttggactcctgcagtctctctcccaggtcttctcaacctctgcccaagccagctcctacgcct

SEQ ID NO: 14084 - DNA, 267 bp, Homo sapiens
satacasacacacacacayacagagacacatcttaaggggacccasaagtattgcsctttaacaagacttcaaacttttctgctgtaaagaaagctgtaatatatagtaaaactaaatgttgcgtgggtggcatgagttawagarggcaaaggcttgtaaatttacscaatgcagtttggctttttaaattattttgtgcctatttatgaataaatattacaaattctaaaagataagtgtgtttgcaaaaraaaaagaaaarrmgc

SEQ ID NO: 14085 - DNA, 473 bp, Homo sapiens
tgattgattggcatacaagttctgtgctttaaattattgttttaaaatacaaggtgaaatcgtgaaataaagatgcttctgggtggcagatttccagggttttttcactaagttggtcagacatttctcttgcaaccttgtttgcaatattaatttttttggcaatttttcatagctaatacaaaaaatagactaagcccctatattctaagctaatagagcccagttaatgaatttgagtttggggaaaaccttttgtaggtcagctgcttctcctgccatcacactgactactaattcaggaggatggattcaaacataagtacaggaaatgatagactttttcaaaatcattgttttctcaatcttaattgtgcatttctataagaaacacttgagtaggatattaaagcccagcaggagacctgggcttagtgctcttgaaactctaccttgcccacctacctaccacc

SEQ ID NO: 14086 - DNA, 414 bp, Homo sapiens
gagacggaagcccgtggtgccgaaggcgcgcgtmstcgatgaggtctaggatggacgtgcccaggatcagcaccaccttgggagtgaaggcgatggagtagataagccaggccagacagtgctttaccatggaactgaaaccatgaaaagtgaaactgcaaatgggagagactgctgtatagtcactgaaaaattaatggatgagctcaacagcaaattagacacaactgaaaccttggacccatgtgtggaagatgacagcatcaccaactggagggtgcctggatccctgagtcaccacttgaagcaaaaaggtcaagagtagccacctgacccatatcaggctatgaatgagcagcatctggttgctacagcaacccagctctgcagggtgtccgattaccagcaggctcc

SEQ ID NO: 14087 - DNA, 445 bp, Homo sapiens
  misc_feature 345: n=a, g, c or t
acaatagcaggggacaagaagcagacgagcacagccttggagaagtacccttgaaccttcctctgcagaataagtatcctggcccaggatgggcagccatgcccatggcaaaaactaggggaaaaataatttgcattcctgaggcttctgctctgaccctgacagatctctctcatccaggaaatctggcggaacggcgctctctcagctaaaaagcctcaatcctggagccaacggattcggaaagcaactttgcactccaatcaaataaaaatgttcttctctgctgaggagaagggggcaggccccagaactgagctctcgggctcagaagagtgtacgcgngcttccagccggtatgcacaggcaagaagtgaagtgggcagccctggggcagaggatgcgactactggactgaggttgaatcctttacgtgtcgccacgc

SEQ ID NO: 14088 - DNA, 503 bp, Homo sapiens
caaagaattagtaataaatttttagggaaaataagaagccagggtataaaatttccaggtttttatatctaaaataatgtgaagcaataactgtttaaaactcaggaatacattcaccagcagcagcttaagaaagcatcaaacataactgagatcatcagtaattttataaaaatggcatccaggaaaagtaaaaatataacagaaatttccacgaggtaaaatgcccctacccaccacccccccaaaaaaaacagaaagtgaatataaaataagctacacagtcctaagacttcttattaataatttccagttggaagacaatgggcttaggaggaaacatgtttgcaactgaatgaaaaacgtatgaagagaaaataataatacctactccttgagctctaagcagcaatgaaaatctaagaagtttaacatttttctttctccatgctgggagtacagtggtaaaggtagcaaaacaaactataattactcagagatga

SEQ ID NO: 14089 - DNA, 441 bp, Homo sapiens
aattaaagaatgggsraaggatttgagtaagtatttcttcaaagaacatacccaaatggtcaataagcacatgaaaatatgctcaacatcattaactagcaatgcatataaatacaaataaaatcatggtgagatacgacttcatacccactaggatggctatactggaaaagacagataataaccatcattgggaagaatgtggagctgttagaaccctcatgcactgccagtgggaatgtaaaatggtgagccacattggaagagtttgggagttcctaagataagaagttaaacatagaggctgggtgcggtgcctcatgcctgtaatcccagcactttgggaggccgagacgagtgtatcataggtcaggagatcgagaccatcctgccaaacatagtgaaaccccatctctactaaaaatacaaaadaaaaaaaaa

SEQ ID NO: 14090 - DNA, 394 bp, Homo sapiens
ctgctgttaatgcgggcagcacctacagcaacttggaatgagtaagaagcagtgcgttaactatctatttaataaaatgcgctcattatgcaagtcgcctactctctgctacctggacgttcattcttatgtattaggagggaggctgcgctccttcagacttgctgcagaatcattttgtatcatgtatggtctgtgtctccccagtcccctcagaaccatgcccatggatggtgactgctggctctgtcacctcatcaaactggatgtgacccatgccgcctcgttggattgtcggaatgtagacagaaatgtactgttcttttttttttttwaaasaatgtaattgctacttgataaggmccgaacattatyctagttycatgtttaattt

SEQ ID NO: 14091 - DNA, 508 bp, Homo sapiens
agtttactgtggattgtttgtatcccttacctgctttctattgggttatgtgtggatatattgtttttatttgttcagcatctccttccccatcttctggtaacacaacctttatttatttgtggggaacctattccctgtggcttaggtgagcatgtgaccaggcctggcctcctgagtcccacagcttcctagccacagtgataaaagaatgggtatataacttaagccaggctaaggaaagcccttaacagaacttctgctggaactactggaaagaaggctttatggagatcccaggaaccaaggaccatgtaagcctgaatttgtgccatgtggagagagtctgtctgaggagaaactcggatgctagcagaaatggaaagagaactaagttctgatgtcatttttctggaggccctagatccagctgtgcctaaagcctgccctacctccggactttaaagttttgtgagccaataaagtcctttcttgtttaagataattg

SEQ ID NO: 14092 - DNA, 501 bp, Homo sapiens
cgtttgtgttcttacttggaaatctttgttgggagggctaagatgatcctcttttctaggagcagtggtatattagggttcttcagagatatagaaccaatggaatgtgtgtgtgcatgtgtgtatgtgtatgtttgtgtagctatacatagatgtatagatatatatatatagagagagaaataggtatgggcggggggagagagatttatttaagggctggtcacggtggctcacgcctgtaatcccagcactttgggaggctgaggcgggtggatcgcaaggtcaggagatcgagaccatcctggctaacatggggaaaccccgtctctagtaaaagtacaaaaaattagtcgggcgaggtggcaggcgcctgtagtcccagctgctctggagactgaggcaggagaatggcatgaacttgggaggtggaacttgcagtgagccgagatcacaccactgcactccagcctgggtgacagagcaaagactctgtctcaa

SEQ ID NO: 14093 - DNA, 326 bp, Homo sapiens
cattcagccttttgttttagtttggtaagttttaagaaatttcagcagcaaagttgttattcagtgggcacgatggactccaaatgcctcaagttatgtatacctgtcccagatgtaaacttcattgtcctttgttggatgatattttaaatggatataaaataaattggtctaaagggctgccctccttgttgtgtttttaaattttagttaaaaactgctacagcttatgactttgtactttaagataattgtattgatcttttttcagattccttgtattttttaataaagtaatcttaaataaaactcaaaaaaaaaaaaaa

SEQ ID NO: 14094 - DNA, 514 bp, Homo sapiens
aacgatgttgcctagttaacgcgagastcgggcgcagtctgggagcggacaagatacagtaaacaattggcttgcattgcaccttcctacccaagcagcttggttttctttcgctttgaccctgtaatttctttcccacttcgttgtcgtctctgaattacctttctcttgattcttgcccattagcatcctccaatttcagatgtttgtagatccccaagtgttcccagggaaaactactagaaaaggagaaaactgaatgggctacctttgaagtccagggcaccctcctctatcttgttcacttcctcatcaggcactatctatggactgagaagagaaggactttaaaacagtggtaaagaaagcaacaaagacaatgactggcaagacagaagaattgtgcagagaaagaggaacactgtgacccgatcaaggacgaaatgattccaacctccttagagccttgctggtgccgagatgtctgtgatcatcagtcacctcttcatcccaa

SEQ ID NO: 14095 - DNA, 504 bp, Homo sapiens
catatatatgaaggtgaatcaaaagaaaaagaaaacagattacaactttattactgcccttgttggacacttataccagcaggctagcagacactgcacagaatatagaaatgagactctgagtacatgatctataatgaaaatgaagccaatcagaatctaatattactacaaggttgaaataaaagctatggtatttctcataactgcacttggcacttagagaaattgagactcacaacatgcttcataaacattaattaattactctgggcttacatttaattcttccagtggatagaacgtatgtacagaagatgaaagagtcagccataacctggtgctcattgtacttccagattgtaggatcagctaataataatcacaatagtagctgacacttgtaatcttcagaacaccctttaagcatttattaatcaactattgcgccatctcaagggaaatattattcttctcacttataacccataaaattgtgtcttc

SEQ ID NO: 14096 - DNA, 186 bp, Homo sapiens
aacgcccagctgctgccgctgcttcaggagagagggtggggtgtagactgggtgggtctcacctcctgatgccctcaaggcgcsctctcagccccgsgtccscggcctgcagcggtgcagccaaagcccggacctctgcccgccccaaacccgccatgaccaccggccgccttttacydagcgtca

SEQ ID NO: 14097 - DNA, 174 bp, Homo sapiens
ttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaaagtcagcatttttttttttt

SEQ ID NO: 14098 - DNA, 225 bp, Homo sapiens
agtagatatcagatacgatattttggaaagttggacattaagaagagtgtgattggggaggttgttgtgactttctgcctgaagattcagagtcaggatcatgtgctaacaggtgacttgaagtttagaatagccatttggggagagtagacacaagaggtggggcactcatggctgacatttgttagagcaaaaggatttattagagtgaaaaaaaaaaaaaaa

SEQ ID NO: 14099 - DNA, 382 bp, Homo sapiens
  misc_feature 372..373: n=a, g, c or t
taattattgaataatttgtcagaggataaactcccaacctagacctttcacttaaaatagtgtgaatttgtatatgtttttaaaagaaccagtactggccgggtatgctggcttttacctgaaatcccagcactttgggaggccgaggcgagtggatcgcctgagatcgggagtttgagaccagcctggccaacatggtaaaatcctgtctctactaaaaatataaaaattagccaggtgtagtggcgcgcgtctgtaatcccagctactcgggaggctgaggcgggagaattgcttgaatccgggaggtggaggttgcggtgagcctaggtcgtgccactgccctccagcctgggtgacagagcgactgcnnctccaaaaa

SEQ ID NO: 14100 - DNA, 432 bp, Homo sapiens
ctgaaccagtattttctttgttctatctgagtcatgggaatgtcagaaacaaagatggacttatctgaacctaaaatactgtagaccagaaaacccccaacagagtttgtaacattgcaaattttggcagcatgatcagaacattagatggcttatcattatcagactttatatctgattataaagattaggaatttctacttcaggaaaggaatgaatgggattgaaaaggattgaaatcttcaaaataatgaatatctgaaagctcttgcattattttgaagcttattttttctataaatcttagcaattgaaactaacagttgctgggtatggcaactcatgcctgtaattccagcactttgggaggtcgaggcaggtggatcatctgaggtcaggagtttgagcccagcctggccaacatggcagagc

SEQ ID NO: 14101 - DNA, 455 bp, Homo sapiens
attttaagtcattcatgtattgaaaagaggatggggatatgatccctctgctctgtggcagtagatctactaatgggagagtcctggccgcacatctggcctgggtctggaggtgccctacggaattgaaagctggctggaactgtcatcttaacatgtcctggtcatcttaacgtgtccacctctctggcaagcctcttttcaagtctttttgttaccatcttcagctttttccctccatactagattcttaatgaattgctgccaacaagagaaagctttatacatgaagagaatggcaataagaactaactcgtctttttaattttaaaactggtatatattcctatataataggaatggaagatacttgcaaagcctatttgttcctctacagaagagttaaaaattacctgggctaatggaaagaagggagagtcagccaattagatgct

SEQ ID NO: 14102 - DNA, 354 bp, Homo sapiens
  misc_feature 342: n=a, g, c or t
aaaaaaagsggacccgsgaacggtggcgstgggtggacacggaggtcccgsgstccccgaccgaaatagggsgggccctatttcggagaggtktttggcacsaasattttttaaagccccgtgggtggttctccgggatctcccagaccgagagggcstgaacgtcsagacstcagggaatggggtcgaaggggcggcgctcgtccgcggaggtgggcgggasggccstgggctccggctctagagagcgggaktgaccctcggtttctggcctccgaggggcgggagcdatcctcagcaatgtccctagtctctggcttgsggstgatttttaaatttttntgtagaggccgg

SEQ ID NO: 14103 - DNA, 454 bp, Homo sapiens
ctttctttgcctccctccccacagaagcaccagacccacctgagccccagagcctcatgccagcagctcctggctgttcctcacctgaggctagagcagcagctgccagcttatagatggggcggatggcaggtgatagactgggaagcactgctgggtggtggaggtgggcagtggcaccatgacgggcccctagccacacagctgtcctcactacggggcagggagcagcctcggcaacaggcaaaggccagagtcagagtggtggggaggacaggggctgctgccgctccctggaaagccactgcagaggggcagtgctggmcagtgcagcctgggggaagtggaagcgtcctgtctgggggcagattcccaagcaagggtgacccatggttaagggccactggaaagctggagagagcttgggatcccttccacctgggggccaatggtg

SEQ ID NO: 14104 - DNA, 607 bp, Homo sapiens
taaattatttgttagttgacgatgcaatcagcatgctgattaaggttgcttggttttttactaaacattaactgaatgaaaacgggtagtccttgttctgcttggggggctttaaggaagcaaatggactttcagaacagagattgtcaataaagatccaatgtgataatttatgtkaaatctttctgcaaactmtacagtatgataaaaatataaggtagtttcactggaaacaacagaagactagaagctgatgtgacgtggcaatatcaaccaggaatacccatctcgagttctggatatgtgctctgagaaggtgcccatgtcaccgaccacactggaggccaatgcagatactgggggaaggttccatggtagctaagtgtggacaagctaatcactgaagttccctgatgcagagttgataatctctctagagttggatgaaagactgtgctgccttgaagctctgagagatgccatgccaattcaaggcagggtctttattgttgaaactcttgcgtaatgacatctttattcaggtgaaaatacaggatgaatttcaactatatgatattgtttatgtyctcagacatgttatttgtct

SEQ ID NO: 14105 - DNA, 69 bp, Homo sapiens
aaaaaaaaaaaaaaaaaaaaaaaaaaaaaaaaaaaaaaaaaaaaaaaaaaaaaaaaaaaaaaaaaaaaa

SEQ ID NO: 14106 - DNA, 429 bp, Homo sapiens
atcaccttttagagctagagaaccgtccaggtattaaatgtttggaatcttttatgatgtggattgtgctacaggggacactgagtaacgtggggaccaatgtccttcacagtttttgtagaaaaatttttaggtggtcttccatattcacccttagaagcaaggacaacccttcgagtgtaattccgtggagatgatttccttctgactcaaacacccatagcttccctgtctgtccatttcgtgagctcctcattaccttccatgactcacttttccatgtgacacggagcctccctggcttccactgctgatactgaccattcctttctttgttctctatgctgccgtggacacagagccaccatcgctgttaactgtactagagtctttacttttttttcttttgtgagcctaagccttcctcaa

SEQ ID NO: 14107 - DNA, 379 bp, Homo sapiens
attctcctgcctcagcctccggagtagctgggactacaggcgcccgccaccacgcccggctagttttgtttttgtatgtttagtagagacggggattcaccgtgttagccaagatggtctcgatctcctgacctcatgatccgcccgcctcggcctcccaaagtgctgggattacaggcgtgasaccgcgcctcgctgtccgcctcttgaagagtaaacgaggccgggcgcggtggtttagtaataccagctgtaatcccagctacttgggaggctgaggcagaagaatcgcttgaacccgggaggcggaggttgaggtgagaggagatcgcgccattgcactccagcctgggcaacaagggcgaagttctctcaaaaa

SEQ ID NO: 14108 - DNA, 488 bp, Homo sapiens
aaatctgtttgttataagattggaaacaatttttgagagggactaatttaaacaagtcctcctttagtcttttgggtcgcgtagttgctgaaacctaagtacctgcagcctacaggataaggaagttcacagcctgcggggtgaatgaacccatgtgtgaactgcacagagcaattcatagaaaatgcatagaaatttgtaacactttggtcacatctgtctctagatggtcattgaatttgtttaaagatggatgaaaggccaggcatggtggctcatgcctgtaatcccagcactttgggaggccgaggcaggtggatcacttgaggccaggagtttgaaaccagcctggccaacatggtgaaaacctgtctctactaaaaatacaaaaattagccgagcgtggtggtgcgtgcctgtagtcccagctacttaggaggctgaggcatgagaatcacttaaacctgagaggtggaggttgcagttga

SEQ ID NO: 14109 - DNA, 471 bp, Homo sapiens
cttagctccaagctaccactgcagatagaggttgtatgggataagtgagcaggggacaagggactacatgatagaaggggcctggaagccatccccaaggagtctgaacttttgtcagatcaagtcttgcccttgtctttgttagtgcaatttttttttcctgccaggaatgttcttcagtcatctggggtggggtgggcaaaggcatccttacctccctgaaccaccccatcctctgagcagggggagatgatcaatcggattgagaagaacatcctgagctcagcgactacgtggaacgtgggcaggagcacgtcaagacggccctggagaaccagaagaaggcgaggaagaagaaagtcttgattgccatctgtgtgtccatcaccgtcgtcctcctagcagtcatcattggcgtcacagtggttggataatgtcgcacattgttggcactaggagcaccaggaaccc

SEQ ID NO: 14110 - DNA, 171 bp, Homo sapiens
tacaaaaattagctgggtgtggtggcatgtgcttgtagtcccagctactcaggaggctgaggcaggagaattgcttgaacctgggaggtggaggttgcagtgagccgagatcgtgccactgcactccagcctggcgacagagcaagactccatctcaaaaaaaaaaaaaaa

SEQ ID NO: 14111 - DNA, 356 bp, Homo sapiens
ataaaggacacattagagcataccagagaaaaatcttacatgaaaacagtaaacagtaagaaatacatgaacaagattattccagagggtgatgggtgctgtacagaaaataaaccgagaaggtataaaagatattgactaaggataaattagattgtgtagaacaggagctctagaaagacctcaccaaggaagtaaccttggagcgagtgatgagacagcaggaaccaccacgccaataccttgggacaggacattccacagagatgcagagacaaggttggcttagccaggcatggaagaaaggccaggggcacaaagatttggtataagaagttccagaggaagacaaagac

SEQ ID NO: 14112 - DNA, 74 bp, Homo sapiens
aaaccctcagggacctggtatagacccagaatctgtttcacacaacaactgctatttgaaggaaaaaaaaaaaa

SEQ ID NO: 14113 - DNA, 481 bp, Homo sapiens
gcattttgatagtggctggagggcaggcagctcaacctctaaacccccctggtctgggcaccaagtcctgtcctgggcacgggacacagtcctccagcgagaccaaacccagcttctctacagcaccaggaagaaggcaagctgggccaccagggcgcggcccaggaaggaaaatcctccatggtcctgttgacagatgtggtatcaaatgaattgttctctgcttagacacgactttgatatttattggttcaaattgctcggctgactcagtcttgcggactctgattacactggacctatccaagatctgagatcatcaactcatctcaaaatccttaagctgaccacagcagcatcgtcccttttgcagtgtaagggagcccagctgggacaatgtgtgaatcaacgcatgaaggagtgagtgagcagctaaccaaatgaaagaatactcagatatctggggtacagttcccttcca

SEQ ID NO: 14114 - DNA, 443 bp, Homo sapiens
gtagaaaggggtgtgggggagatgatgtgggctctacctacaagatggggaggcatttctttatattatttgcaaaaaagcagggttgggaaataatattcagaactgagtattgcctctctgtcatacaattttctcacatgtgctgcggaagatgccttatttcgtgcatgcatgagcttcgaaggggcgcagaagctgtagatgaaaccaaacctaaggaaagtgcccggcaggacgagggtaaagaagaggaacctgaggctgaccaagaacatgcctgaactctaagaaatggctttccacatccccaccctcccctctcctgagcctgtctctccctaccctcttctcagctccactctgaagtcccttcctgtcctgctcacgtctgtgagtctgtcctttcccacccactagccctctttctctctgtgtggcaa

SEQ ID NO: 14115 - DNA, 259 bp, Homo sapiens
attctatttagaactttcatcaaaccaagaagatgccgtgattgtggagcaaccagaagtgattccattaacagaggaccaagaagaaaaagaaggtgaaaaagctccaggcgaggacacacctaggatgcctgggaaaagtgaaggctccagtgacctagaaaatactccaggtcctgatgttgaaatgaatagtcaggttgacaaggtaaatgacccaacagagagtcaacaagaagatcaactaatagcaggggca

SEQ ID NO: 14116 - DNA, 309 bp, Homo sapiens
  misc_feature 212,262: n=a, g, c or t
agttttagttccggcaatgagttgcgccggggcggsgcctccccgcctttgssttgcgccgggggcccggcggtccctctcagcttatggaagaagaaccagtgtcagatttcgcagttcaggaatgactttagacaatatcagtcgggcagctgtggatcgaataatccgggtggatcatgcaggcgaatatggagcaaaccgcatctatnccggccagatggctgtcctgggtcggaccagcgtcgggccagtcattcanaaaatgktgggatcaagaaaaggaccatttgaaaaagttcaatgagt

SEQ ID NO: 14117 - DNA, 483 bp, Homo sapiens
accgtctccatccctgcgccgggactggagaggcttactctctcctgctgatgctgcagctgctgggatgccaggaggggaacgcctgaggaaagtgctgagagaaaagagagggagggatacagaccgggcccagatgagtttgcgctgaatctgaagtcggtaggtccctggacatttctattatggaagccaagaagaacctcccctccaccctctgaagccagtgtggatcgggtttctggcacttgcagtgtctgcacggtctcctctccttccttctccattgccctttctcacccgcctgggcccgccaccctgaactaccgggacacatgctgttcctgcctccaggcgtgcacttcttcctgcagcctcctcccctactaactccttcttgaacttgatagctccattgtcactttcgagtcttccctaaaccactcccttcccaaataaaactgtttcatgtatttttctttc

SEQ ID NO: 14118 - DNA, 473 bp, Homo sapiens
tgaagaatgtatataggtaaaggggagtgtggtccagtggttccagaaaagggacagaactgtgttctgtctwaggcttgaccgctggctcgctgtgtggccttgggcaagtcacttaacctctctgtgcctcagtttccccatctgtaaaatggggataataatactgacctacctcacaggggtgttgtgaggctttaactaaatgttttgtaaagcgttttgagatacagaggcaaaggcgctagggaagggcaaagtattattggacttaaggaagctgaaatggtaccataaatgctgctattctgagagccattttaaactgcactgctccaaccacccccgcttctcatcaccaggacagcaggtcgagaaaatgtctttcctttcacttgcttctggggtttgtgattattcaagacaattttttccccttgctgtatctccttccctcacctcctcgacttgtt

SEQ ID NO: 14119 - DNA, 487 bp, Homo sapiens
tagacctgttctacctcctcaccaaatataatggcagacccatgtgtgtctggaatggccttgaattgctctttccttaaaatagctagctcttcaggagagtatctaaggcccactccatcttacctgaaccagttggtaagggtaaccatgacatagagtgaggcaaggaagaagacgaagtggaaggcagaatagttgtaggaaagatgctggacttggactggaggagctggaggggtttcttggtcagctggcctcgcagccccacccctttgccctggagagaggaaatggctgctgggagcagagctgctgaaacacctcttcccctctcccccaactacctttgttaaggctcttgagggttcttatggcactccacagagatctaccacttcttatggttcctcacttggcactcacctttgtctgcctccactgtttcagggcagcagaaacacagtgagggcttctgcaaaacaga

SEQ ID NO: 14120 - DNA, 430 bp, Homo sapiens
tcattcgattgctatttgagacttttaaattaaggtaaaggctgctggtgttggtacctgtggatttttctatactgatgttttcgttttgccaatataatgagtattacattggccttgggggacagaaaggaggaagttctgacttttcagggctaccttatttctactaaggacccagagcaggcctgtccatgccattccttcgcacagatgaaactgagctgggactggaaaggacagcccttgacctgggttctgggtataatttgcacttttgagactggtagctaaccatcttatgagtgccaatgtgtcatttagtaaaacttaaatagaaacaaggtccttcaaatgttcctttggccaaaagctgaagggagttactgagaaaatagttaacaattactgtcaggtgtcatcactgttc

SEQ ID NO: 14121 - DNA, 168 bp, Homo sapiens
acctagcgccacccgcttcgcttgcatcagctgcgcgccccatcccgaggaatggtaggggaagaaaaagctattgtttacaattatatcaccattaaggcaactgctacaccctgctttgtattctgggctaagattcattaaaaactagctgctcttaacttaaaa

SEQ ID NO: 14122 - DNA, 403 bp, Homo sapiens
aaatatataaataccacaatgaaaaggcactttggcttgaaaaacacctgaggtttgcttgtgggaagtaagtgtcattaggttacagcttgggagttatcaggaagtggtggaaggagggctgtctgaagtccaatggaaagttctgacatcaatgtgatgaatgtgattcataacacatgcagtgacctgatgaagctggtagatgtttaaggtgcctgtgtatgtgtgtgcacattttgtgcattcctgcatggctcatttcagccgaatatggttttctgcacttcctagtgtttttctcatgcataagcaaatgcaaaatttatgttatgctcagattgtttctggatgtatctgatgcatttgaacaaattcacattttcaaagtaagagttaaagc

SEQ ID NO: 14123 - DNA, 481 bp, Homo sapiens
tgattgcaaggaccaccttgtggatcaccttttcccagctggctagggctaggctggggtctctgcacacagcttttgcttagtgtttcctgggtcaggaacagagccaacaggatgaacgtgtgcaaaagccttggacttggctgtgatctttgactgctaggggagggaacctgggtatggtgagacggtgacgagagaaaagggtcacaaaggactggcctccctgatctctctcctcatggcagcgacccacctccagtcccctggacaatcgggtacaagagacttaaggttgggcatgggaagggtggggtttccatgatccattaaatgccttcctactcccattcatcgctctcaaaattagcttcagtgacaaagacttaaatctctctcctatctgcagcactgggttggagagagggcacgggagttggtcttggctgttcattgattgagactgtaggaactgtgttgg

SEQ ID NO: 14124 - DNA, 315 bp, Homo sapiens
attgtttgggatgctggggtgaggcccgcctggaccgcgcccctctcggaagtgtagccaggagtaggggtgtaggatgtgcagctgtgacccgtccctgtggactgaaggcagaggttccggcttctggcaataaagaaacaactcagactgtaaaaactctggagtttaatgtcaccgaacacattttgaaaagaactgccccaggcctggcgcagtgtctcactcctgtaatcccagcactttgggtggatcacgaggtcaggagatcgagaccatcctggctaacacggtgaaacccgtctctactaaaaa

SEQ ID NO: 14125 - DNA, 417 bp, Homo sapiens
  misc_feature 372: n=a, g, c or t
agagtttaattgatgtgaggctggccatgcatacaggagacggagttatgactcaaatcaatctccccaagcatttgggggctaggatttttcaaaggagcaggacccggcacacagagagatacactctgactctcgggagggagaggaagcagccggggaaagcaagtctaaagtcaacggtggattccagagagatggggacttggcctgacgtcaagcatgtgatggtcaggagttatggagcagctggcatctctatctgaccacacgcaaagcctcctggaaaacacgtggccatattggggttgataattcaggtagcagagttggcttccatgccagaagtgggagggacaaagaaaccacagnctcccacaaaaggaggaggagctttctctgaagtgctactgccca

SEQ ID NO: 14126 - DNA, 503 bp, Homo sapiens
  misc_feature 316: n=a, g, c or t
tttaaaataaacagggcaacataacagaaagtaatacagagactctactttggactgaagggataggaaatctcagtcttgctaacaaagtgacatctaggcttaaaacttaagcttagagctcaaggtttaaacagagaggatagaacaatgtactaggcagagaaaacataaaggtcccaagacaaaagatatagtcaaggtacagacaaaaaataccagggtgcctggagcagtgaaatggctcatggcatgcagtgatcaagaagccttttgggtactggttaagaatttggaattatattaaatgaaatgngtagtccatggaggatttccagcagtgtagtgtctgattcgactatgttttatttgcctgcgtaaatagacacagaaagaagggtatgaagaaagggcaaattggctgggcatggtggctcacacctgtaatcccagcactttggtgtttaaattccttggggaaggccgggcatggtacctcatgc

SEQ ID NO: 14127 - DNA, 493 bp, Homo sapiens
ttttgggagtaactatcttgtttttgattttagaggctcataggcagaaggtacttgccttgtctcagatgtgactttagactgtgaacttttgaattaatgccggaatgagttaagactgtggggtgactattgaaaaggcatgactgtattttaaaattgaaaagacataagatttgggaggggccaggggcagaataatatggtttgaatctctgtccctgtccaaatcttatgtcaaattgtaaaccacaatgttagagttgtggcctggtggaaggtgactggatcatgacggtggtttctaatggtttagtaccatcccccagggctgtttccattatagagttctcatgagatgtgtttgttaaaaagtatgtagctccttccccttcttcctcctgctccagttatgtaagatgatcctgcttctactttgccttccaccataattgtaagttttaggagacttccagaagctgaggaaatagcc

SEQ ID NO: 14128 - DNA, 182 bp, Homo sapiens
  misc_feature 116: n=a, g, c or t
ataatacagctaaacacacagccataaaaacaaagtgtggactcgtgccatttcccttggagcagagaaacctgaacgatcagggaggcattgtcctaggatagtaaagggaggangggggaggaaaaggtttcaggaggagacagactttcaaaaggaaacaagccataggccaaaatatg

SEQ ID NO: 14129 - DNA, 385 bp, Homo sapiens
  misc_feature 122: n=a, g, c or t
attgaaaatggatggtttgggtattaaaaagaaaaaaaaaacttaaaaaaaaaaagacactaasggcsaktgakttggattctcagggcagggtggsattttcccttragcaaagcagccanacgttgaactgtgtttcctttccctgggcgcagggtgsagggtgtcttccggatctggtgtgaccttggtccaggagttctatttgttcctggggagggaggttttttgtttgttttttgggtttttttggtgtctkgttttctttctcctccatgtgtcttggcaggcactcatttctgtggctgtcggcsagagggaatgttctggagctgccaaggagggaggagactcgggttggctaatccccggatraacggtgctc

SEQ ID NO: 14130 - DNA, 62 bp, Homo sapiens; identical to SEQ ID NO: 11091

SEQ ID NO: 14131 - DNA, 392 bp, Homo sapiens
attcggagggaagctgacatccacaccaagtcgagacttccagggatgtggccggggagcagtcacatgctgtagctttcatgagcacaggcatcagtcaggcagatgtttgtcgactggaatggcgccaaatcttaaaggcagaccacgcaaaaagaaaccatgcccacaaagaatagattcattcagtggtgttaaggattccaacaacaattccgatggcaaagcgttgccaaggtgaaatgtgaggccaggtcagccttgaccaagccgaagaataaccataactgtaaaaaagtctcaaatgaagaaaaaccaaaggttgccattggtgaagagtgcagggcagatgaacaagccttcttggtggcactttataaatacatgaaaga

SEQ ID NO: 14132 - DNA, 496 bp, Homo sapiens
gaaggatattataccttccattttctttactttaaagacaagatctttaatgttgccattccccgattccatatggcatgtccaacattcagggtgtctatagcccgattggtaagttaaattttcctctagtgctgatttacatgactttgtagggttaacactgcagataagccaggcaaatagttagtttataaatagtgttccagagaaccctagagattttgagaaagtatcttgggggtcatgtgaatttgttgagagaaatggacaagtaaatgaggctccatagtctctaaccagagaatttctgctgttttaaagattcaacttgtttttcactgttcagtggcctaaatgtagattatgagaaataccacattagaccagtagaatcagctttaagactgggaaaacaacttcttacagtgtttttgctcaaacttccaatttaatgtcaaataaacaaatattccataaagatcattataaagaa

SEQ ID NO: 14133 - DNA, 452 bp, Homo sapiens
cttattggaaacaaaagaataacttagaatacgtggagggatgaatacttttttttttctacctcttttatactaaaatastatgaatctcagttgggcatgagaggtagtgaattgaagagggtttgtgtccgagctctctggtcaaagcttggatttacttattctgtgctataaattaaaaggaaatacattctcttaattggtggtgaagagacttgctgaaagttgcccaatttgtaattaaactttggatctaatattctttttttcattttctatactttgatattagatagctgcttgtatgactatacatgatgaaataattggatacatgttaaaaatgaaaactaaactctgcataagtaaaattagtgaagaggcagaaggtaggggtggcctctatgaagcaggtatgagaaaagctccatgaagttatgattacattt

SEQ ID NO: 14134 - DNA, 480 bp, Homo sapiens
aaaccatggtgaacttgggtctgtcccgggtggacgacgccgtggctgccaagcacccggtgagwaggccggtctgggacgcgggcctcaaaccccagaagctgacctgagcgaggcgtggggccgggcgtgggggtgccctcgtcagggaagagtggcggaggctgggggcactctcttgctaaggggctcagggcgtccgggtgggcatagtgaggtgggacgtgtccaagcgcccagggtctcactcctccacagccagggtgtgcccagaggagggacaggagaggcggtgaaggaagagggcaggggatcgagccttcacccgcctttgccaccccagggactcggggagtatgccgcatgccagtcacgccttcatgaagggcgttttcaccttcgtcacaggcaccggcatggcctttggcttgcagatgttcattcagaggaagtttccataccctttgcagtggagcctcc

SEQ ID NO: 14135 - DNA, 449 bp, Homo sapiens
attacctcattgaatgacattaagcctataagattagggattattcccacttgatagatgaagaaaccctggtatagacaaataaattgtccaaaatcaaatagcaaataagtatgctattgtatgccatatcatctctcatgctcatattagcatttgggagaaacagtttatcgcaattacagcatgagsctgggtgcagtggctcacacctataatcccagcagtctgggaggccaaagcaggaggatcacttgagcccaggagttcaagaccagcctgggcaacatagggggactccatctctacaaaaactttttttaaaaaagaaattagtttggtgtggtagcatgcgcctgtggttctagctacttgggaagctacggtgggaggatcatttgaatccgggaggttgaggctgtggtgagccatggtcatgccattgcatt

SEQ ID NO: 14136 - DNA, 438 bp, Homo sapiens
tttgtatcaatttattaaaaaaatctctaatcctctgtaaattggtgaaacattatggactctggaaaacactacctacttggctaatttctttttcccctaatagtctactgcaatgtgatggccccttattaatttattaaccatgagagtcctattaaaggacagagtattatagctggaggggatcttagggattcctctagccccactttatagttaagcaaactgaggatcacaaaggcattgccctcacaatctcagggcagtggctgggaatggagctcagagatcttcactctagactcagaagacccttcaaggagaaccagtctaatgtgcttgaggggagaccatgggggctcctagggacctgcgaagagccagagtgggagatggtgagttgaggagaatgacacctcagcctccawcctccag

SEQ ID NO: 14137 - DNA, 181 bp, Homo sapiens
catgttctctttgctgctaaattaacttatcactgcattcatattaaatttccttgaggaatttccctttcactgtgtcatttttatatttttttattagtaccttttctctcaaaagctaattctctttgaaagcaatgtcttccagtccaggctcttcgtaattttttttttttttttg

SEQ ID NO: 14138 - DNA, 472 bp, Homo sapiens
  misc_feature 430: n=a, g, c or t
aaattatttcaatcattgtaagttaatttgtattctttctaaatatataggttgtaattaggggtgtattagtggtcctaaaccctggaccagcattggaaacatttctaatgtttaacacatttggagactctataactcactaggtgggaagtggggcttagaagcttgcttattaagaggcgggcatggtggcagtggttctcatcggtagacccagcattttgggaggtcgaggcgggctgatcacttgaggtcgggagttcgagaccagtctggccagcatggtgaaacctgtttctactaagaatacaaaaattaaggctgggcgcggtggctcatgcctgtggtcccagcacttcgggaggccgaggcgggtggatcatgaggtcaggagttcgagaccagcctggccaggagggtgaaactngtctctactaaaaatacaaaaattagcttcctgcagtggcgg

SEQ ID NO: 14139 - DNA, 444 bp, Homo sapiens
actttggtcgtgggcgcgtgtgtggaatgggaggaggtcgcgctgtccatgggcgtccttggcctgcgccacccagagatgataaatagccaaagacgtcaatggcacccatggacatagtaagcatagtaggagctgaaaaactagaagcaatgacaatgtcaactattttgagcaaaaagaagcagtgtcttcggaacatttgatcataaaaccagaaattaaaggatgagaaaaacatttttctgaagcttatactttcacatttcctagagagcatatttgtgtggatgggggtgggtaaacactcaacaaaagtttctttaaaaagaagaaaccatcctggtttgatgtaatcaatggttgcccactgctcccttcctgtgcctgtgacccttcccaaactgccctgttgcttgcaggctcgcctgagctgaaaggcag

SEQ ID NO: 14140 - DNA, 236 bp, Homo sapiens
ttaggcttttggtctagataacctctgtcgtagtgacacagtggtgccatcgtagcctaaaagcttatgtagacaatggataaatcaatggacctggttttattccagtaaaacttaatttatacagtcagagggccagatttggccttggtctatagttggccaaccctgtttagagcagtcaaaatttattccctggggctgggccaactttttcttraaaaaaaaaaaaaaaa

SEQ ID NO: 14141 - DNA, 478 bp, Homo sapiens
ttgggaatgccatggggtttgataatctgccagggacatgaagaggctcagcttcctggaccatgactttggctcagctgatcctgacatgggagaacaaccacatttttctttgtgtgtgcttctagcagctgttcgggaggaccgtgacccaacagtgttcccatgctgtttcttgtgaaatgctctcggctatgtagcagcttttgattccctgcataccctaggctgctgccctatcctgtcccttgtttataacattgagaggttttctagggcacatactgagtgagagcagtgttgagaagtcggggaaaatggtgactacttttagagcaaggctgggcatcagcacctgtccagctctacttgtgtgatgtttcaggaactcagcccctttttctgcctaggataaggagctgaaagattaacttggatcttctaatggtccaaatcttttgggtcacaataaagagtc

SEQ ID NO: 14142 - DNA, 52 bp, Homo sapiens
ttcagtgtgaggcgacaggctgaggccagggggacacagaggaatagacaca

SEQ ID NO: 14143 - DNA, 439 bp, Homo sapiens
  misc_feature 327: n=a, g, c or t
aaccatggtgaacttgggtctgtcccgggtggacgacgccgtggctgccaagcacccggcaccggcatggcctttggcttgcagatgttcattcagaggaagtttccataccctttgcagtggagcctcctagtggccgtggttgcaggctctgtggtcagctacggggtgacagagagtggagtcggagaaatgcaacaacctctggctcttcctggagaccgggcagctccccaaagacaggagcacagatcagagaagctaggagagctccagcaggggcacagaggattgggggcaggaggagtctggaacacagccttcatnscccctgaccccaggccgaccctccccacaccctagggtascccagtcgtatsctctgtccgcatgtgtggccaggcctgacaaacacctgcagatggctggtgcccaacct

SEQ ID NO: 14144 - DNA, 316 bp, Homo sapiens
gacggggccgggcgacctgggcaccacaggacccgaggccaggagccaggggcccagaagattgagcttctagagcctcagagatggaattcgccgttttgccgcgatttggcgttaacttattgacccatggggaggagggtcacttcccgtgaaaagaaggcagagatgttttgctgtgcccagtgtgaggaagcgaaggaaaagaaagatcttttgaaaatgtgtacatctacttgcagcttgaaaattccaagtgccagacatttttcttggaggaaataaatgtcttcaatttaaaaaaaaaaaaaaaaag

SEQ ID NO: 14145 - DNA, 509 bp, Homo sapiens
tttgctcatctgtcagcgtatttggtctttatctgactgcatactgcctatactactctctcctaccagaagctacagccactggtgacaggaacagagctctcatgagggtaaagtccctggctagtacagctacacaggtagctccctcgcagccaatgagctgagccatgtgatgtccaatttgaagtcagtcacagccaggcctatgctctcagccagcagtgccactcccatgggagacaggggtgctggggcaaggccagggctagggtcaggccaggcaggccccaggtaggacaagaccaggcccggctcaccttgttcatgccagacctcccaggcactgacctctaattcttaagaaagtgcctagtacagaccagcctggccaatatggtgaaacccgtctctactgaaaataaaaaaaattagctgggtacagtggcaggcacctgtaatcacagctacttgggagactgaggcaggagaatcactttgaacccggg

SEQ ID NO: 14146 - DNA, 497 bp, Homo sapiens
tgatgttctaattctgtgaattatcccaataatgtacttgtagcatgttttttttttcactccattccacgatccagtccaggatcacatgttttacatattgcatttaatgattatgtctcctcagcagggtgatcaagtcatcaattcagaataaccctgttttcccagaccttctccattttagcactgaaagtcctgcatcctgggaaactactcagtcctaggtgaatgggtgaagagttggttatgctactcttcagtctcctttaatctggaaccgttggctcagcctttcaatgttatgtcttttataacattgccatttttaaagaaatcaagtcagatactttattgaacatccctcaacttgatattacctgatattctcccaggttatgcatttctggttggaatactacattagtgattttgtgtcctttttgaagtatcacagctggaggcacagatgtccatctgtcctgcattgggtaacg

SEQ ID NO: 14147 - DNA, 67 bp, Homo sapiens
atatatacctaggagcaggattgttcgaccatatggtaatttctgtgtttatctttttttttttttt

SEQ ID NO: 14148 - DNA, 291 bp, Homo sapiens
  misc_feature 215,222,233: n=a, g, c or t
ccaaagatagtatttccaaactgttatatacccatctactcccaacatggatataagttttttaaaaaaatagttgtatataacatacatatctgccccagtgttacttcacaggcctatgccctacgggaactccactctcccagccccactttacccagstggttgggargaccagagcctgtctcarggaattgcctgctggggtgatgcanggaggangggaggtkcanggaagawgggccggcctcagctgtsaccagcacttttkaccaagtcctgctactccgg

SEQ ID NO: 14149 - DNA, 100 bp, Homo sapiens
tacttttagacttggggttctattttgctttaaaacatgtacatcagttttgttttttgttttgttcttttctttccttttttttttttttttttwaaag

SEQ ID NO: 14150 - DNA, 471 bp, Homo sapiens
aaaatttcgaaataaacagtttccttgcacggtttcttgttccctctgagtgcttgagcttctgctgccttccccttcatgctgctgctgctctgtttgctgttcatgacccttatcccttccatcgctgaaggtgagacctgcaaaggggttcttgccaggcccaggaagcataaccccagggactttaaattgaagtcctagggttactcagtatagggaggaaatgaggaccaaaatccaggcacaaactgttgaaggatgagtcttcagctcctttccaagtaggagtataatccagtggtttctgtctttgaaagttagactgctaccctgttcttcctgctgcctctacatttaccaactctggaagcaaggcttggcccaggctcctctgtgcattatgagggtttgggagtggggctgggctggcccagagttcctgggcatggagccacgtcataaagcttg

SEQ ID NO: 14151 - DNA, 456 bp, Homo sapiens
ttagggagtcccctcttaggacaggcactgcccagcatcaagggcagcagagttgggtgctaagatcctgaggagctcgaggtttcgagctggctttagacattggtgggaccaaggatgttttgcaggatgccctgatcctaagaagggggcctgggggtgcgtgcagcctgtcggggagaccccactctgacagtgggcacacgcagcctgcaaagcacagggccaccgccacaccccggcagaggggcacactctggagaccttgctggcagtgctagccaggaaacagagtgaccaagggacaagaagggacttgcctaaagccacccagcaactcagcagcagaaccaagatgggccccaggctcctccatatggcccagggcttaccaccctatcacacgtggccttgtctagacccagtcctgagcagggggagaggctcttgagacct

SEQ ID NO: 14152 - DNA, 406 bp, Homo sapiens
aatttctatgattcaacaccgccttcaccagctcctctatcaaaccttgagatggagtctcacgctgtcacccaggctggagtscagtsgcgcgatctcgactcactgcaagctccgcctcattcacatcattctcttgcctcagcctcccgagtagctgggactacaggcgcsccataccaggcccggctaattttttttttgtatttttagtacagacggggtttcgctgtgttagcsaggaaggtctggatctcctgacctcgtgatcagcgcgsatsagcttcccaaagtgctgggattamacgtgtgagccactgagcctggccaacatggcgaaaccccacctctactaaaaattaaaaaattgcccaggtgtggtggtgtgmacctgtaatcccaggct

SEQ ID NO: 14153 - DNA, 443 bp, Homo sapiens
ctaaaaatacaaaaattaactgggcatggtggtgcacgcctgtaatcccagctactcgggaggctgaggcacgagaatcgcttggacctgggaggcaaaggttgtagcgaggcggaggttgagtgagccaagatcgcaccactgcactccagcctgggcagcagagtgagactccgtctctaaataaataaataagagatgggaaaaacacacacacacgcgccactgtgttttggggccttctgcagcctcagtctcaaggggcctccttcggtcagcttggactggcttctggcctcagaaacctcagggcccatcaaagtccggaagcagcaatgggtaggtctgaccagggctgtggctgtaaactacactggaggagcctggccctcaggaagaccagagatgcagtctgcagcagtaggagaagggaggaaggaaaa

SEQ ID NO: 14154 - DNA, 328 bp, Homo sapiens
gttaaacaagggtaccacaatatcatttataattgatgtcaatattagtagtccactttatgcttaaaataaaatcataaaaaatcaagttttaaggttatattttttaaaataatgaattttctatctctaggcaacatgtctttattattcaagctgaatgtttaagagagattttggtcttaaaggcttcacatcatgaaagtgtacatgcatatgcaagtgtgaattacgtggtatggatgtttgcttgtttattaactaaagatgtacagcaaactgcccgtttagagtcctgttaatmttgatgtcctaacactgggtctgc

SEQ ID NO: 14155 - DNA, 267 bp, Homo sapiens
cataaagaagctctagttcttatagaaataacaaagcaaataaaagttcttaacaatcccctctttcgaagtgcatttttttaaagcagggcaggagacatttggactctagctatatgacatactgggaaaggcagagggtggagggaagatttcacttcattgtctagcccagaatcttgagcaacttgtaactaggtgtttatggaataaaggagaatggaaaaaagaaaaaaaaaaaaaaaaaaaaaaaaaaaaaaaaaaaaa

SEQ ID NO: 14156 - DNA, 333 bp, Homo sapiens
tttttttatgtctaagtagtagattatttgcatatttgtaaaaactgttaggtctttatattttaaagtgtaataccagttttgttattttagtagcagaaatgggatgattgttaaagttccccaaaaatgttggcatgaaattaatttttccctccttatagtcaaggaccgtagaggaagaaaaacttttttttcatatcatgcactatgtaaacagacacattttgctatctgtgtcatcaggatagtgtaagtggtagggtagagactaccctagacatctgcatctttgtaagttagccagacaataaagaaaagcagaatgaaaaa

SEQ ID NO: 14157 - DNA, 503 bp, Homo sapiens
aaatctggcatctttagaaatcttgctggtgctaaagagagaggaaataattttttatacagaaggcatgtctcaagtgaaaccaaaacaccaaagcacatdccttcagtgtatattcacatggggtaaatatgatgctgagtaatgtgcacaaaggaaactcttgacaaaaacacagtcatcttttgagtatgttaggtcatttgttatttcatttgaaaataacctggctggggcgtggtggctcacacctgtaatcacagcattttgggaggccaaggtgggtggatcacctgaggtcaggagttcagaccagcctgggcaatgtggtgaaacccatctctactaaaaatacaaaaattagctgggtgtggtggtgggtgcctgtaatcccagctacttgggaggccaaggcatgagaatcacttgaacctggcaggtggaagttgcagtgcactgagattgggccactgcagtccagcctggacgattgagttgagact

SEQ ID NO: 14158 - DNA, 460 bp, Homo sapiens
ttgtagatgctggtaggggctggggctaccttgtttttaacatgagacttaattactaactccaaggggagggttcccctgctccaacaccccgttcctgagttaaaagtctatttatttacttccttgttggagaagggcaggagagtacctgggaatcattacgatccctagcagctcatcctgccctttgaataccctcactttccaggcctggctcagaatctaacctatttattgactgtcctgagggccttgaaaacaggccgaacctggagggcctggatttctttttgggctggaatgctgccctgagggtggggctggctcttactcaggaaactgctgtgcccaacccatggacaggcccagctggggccacatgctgacacagactcactcagagacccttagacactggaccaggcctcctctcagccttctctttgtccagatttcc

SEQ ID NO: 14159 - DNA, 354 bp, Homo sapiens
  misc_feature 12: n=a, g, c or t
actggaggcttnggcccgccgaaagtgggcttctgggccatctcgcatattctcaacggctgtgcgtgtccttaaaagtccctgggaagcggccgggcgcgtggctcacccctgtaatcccagcagtttgggasgccgaggcgggtgcatcatctaaggtcaagagttcgagacaagtctggccaagatggtgaaaccccgtctctacgaaaaatacaaaaattagccgggcgtggttgctcatgcctgtaatctcagctactcgggaggctgagacaggagaattgcttgaacccgggaggcggaggttscagtgacccgagatctcgccaccgcactccagccagggcgaca

SEQ ID NO: 14160 - DNA, 147 bp, Homo sapiens
ctgatgccctggggatgagaacaactagcttggatctcgtgccgtgtaattcaatgtttcattccgctgcctccatcatgtaatagaatcgctttccagaaaggcagttaactggaagcagcagaggctcccagccgtgagaggact

SEQ ID NO: 14161 - DNA, 337 bp, Homo sapiens
tggtttcatgtcctagtaggaagtgcattctccatcctcatcctctgccctcccaggaagtcagtgattgtstttttgggcttcccctccaaaggaccttctgcagtggaagtgccacatccagttcttttcttttgttgctgctgtgtttagataattgaagagatctttgtgccacacaggatttttttttttttttaagaaaaacctatagatgaaaaattactaatgaaactgkgtgwacgkgtctgtgcgtgcaacataaaaatacagtagcacctaaggagcttgaatcttggttcctgtaaaatttcaaattgatgtggtattaataaaa

SEQ ID NO: 14162 - DNA, 69 bp, Homo sapiens
aaaaaaaaaaaaaasytysysggscsgtttttttttttttttttwwttttttttttttttttttttttt

SEQ ID NO: 14163 - DNA, 472 bp, Homo sapiens
  misc_feature 403: n=a, g, c or t
aagaattaagaagtgaaagatctctacaattaaaactaaaacattgaagaaagaaatcaaagagaacacagaaaaacagaaagatattcaatgtttacagattgaaagactcaattattgttaaaacatccatgctacccaaagcaatctgcagattcaatgcaatccctatcaaagtaacaataacattcttcatagaaatagaaaaataatcctaaaatttatatagaatcacaaagtcccagaatagccaaagaggatagcccacaaaagacctacaggctgggcgtggtggctcgtgcctgtaatcccagcacttttggaggctgaggtaggcagatcacttgaggtcaggagttcaagaccagcctggccgacatagtgaaaccccgtctctactaanaatacaaaaattagctgggcatgggggcacacacctgtaatcccagttactcgggaggctgtggcacaa

SEQ ID NO: 14164 - DNA, 461 bp, Homo sapiens
agtagattaattccatccatcacaggcaggctgagccttcttcccctctctggactgcctggccaaccccagagagaaggagcatcatggctcacctgggcctagtactggatctgggaacaatggataaagttcttgyttgggsmggatttaatgaatgaccttgagcagatgtgggtgcctaaatgctgtgaaatgaacatgtatttctgkcatatggggataaacatgtggacatgtatttaaggttttgtatctgtgcagcttctatgcacacaaacatcaaagtctattggatggatagccacggtggctcaagcctgtaatcccagcacttgggargccgargcgggargatcacttragcccaggagttcgggamcagctggggcaacatggtgacactgtctctacaaaraaataagaaattakccaggcacggtggtacatccctgtggtcc

SEQ ID NO: 14165 - DNA, 543 bp, Homo sapiens
tataatcccagcactttgggagtgtgaggtgggaggctcacttgagcccagtagtttgagactagtctagtcaacatagaccttgtttctaccaaaaatacaaaaattagccgggcatggtggtgcatgcctgtggtcctggctatttaggaggctgaggtggatcacttgagcctgggatgtctaggctataatgagctgtgatcatgccatcgcactccagcctgggcaacagaccaagacttggtctgaaaaaaacgaaaccatttgatgtcacatgtgaaaaaagacctacaagtgaagtaggtgggccaaaagacatgcacatttaaaaatgtgctaactatactagctaaaacctgtgcttaatatatgccagaaactgctctggtgctgttaatggagcctgctaaacaaaactgcttctcaacaatagaagttgtactacgctatggagtggacactccatagcaatgaaatgttttggagtgcctgtttcctcatctcagcaacataatagttctcaaacttcttagtctttgt

SEQ ID NO: 14166 - DNA, 424 bp, Homo sapiens
ccattagtttttttctagagcccacactggcccacatagctccatcccatacgggtagctggctccagctgcgccaaggtgcagacccgccctgggcatgctggcctgtgacggagcctgaggtcacagccccctgactagcctgagaccttcctaggggctgtggctgtttccggggaggccgggaggggcagctgtgagccctgtggaggacgttgggagtaacgctgctttgctttggcaggttgaaggggcccggccaggactcggggaagggtggcctgasarcagcgatgacctctggggtcactgtcccaggagggacttcacctggaacaagarctggaggcagccgcttgcccaggaggcttgtcccctgargcgcttcgccagtraagtrcgggctcagggcctcgagtctctc

SEQ ID NO: 14167 - DNA, 538 bp, Homo sapiens
aacaaaaaaacaaaaaaaaaaaaattagaaacgagactgcatactgtaacatacaacttttatgaaactctaaaatagtcaaaattaatttatggtgatagaagttagaaaagtgggccgggcacggtggctcatgcctgtaatcctagcactttgggaggctgaggcgggtggatcacttgaggccaggagttccagaccaacctggccaacatggtgaaaccttgtctctactaaaaaatacaaaaattagccgatcatggtggcaggcgcctgtaaccccagctactcaggacgctgagtcaggagaatcacttgaacctgggagggaggcagaggttgcagagagctgarattgcactccagcctgggcaacagagtgagactccatctcaaaaaaaaaaagttagaaaagtggttacctgtaggtaggcacagattggaggggcaagagggagacttctgaggtactggaaatattgtgtcttcttatctgggtcatagttatgtgaatctatccgtctatccatatgtaaaa

SEQ ID NO: 14168 - DNA, 372 bp, Homo sapiens
  misc_feature 92: n=a, g, c or t
tccttgaaaaccactctgatgtcacaactgagtgtctgttccgtttcagatacccagggctgctgcccagttctgtaaacgcagcccagmtnaagctctgctgtctcaagtgtgcatttatacccaggtgatttggacggagcagctaccatggcgtggacgccttcactgaactccgggctgcagtgcagggagctcagagcagtgctgctaccaaacagtatttaactttgaacaactgtgtcaggcaatggatttgaattttaagtgtattaatagctgtgctctgtgtcgtaggcaaaattccactgaaggagcctctgtgccctgcagccggcagcgcggctkaagcatgtgttggccaaggaatgc

SEQ ID NO: 14169 - DNA, 392 bp, Homo sapiens
catctagactttgagttccctgcatctgccaccgtagtttctagcaggagtagtggggggagtaatacagattcttccctagaaggggacactggtaacatgtcccactcttggattagcargggtgggtccaggaagatgatatttgcgtcttttgcccacccccctggcattcagctggacccaactaggscatcatgagtggcttctccctgtcatccccaggggtcataggatatctacaccgcctttctgaccccaccctgcactcccatcctttcctctctccccgttcatgccctgcactacatagcacagccgggatgcttggaacagaggscttggctgctccgcagtgcacagggcttccctctctcggggttggcttcttc

SEQ ID NO: 14170 - DNA, 347 bp, Homo sapiens
cttaactggaaagtgaccgtccactgccccatggagcccatctggacacagcacagccccaaaaccgttagcagctggctctgtttccaagcctggggaggggttcctcagtgcaggagttggggacaggctggggatccaagctgcttgarggggtcaaccttggaccaaagttgccttaagcctgtggtaaaarggcttcagggaaggtaagtgggccacctgccggaagctgccagctgcccggctggcaatggtgtkagtgtcttggccctgtccctgccctggggtccarcargtcatccctcccttcttctctctcctttggcgtttgttcctgtagtcac

SEQ ID NO: 14171 - DNA, 448 bp, Homo sapiens
atttcagagcgcacaagccatggtggccaaacagcggatccggatggctaacgagaagcacagcaaaaacatcacccagagggggaacgtagccaaaaccctgaggccgcaagaggagaaatatcctgtgggaccatggctgttggcactgtttgtttttgttgtctgtggctcagctatctttcagatcattcagagcataaggatgggcatgtgagaaagccagggatttgacaccacctccctcccactggaggcgggaggacaacggaagcggtcagccagtttctgcgggaaacaagcaggccacacggaatagaaaaaaacgctcccccacttgttccctgatcacttcatcgtggatgtcagaccaaattgccttctcacaggacatcttggtgcatccgcgttctcaagcggaaaggacattttgcttttctgttggcag

SEQ ID NO: 14172 - DNA, 106 bp, Homo sapiens
aaaaaaaagcaaaggagtctaaaaagcatgaaaagcttgagaaaccagagaaggagaagaammmaaagatgragaatgagaacgcagacaagttacttaagagtgw

SEQ ID NO: 14173 - DNA, 487 bp, Homo sapiens
cagaaggggacatcctcaccgctgagctgtgagctccctagaataaagatggaagctttctggtttcccattgaggctgaaasctctttcatagcaaggactatcctgtctctttctagtatgacatctggcccacagtagcccctcaagtggagatttgaatgaccaggtccacctaaaccagatggccctggcatctggagagttcgaggccattttagctggagagttcgagctggagagttcgaggccattttaggtaagctcaagtctttacaactctgcaccttctaccagtccttcctatctgtttcttttggatgaagatgattcttcttttcctaactctgaggttgccctctttcatgtgcattcacattaactgtcagccatacctgtgtacctcaacactcactggttgctgcctgtaatactcttacaaaagatttaatgaaagtgatggagaccttgggtgtctagcaactgc

SEQ ID NO: 14174 - DNA, 491 bp, Homo sapiens
tttcaagttttaagacttcgatccacccctatgagagcaagtaattgtggaaatatttttggtgtaaaatcattccagagtatgtaatatttaactgatagctgcatgaaagtgagattcgtgttactttggcttttctgtctctgttgacacggttgcacatttccaagttactacagcgtgaaaactgtgtgtttaaaaaaaaacaaaattaaaaaaagagattgtggcctggttttgtaaaagttttaggtaaaattacaattgattgttttaggaatcattattaaaaattttctgcaaatcataaagctatatcgaggtgttgagcttagccactatgcacattgtaattattcattgtggctgtccagttctatgatgcattctggcattttgtaagcwgctctgactagcaatatatagattcatttaatgtgttaacattggttaataaatgtatttaararrdacartgadraaaraaaaaa

SEQ ID NO: 14175 - DNA, 600 bp, Homo sapiens
cttgtatctatcaccagatgctcttgtatctagtacctgcttggcatacagtagatagaaagctttgctgagtgaatagctctgcctttcgtcttttttgatatgtgtacatcttttaaaaaataatgaatagactttgttttagagctgttttggtttacagcaaaactaagcagaaagaaaatatccccttccacaaacatcctggactgtacagcctcccctaccatcaacatcctgcattactgtggaatatttgtcacacctgataaaccaacatagattcatggttacaaaaatgaaccaatatggataaaacatatacattatcagccaaagtccggagtttgttaggttttgctctttgtgtatattcaagatacatttgacaaatgtatagagatgtacccaacactgtaacgtcagactccactgccctaaaaatcccttgtgcctcacctatccatccctccttccctgcaaatccctggcagccgctgatcttttttactatctccgtagtttttccttttccagaatgtcacatagttggaatcatgcattatgtagtcttctcagattggcttctttcacttagat

SEQ ID NO: 14176 - DNA, 77 bp, Homo sapiens
aaaaaaaaaaaaaaaaaaaaaaaaaaaaaaaaaaaaaaaaaaaaaaaaaaaaaaaaaaaargaaaaaaaaaaaaaaa

SEQ ID NO: 14177 - DNA, 529 bp, Homo sapiens
agtccatctcaaatcttcaccggctgtaccaagaacaaaaaaaaaaaaggaatttgagacgggatctcagcatgtttgccaggatggtctcagtctcttgacctcgtgatccgcctaccttggcctcccaaagtgttggaattacaggtgtgagccactgcgcccagccatcagaacaaaatatacagctggatgtttgtcacaattctaatgtccctgcaaagatgagatgcatgaatcacacagcaatctcatcaaaaagttgaggaagagaaagagtgctgccccacgctgcctgatttacaacgtgaagtgaaatctttgaaaagaaaaataagacaatgtcactcaagctcttatctgaggatttcctgggtttgaagacagagctcaaactcatacaaggggtcatctgagtctgcagataggcttgctttatgctgctccgtcagatctcttctaaagattagtgcgcaaattctggacattacattttaatggtaacatggattcaactaaagggtaagca

SEQ ID NO: 14178 - DNA, 564 bp, Homo sapiens
ataataataataaaaatactaagtatatttcttggtttctagggttaattttttttcatcttcctctcattaatttaccacttttatcactaagataccttaagtttctttattccttggattggtagtatagtgaaatgattagggcagggctttgaagccagagagtcctgggttcaaatcctggtgtggactctatctttttggggtaagaacctttaaattctctgactttctagtgtcttttaaatgggtgaaataacccttactttatggaatgttgcaaagatgagagaggatgtatgtaaaatgttaacctattacagagcttgatatggagtagacgaattctaaaattacattgagccattttgcctatagtggtgttagaatagaaaagtatactcatacattagaattgtgcacctagagctaagtgattccagccctgtggaacccgtcaatgccagaatggcatgtaggactagatagatgaatgtcacctgaccctgattgtctattaaaactcaatgtatggccagatgcagtggctcacgcctgtaa

SEQ ID NO: 14179 - DNA, 498 bp, Homo sapiens
tagaagaaaagctccatgacattcatctgggcaataattttttggatacaaatccaaaaacacaggcaacaaaaacaaacattgacaaatgggattacaccaaactaaaaatctcttgcacggccaagaacacaaacaacaaagtgaagagacaacctgtctgcaaatcatacatccgataaggggttaataaaaaaaaaaaaaaaaaaaaaagaaactcaactcagcaatgagaaaacaaagaactcaatttaaaaattggcaaaggatctgagtagacatttctccaaagaagacataaaaatwtccaacaggtatatgaaaaagtgccccaaatcaaaaatcacagtgrgatatcacctcacgcctgttagaatgactgttatcaaaaacacaaaagataacacgtgttggtgaggatktggagaaaaggaaacccttgcacattgttggtgggaatgtaaattrgtacagsccttgtgaaaaacagtatggaga

SEQ ID NO: 14180 - DNA, 301 bp, Homo sapiens
cctccctgctctccacctacccagctgtgttcattgagttacatttcagtattttgtggtttattttcatcaaggggtacacaagaagcagctttatgcaattaatttttttgttctgtttattgtagtcatcctcaaatgtcactgtgtaaagtgttgttgttgtttttaaattcaactgtcctgcagtaacataacatttgagaaacagagacaatgtaataagttttcataaagctaaattaatgtagagaaatttttatcatgaaatgctatcttttcaattgagggaaaaaaaaaa

SEQ ID NO: 14181 - DNA, 439 bp, Homo sapiens
caaaataagggcgttatttctactgagtggaagggctcagggtgcagtgttttggtgatatctaatgttttatcccctaagttttgtgagtcttgggcgtgatgtatccacacatagataggtcatcatgacactggaggacatcaaaggcagagaaacgtgtagagctgctagagagaaatgactggctaagcatgaagggatgataatttgacaacagatctctcattagtagcaatagatgccagaagagcttgtaatgcatctttgagctgctaaggggactgcactgtgacgtgcatgtggacaggctgcaccaggtccgggggtgcgatggccactgcagtgggttcctctccccaccccagaaaattcagttaccaaaactgactcaagaacagagaacagaatcagatcagtaacaatggaaggatctggg

SEQ ID NO: 14182 - DNA, 203 bp, Homo sapiens
agggaagagtcgcgcccccggggagggagcagcactggcccattctgcagatggggacatcgagtcacgggctggctacgaactcctcgggggcgaaggtggcggagagggatgggttccaggacgtcctggcgcccggggaaggctcggcgggacggatttgcggtgcgcascagtgccgttcgtccctcaggtgcttggcg

SEQ ID NO: 14183 - DNA, 436 bp, Homo sapiens
cgaaaatcatcacaggttatccattacgccgaccctggctgcagagggcctgccacaggcaccactcacaccacaagcagactggtacagtttcgggaatttctgtggactggttgtccagctgggggtaacttgaaaccagccccggtggagtattcacaccacgcgcatgtgcaaaacacgcaccccaggcttcccctcactaggtccggctgctaaacactgcgccasgcaccataggysagggactcagagcggcctgggagaggccggccctccaagggcgggagggcaggtggggtctgggccccgggtgggaaggctggcagcaggatgtaccctgcctgtgtcagtcactgctcccccaagaggacttgggagctaagcagggaggtggcctggctccagtcctgctgcatccccaggcctcagccct

SEQ ID NO: 14184 - DNA, 413 bp, Homo sapiens
aagtttttgtttctgggcggcgttcggtggtgtcccggtgcagccacgcgagagtagaagggtggaaaggggaggtgcccagtgaaatggagcctgtcccgtgcactttcgggcatttcgagcatcttgtgggctctcccaagtcgcggcccctcctctgagagccacagtcaggtctgtcctcaggggtcgaggcggctgcgctggggcctcggccgggaggaggcggggggcacggcctttccattttccctgctcccctctgcagaagcctcatagggcccggcgcggcggctcacgctgtcattcccagcgctttgggcggattgggtaggaggattacttgaggccaggagttcaagaccaggcagggcaacatagggagacccccccccaaccatctctaatggaaa

SEQ ID NO: 14185 - DNA, 483 bp, Homo sapiens
cattttgtaaataattgaatcaaataacaatggggcggggaagaagccatatatttttcctctctttttagaaatgaattgaaggccagacatgctggttcacatgtaatcccagcactttgagaggccaagcgggagaattgtttaagcccaagagtttgagaccagcctgtgcaacataggaaaaccctgtctctacaaaagaatttaaaaacagctgagtcagctgggcgccgtggctcacgcttgtaatcccagcactttcggaggctgaggtggatggatcataaggtcaggagttcgagaccagcctggccaacatggtgaaaccccgtctctgctaggaagacaaaaattagccaggagtggtggcggacgctgtagtcccagctactcaggaggatgaggcaggagatctgcttgaacccgggaggcggaggttgcagtgagtcgaatcgcaccagtacacttcagcctgggcga

SEQ ID NO: 14186 - DNA, 391 bp, Homo sapiens
tgtaagacctgcaaattcgttatttttcacaattgttttggccattttaggtcctttgcatttccacatacatttttagaatcaacttgtcaattttaacaacaacaacaacaacaacaaaactcctggaactttgactgggattgtattgaacttctagatcaatctggggagaactggcatcttaacagtaatgattcttccaatctatgaacacagtatatctctccaactttttaggtcttaattttgttaaattgtttgtagttttcagtgttctggtcttgtacctgttttgttaaatttaaaaaattcccactttgggaggctgaggcgggcagatcacgaggtcaggagttcgagactaggctggccaaaatggtgaagcccc

SEQ ID NO: 14187 - DNA, 468 bp, Homo sapiens
aataaaaagaagatggaatcctaatgcaatgtgtttgtttttgtggcttgtgctggagtgacaagaaaagttccttttgtttttgtataacagactctattactaaattggagagtcataagatgacttttgaaaaagctgtttacagatcagatttatagatattctgggcaaattagcctttggtgtgacttttgttaacttgaaagaactttcaggccaggtgtggtggctcatgcctataattctagcactttgggaggccagtgcaggaggattacttgagcccaggagttcaagaccaacctgggaaacatggcgaatctgtctctacaaaaaataaaaaaattagccaggcatggtagtatgtgcctgtgtcctagctactcaggaagctgaggtgggaggatcgctggagccccagaagttgaggctgcagtgagccgagattacaccactgcactccaa

SEQ ID NO: 14188 - DNA, 261 bp, Homo sapiens
cattgtcccagactcgaagccgaggctccactaatctctttagtaaattaacttcaaaactcacaaggaggcttccaactgaatatgagaggaacggggagatatgagggctcaagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataac

SEQ ID NO: 14189 - DNA, 74 bp, Homo sapiens
catccgatgagaaattacaaggcaggcaaagagtcaggaaaaaaataacccataacaagggggaaaaaaaaatc

SEQ ID NO: 14190 - DNA, 323 bp, Homo sapiens
atacaaaaattagssgggcgtggtggcggccgctgtaatcccagctacttgggaggctgaggcgtgagaatctcttgaacccaggagatggaggttgcagtgagcagagatcgtgccactgcactccagcctgggtaacagagggagactcctccgtctcaaaaaaataaataaataaacttgtgagctggccccaacccctcctaggaatcacagctccccgtactggtgcsgccgcagtggccaagttgcgacactgcccacggcccctccctctgatgcagattcagggcttctcttcgatcatgttgggttttgattct

SEQ ID NO: 14191 - DNA, 453 bp, Homo sapiens
accgacgaccccgacgtctgggtgcgcmgcggccctgcgcccgcgacgcccaccgcaagagatttgctctgtggccatcatctccggcgggcagggctaccgcaactttggcagcgctctgggcagcattgggaggcaggccccgtgtggggagacggacagcaccctcctcatctggcaggtgcccttgatgctatagcgcctcccctctcccctcagagggcacagctgcaggcctgaccaaggcacgcccggctctcgtgctctaggacctgcacgggacttgtggatgggcctggactctccagaaactacttgggccagagcaaaggaaaacctcttgttttaaaaaaatttttttcagagtgttttggggaggagttttagggcttggggagagggaggacacatctggaggaaatggccttctttttaaaagcaaaaaacacaaaa

SEQ ID NO: 14192 - DNA, 489 bp, Homo sapiens
acatgtttttcaagaagcctttattacataaaggggaatagaattaaaatgtttctttataagaaaaatatacatatttgtgttcttggccccattaaaactagtcagtagtcctttggcaaagatatagtcaacaagagaactgggtatgagtccaggcattactcctgttcatagttgtggatgcatgtgtctgagccagactgtctcaactggagtctcttgggttatagcagtaaacccgtgtattccatgaaaccactgggcccatcatcaaaaggtttccacttgtgtgccacagttgcttattactgagtttgggttccaagatgactggcaacttctgaaataatctcattgaaggaaagagtttcattttttttttaaaagagtttgctggaggaaaagaagcatgttaaatgtttttaagcagctaaaagtcctagatggaagcatatcaggatgtgtcggtgcttggctcttagtgaa

SEQ ID NO: 14193 - DNA, 441 bp, Homo sapiens
agatatcatgatcacagtgattcccgaagaaattgacccataggcagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcagcagaagctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgtagatagaagagccccacgggagccaggatgggactggtcgtgtttgtgcttttctccaa

SEQ ID NO: 14194 - DNA, 497 bp, Homo sapiens
gttgttgttgagctgcaagatgaagaggttgacsagcggggagagcaacccccggggcagctcagtgaccttgttgtggtccaggtagaggttgcttatggaaccacagagaacagtcccatgacattcgcgcacttccctcaggacactgtggagcagaaggcagaaagcgtgggcagaattatgcctcacacggagagatgtcgccacaatgaatgagcagggcttctgcaagatcgtgggccgctctaaggatatgatcatccggggtggtgagaacatctaccccgcagagctcgaggacttctttcacacacacccgaagtgcaggaagtgcaggtggtgggagtgaaggacgatcggatgggggaagagatttgtgcctgcattcggctgaaggacggggaggagaccacggtggaggagataaaagctttctgcaaagggaagatctctcacttcaagattccgaagtacatcgtgtttgtcacaaacta

SEQ ID NO: 14195 - DNA, 180 bp, Homo sapiens
tactgaaaaatagaaacttagccgggcatggtggcgcatgctgtaatctcagctactcaggacgctgaggcaggagaatcacttgaacccgggaggtggaggttgcggtgagccgagatcgtgccattgcactccatcctgtgcacaagagtgaaactccgtctcaaaaaaaaaaaaaaa

SEQ ID NO: 14196 - DNA, 452 bp, Homo sapiens
atttatttaattaagaggctataaataatatatacactactgtatggtatttaacaaataagttttaaatctgttaattcttctggaaaactttggatgtagggatggcaagctaattttcttgtatagctggtgatataagcagcatggtcataaaataasatttcttataaagamtaactggtaatagttgtgacagaacctggttttcctgactgagaatcccttscttgcttagaatatctgasttcccattgaaatggaacatagaaaatgtgttttcttatgtgactctcattattggttcstttatsttagttgtgctacaatataaggctggacctgtaatacactatgtatcagactagactgaaaaatgtgatcgatttgttttctaagtcctccatctatataactgaaccatggtcaggggattagagagcaacagagca

SEQ ID NO: 14197 - DNA, 474 bp, Homo sapiens
ttatcattttctttttcttttccccccacttattcctctacccccttgaagttagcttgcagccccaccactctgttgcaactactgctgtagttcctctgctctcccaattgccaaaccaagtagatatttttcagttcatttctcatcaagtttctctaagtcaattgccagtgwatccctctcaaaaacctttccatctttgcatgaggtcgtacactctttcttttcctttccccccacccttcctttgacctggggttcccaggatcccattctccattcctgctttcctcactctgtgtgtcttccaagactgacttgtgcattcttattttaattaccacctgtttgctgaaasccctaaatttatatagaaatccatcttaacctcttctgcaaagcttggaaaccccaatatttattggaaattcccaactgagtatcccatgggtttataaaattcttcatatc

SEQ ID NO: 14198 - DNA, 353 bp, Homo sapiens
tagacagatccccgttcctgacatcacagcagcctccaacacaaggctccaagacctaggctcatggacgagatgggaaggcacagggagaagggataaccctacacccagacccccctggacatgctgactgtcctctcccctccagcctttggccttggcttttstagcctatttacctgacaggctgagccactctcttccctttccccagcatcactccccaaggaagagccaatgttttccacccataatcctttctgccgacccctagttccctctgctcagccaagcttgttatcagctttcagggccatggttcacattagaataaaaggtagtaattagtaaaa

SEQ ID NO: 14199 - DNA, 444 bp, Homo sapiens
  misc_feature 324,392,430: n=a, g, c or t
ctgtttgtgggagaagtttccgattttacctgcagctgagtcaatttggagagccgagtgaaatacaggggtagaggaagcagcagaaaggtcctgggagctcactgggtccccaagcagcccattcctgcctggcaccacagggatccaacaggagaggagcagggggtaaaactccacagggagaaggaaatctctagctgaactctaacaatttgaacagggtgagaagcctcttggccagaactcgggggagggtgcaaatctggtgtgcagactccacaagtggtggaagaaccaagccctttcttttgcagctggtangtgggtagtctggggcaggttttcaagcctctgtggctctccacctggaaatggactgggggctgttnggggcagcacgttgggagtgagacagccctttggtttncgtgggagctgggt

SEQ ID NO: 14200 - DNA, 390 bp, Homo sapiens
tttaatattctgtttaggcccactaaggcaaaatagccccaaaacaagactgacaaaaatctgaaaaactaatgaggattattaagctaaaacctgggaaataggaggcttaaaattgactgccaggctgggtgcagtggctcacacctgtaatcccagcactttgggaggccaagrtgagcaagtcacttgaggtcgtgagttcgagaccagcctgagcaacatggcgaaaccccgtctctactaaaaatacaaaaatcacccgggtgtggtggcaggcacctgtagtcccagctacccgggaggctgaggcaggagaatcacttgaacctgggaggtggaggttgcggtgagctgagatcacaccactgtattccagcctgggtgact

SEQ ID NO: 14201 - DNA, 317 bp, Homo sapiens
  misc_feature 188,288: n=a, g, c or t
caggctttctgacttccatccccaaaacacatttaccagcatactccaaactgtttctgatgtgttccatgagaaaaggattgtttgctcaaaaagcttggaaaatactacacactccmtttctscttstggagatcaacccacattagagtgtctaaggactmctgagaattcctgtwwacagtaancaaaactaacgtaatctaccatttcctacactatttgagcatggaaatcatagtccccactctgtgagaaacttaacgctttttggagacatttctgtanatgtcagtttggagaaatgatgagctacg

SEQ ID NO: 14202 - DNA, 145 bp, Homo sapiens
  misc_feature 25: n=a, g, c or t
agcagtcctctctggggagcctgangcaaacatggatcaagaaactgtaggcaatgttgtcctgttggccatcgtcaccctcatcagcgtggtccagaatggattctttgcccataaagtggagcacgaaagcaggacccagaat

SEQ ID NO: 14203 - DNA, 275 bp, Homo sapiens
agagttgtaaggatggaaacaaacacttctgtttctgaaccagagtgggttctcagagtcttggctttctttctgcagcctgtmtgcctcctaagcagctgagattgtttccccactacagatgagtgataagctgactgcaccctcacggataattctatcaactcctgggaccatagcatagagggtgcttaagacatgctgcactggacgatgcacacaccccatctctccaacatgactaggccaccaggatgcatcasagtcctgacccc

SEQ ID NO: 14204 - DNA, 200 bp, Homo sapiens
  misc_feature 43: n=a, g, c or t
tttgcttgactgcttcctcctaaccctctasccactagcackntacttcctaaagctgttgtgtcattaactctgttggatcaactctctgggaaaagattctgttaatgtaagtgcacttactccctggatgttgtcactagtctagtggcttttgctaaataaacctttcttatttctagaaaaaaaaaaaaaaaaaa

SEQ ID NO: 14205 - DNA, 484 bp, Homo sapiens
tatgtttagatatgttaagatacacaaaacttaccattttgttgcagttgtctacagtattcagtacagtaatatgctgtacaggcttgtagcctaggatcaatagactctaccgtatagcctgagggtattgtaggctataccatccaggtttatgtaagtacactctatgattatgcaaccacaaaatcacctaagaatgcatttctcagaatgtatccccatcgttaagtaaggtatgtggaaatgaagagaggggcattttaggtagtgggaacagtctgagaaaaggcaaagatgtggaaaagcttaataatgacactttatggggaatggtaaatcatgctatagaaaagactctagtctctagacaaagtctagtttaccagtagtatcagagttaagagtttcctgttggggccgggtgcagtggctaatgcctgtaatcccagccttttgagaggctgwgacgggcggatcactt

SEQ ID NO: 14206 - DNA, 434 bp, Homo sapiens
  misc_feature 346: n=a, g, c or t
atagtaaagttaacaaagcacaggaagatgatttgaagtgggtagaagagaatgttccttcttctgtgacagatgtagcacttccagcccttctggattcagatgaggaacgaatgatcacacactttgaaaggtccaaaatggagtaaggaatgggaagatttgcagttaaagatggctaccatcagggaagagatcagcatctgtgtcagtcttctgtacggctccatgggattaaaggaagcaatgacatcctgatctgttccttgatctttgggcattggagttggcgagaggtgtcagaacaaagagaacatcttactgaaaacaagttcataagatgagnaaaatctacgagcttcttatttacaacactgctgmscccatttmcatcccagactctgacatggatgttcatgcaacttaagtgtgtt

SEQ ID NO: 14207 - DNA, 300 bp, Homo sapiens
atgagaagtttattctgagcaagctcagatatggaaccactgggaatttcctgatgtggaatcactgtggatttgctggtgatgggacttacttgactgggccaaaatgtgaggcatgcactgggaaactagcaggaaactagcacttgaaactcagcctgaagatgctgaaagacatgtatttccagcaccctttagaattgattgagaatagtttaattctctagtggtttaaagcagatacaaattacttaaggaacagctgcagttatgccctaaaaatttaattttttttttttt

SEQ ID NO: 14208 - DNA, 484 bp, Homo sapiens
aaatgatttgataacaggattctagcacaatcaaatgataatcttccgagcctcaatgtaaccattctaaatagatgatswtgttatatggctttcaattaacaagctgggaatcaaaaaagtaaatgaatcacactaatttgattccaaaccaatgtgagccccataataatttttaactagggcaatttcttaaaagtttcctcacacaatgacagcaaagtattttctcaattgtctaatatgatttggggatttgtatataaaatcacgaatgtgctcagaaactataaagacagttcatatgtatgtgacgaggaatgcaaggttttcggtaggtatacagtcacaagttaataattacctacctttctgtgtctgggccatttttggctataatcatctttaattttcctagtcctcccacaggtgctctgtctgtgcccgttgtaactgcaagaagagtcttttctgttcatctgta

SEQ ID NO: 14209 - DNA, 465 bp, Homo sapiens
  misc_feature 461: n=a, g, c or t
gcattgtataaaaacttctctagctgctgtgtcacaaagagactggaaaggggcaaggtgaaggaggagaccagcagagcagccacggccgggacagtgcagaggagggaagatgacacagctgtgagacattttggggaataggtccttctgtcacggggtacaggacccttgaccgcaaaatgacgtgagttaccactgaccattttctgggtcttgatcttgtgactccaaatggatggtacagcttgagcaaagacacagaagcagaaggcaggtttttggttccatgaactctacatctggctacatacaaatggtgaagaggaacagggagaaacatggttgaaaagaacaggcttggacttcaggaagcagtaaaatgagcgaatgccatttatggttacaaagataactcagctgggggccaaacagagactgaaatggagtgggtgargatngagg

SEQ ID NO: 14210 - DNA, 357 bp, Homo sapiens
agaccagagatctagcgactgaagcagcatggccaagccgtgtggggtgcgcctgagcggggaagcccgcaaacaggtggaggtcttcaggcagaatcttttccaggaggtcttcagtttcctcatttgcaagtcttggacccagtgatttccaaaggcccttccagttccatttgtcagacatctcattgagcatattctgtgattcccctcccttgcaatgtaacccacaggctgaggaattcctctacagattcttgccacagaaaatcatatacctgaatcagctcttgcaagaggactccctcaatgtggctgacttgacttccctccggccccactggacatccccatccc

SEQ ID NO: 14211 - DNA, 341 bp, Homo sapiens
acatgcattagaactaaataaaaatgtctatgagagggaaatgttttttataaagatgagattacacggctgggcatagtggttcatgcctgtaatcctagaactttgagaggccaaggcaggtggatcacctgaggtcaagagttcgagaccagcatgactaacatggtgaaaccccatctmtactaaaaatacaaaaattagccaggcatggtggcgcatgctgtaatcccagctacttgggaggctgaggcaggagaatcgcttgaacccaggaggtggaggttgcagtgagccaagatcatgccatcacactccagtctggtgacagagtgagactc

SEQ ID NO: 14212 - DNA, 106 bp, Homo sapiens
atttaaaaagaactctatttgtaaaaacatttatttactgcatggatattgacgcacattaaatttgtgggattttgtatatgtaaaaaaaaaaaaaaaaaaaaaa

SEQ ID NO: 14213 - DNA, 466 bp, Homo sapiens
ctgagaggttgacagtgtgtagatatacttaaagccactagacaggaagagatcactgatggtttcagcaaagatatgaaagagcagtgatctaagggcggagacctgagtcacctaagttttaagaaatgaggagagatgagaaggaaccagaaacagaaactaaaaaagaggagccagtgaggcaaagggagaaccaggagagtttgttgtcaaagaaactaacttaaatatttcaaagaaggaagaagtaagttatcaactgtgtcaaatgttactgataggtcaaataagatgaggattaataattgaccattgtagcctaggcaacatagtgagaccctgtgtctacaaaaaaatatatatattagctggatgtggtggtgcacacttgtggtcccggctacttgggaggctgaggtaggaggatctactcggagcctsggagattcgggctgcagtgagc

SEQ ID NO: 14214 - DNA, 327 bp, Homo sapiens
aatatatctgttattgcatttttatacattaaaagtggaatcatgggctgcgggtggtggctcatgcctgtaatatgaacactttgagaggccaaggtgggaggatcacttgagcccaggagttcgagaccggcctaagcagcatggggagaccctgtctctacaaaacatacaaaattaggtgggtrtggtggcatgcacctgtggtcccagctactggggaggctgaggtgagaggatcgcttgggcctgggaggtgaaggctgcagtgagctgtgattgtgccactgcactgcagcccagaggacaaagtgagaccctgtctct

SEQ ID NO: 14215 - DNA, 458 bp, Homo sapiens
ctacagcttgtaggtgccagagttggggtttggccacaagtaatgttattccaggaccagtgttttatagcacacctaataaggggtatttcaaagactatgctatatctccttaatcaagtccacatattattatgcactagccacacagctcagtgttatagtgggacacaaatcttggggcacacataagaataatctcttgtcctcaaaaattatatctagctttgagaagtagaaggaacacagtagtttcttgcccaaagagaattccagcagtgtttgatgacttccttccatttcatccccagcaaagtgatgcagatgactttctagagtgagtagctgcagtgtttagatagtcctctctaatcacagaatttctttgccatacttttcaccacttctcttaaataacatttggctgcagtttctagagcagttggcacttgaggatc

SEQ ID NO: 14216 - DNA, 494 bp, Homo sapiens
agccccccttttttttattgtacttgttacagatatcttttttcccctctgtagcttgtcttttccctgttagttgtgtcttttgataaataaattcttaattttaatgttgtaatgaaatttaatctttttttctgtatgattagtgctttctgtgagttatgacataaagtcataaagataatctctaatattatcttctaaaagttttattgctttgcctttcacatttagatttcttaagggctaaaattattagataactaggtattagttgattatatgtaattagtaaacaaatatttattgtgacttcagctatgtagaagagtcagtggtagatactaagagatgtaagacttggttcctgccctaaaataatcaacattctgtttgtgtaagtaaggcccttggcatcagcacgatgtaatagaaagaacactgactggactgggcctggtggctgatgcctgtaatcccaagcattttgggag

SEQ ID NO: 14217 - DNA, 466 bp, Homo sapiens
  misc_feature 187,373: n=a, g, c or t
aaatgcaaagattggcctggcgtggtggcgggcacctgtggtcccagctacgcaggaggctggggcaggagaattgcttggacccgggaggcggaggttgcagtgagccgagatcgcgccaatggcactccattcagcttgagtgacagaggtgagactcscatctcaaggtaaaaaaaaaaaatanaaatmagmaastgctatttgagtttasaggagtgagaagtcctctsttgmatggtgagatggggaacatttaattcaatagaaatatttgagaccgggtatggtggctmaggcctgtratcccggsgctttgggaggctragttgggtggatcacctgacatcaggagtttgagactagcctggcnmacatggcaataccctgtctcaaggatacagaawttgcccaggcttggtggtgtatgtctgtggtcccagctactsaggaggctcaggcggga

SEQ ID NO: 14218 - DNA, 462 bp, Homo sapiens
  misc_feature 122: n=a, g, c or t
aaaacattaccgaggtctcatctagttttctctactgccttccaaggtttctactgtacaatttctcattgaaaactgcctcagcattttttaagaagacatcacttcccccttgggaaganaagaactcaatgacttgaagaaactgatgcttcaggtacsttgaaaaattcagmtggttttgatgagaaacagtcaatggggctgttaggggtcctggcggatgcttaggcagtggctgtcctggattccagggaatgccccaaacccagtgatgcaggacccaggactccatctgctcattcttcataaggttggctcacaggtcatctgctgagaaggtcatcttctccgtcttcactgggctcactgaatgaggacattccaagatcccagctcatctcatttgagctttccttttcctaatcccatgcatctgtgtttgagaaaatcttcccaagt

SEQ ID NO: 14219 - DNA, 503 bp, Homo sapiens
  misc_feature 248: n=a, g, c or t
tagaaatgattaaggattccaaagagcttttgtttcagtaggttatacctatcaatatttatcacactaaaaataaaatttattaattcacttacaaaaaatctattacatgtaaggataagtaagatttttgtgaaaagtattaccccaaaaaaggaagagtagcattgttttcaatttacagatctctttaatgtctggcaaaatattaatagaagacagatgaattgtcataggtgtttctgctntaatctcttgtgctattttgttttggttgaagtatttgaagaaaatacagcctctgacagatacatgattaagacgagtacttaatagcatttttagatcattgagggtgttgtgctttaatataacacagctcaacaagtaataaattaacccttcttaaaagttagttgcgggccgggcacagtggctcacacctgtaatcccagcactttaggaggccgaggcaggtgtatcaagagatcaggagttcgagc

SEQ ID NO: 14220 - DNA, 460 bp, Homo sapiens
ctcctaagcaagtatctgttgagcagtctgtctgtctgaacctgtctcagtacctcattctcatctttggttatctttagcttaaacattatcttctttgctgagaacttctggttccagttattcctaaaacaaggaataagtgtcttcagtgtgattacttcagtgtcacagtatggtgcactttctggtaccagaatatgtttttgatacactagacttttagctctctttctttttttaggaagaggtacgtccacaggacactgtatcggtaattggtggagtagctggaggcagcaagcatggtaggaaagctgcttggaaattcataaaggacaactgggaagaactttataaccgataccagggaggattcttaatatccagactaataaaggtatgtgaaaaactttgagtagcttgctaatcatggatattatttagtgacatccatgat

SEQ ID NO: 14221 - DNA, 446 bp, Homo sapiens
ttacaaagcttgttgttgaatgttgaatatttgtccaaaggagtttgacaaaatagaagctgcttggtccctgttctgcctgctaggtcataaggatgaaggccatgtggctggggtacttatgtcaagtccagaatggggcagtgtccctctcctacstctctgcggagacgmaattgaaggtcaagtagactcagtgtagggcaggcagctgtcatgctgcaaagaagtttagaggagtctttgggttggggaggtgacaggtaggtaggacaggatctcttaagatgggaaagatactggggagaggagggctgcttggccccagggaactgcagtgaggtggaactgagctccgctcctgaatctccaaaggagcccatgctgcccggcttccctgagtcattttttccagcatcctgtcagatccctcaatgtactgattt

SEQ ID NO: 14222 - DNA, 370 bp, Homo sapiens
gaaacaaggccgggcacgtggctcacgcctgtgatcccgacactttgggaggccaaggcgggaggatcacttgaggccaggcgtctgggacgaccctgggcaacatggggagacccccgtctctacaaaaaaaattttaaaatttgccgcacatggtggcgtgtgcctgtggtcccagctgctagggaggctgacattggaggatcgcctgagcccaaggaggtcgaggctgcagtaagctatgagagctgtgatcgtgccactgcactccagcctgggcaacagagcgagaccctgtctggaaaaaaaaaaaggaaagaaggccgggcktggtggytcamacytgtaatcstagcaytttgggaggccg

SEQ ID NO: 14223 - DNA, 456 bp, Homo sapiens
gaatgtgctagaagtgctcctagtttcttgtaaaggaagccagagttgacagtacaaagggtcgtcggccagccctgcagcttcagcacctgccccacccagagtgggagtcaggtggagccacctgctgggctcccccagaactttgcacacatcttgctatgatattagccgatgtctwtagtgttgagcctctggattctggggtctgggccagtggcatagtgaagcctgggaatgagtgttactgcagcatctgggctgccagccacagggaagggccaagccccatgtagccccagtcatcctgcccagccctgcctcctggccatgccgggaggggtcggatcctctaggcatcgccttcacagccccctgccccctgscctctgtcctggctctgcacctggtatatgggtcatggaccaagatggggctttccctttgtagccatcc

SEQ ID NO: 14224 - DNA, 475 bp, Homo sapiens
tcttttcggctggaatggggaatttgtgaggtaggccggaagtggtgttgcggagggaagtgtggggagagcagaggcgcastctgctggagagacctgaggcttgcagcgctgggcccggccgggtcgctgcggctgggctggaggtcaaggatgcattccaggaaagttctataaaaatataccatcaactccaacctgatatttgacctagccatggaaaacctcattggctcctcactggatcagaccataaaaatgatccaggaatgaaaatctaagataaattcccrccacttcaagatgttcttatacaagtcaacagtctagcagatcagccagtctctttcatcatcaagcagacatactcaagaaagaggaatagtgaagtgaaatatacagaagcatgttcaagttcatctgttgaatctggaattgtgaatagtgacaatattgagaaaaatactgactccaa

SEQ ID NO: 14225 - DNA, 312 bp, Homo sapiens
  misc_feature 98: n=a, g, c or t
catataaaattarcatcaataacatcatagttaaaagggggctgggcacactggctcatgsactctgggaggsggtggcaggaggatagattgagcmnaggagtttgagacsagcstggscatcatagagagattctgtctctacaataaaaagaaaaattggctgaacatggtggwgtgsacctgtagtcccaaccacttaggaagctgaggtgggaggattgcttgagcctgggaggtcaagcctgcagtgagccgtgattataccactgcactccagcctgggcaagagggcaaggccgtctcaaaaaa

SEQ ID NO: 14226 - DNA, 457 bp, Homo sapiens
gttggaggaggcgcmstcaacagcccggccgaccgctcctcccagctcgctgcgcggaggaccccacagtccggcggccccgcagcscggctgcctagctcctccctggagaccgaagcccacaagagatgccagtatggggacaagatgtctggaactgtagcagctactttgtaaccaggagacatcaggaatgaagataacaagtcaatacatcaaggatggcagagcagaagaacagagggcatttttcagcagcagaaacagtaccagtgattgccttgtctggctggcttgtcatttgaggaaagacaactatttgtttaagcaatcagcccagttttctgttactggcaactaaaagcaattctaaatgacattgatatggaagggaggcagggaaatgctgggaggagaagggcaggtccctggcgagggttccacccccaggcctgtg

SEQ ID NO: 14227 - DNA, 457 bp, Homo sapiens
tcctctcctgaactcccatcctgtatctcaagccacctgctagcaaatatcacctacatgtcccatgtgattcaaaatcacacatctcatctcccattgcatctgcctacgtacaccacctcagcccaagccatttcctgttcagttctccaagcccacaaacctggcctctcctatgatgtcttctcaggcttatgataaggacacatcctaaggttagattttgctgacatttattaagcatacatcatgctccattaacaatgatcatcatattatgctgagagtctagaaaatgtgaagggctgtgaatttgtcctgatacgattctgcaagattgtttctctggctgtgctcagcagcctaaataagtaaaggagaagggaagatggattataagattgatccagagttgggagcaagctagataaatgcagtgggaggaatatgtgggatg

SEQ ID NO: 14228 - DNA, 354 bp, Homo sapiens
tcatcatgacgtcgtgtgcttctaaattaatcattttcgttgtagaaaaatggagtgaatttatattagtcttggaaactaataatagcattgtaaatttatgagatgattttaacagaaaaaatatagaagaatatagttattttaattgtaatattactaactgtagggtgaraaaaaggggggggggtcccattgtggtgaactatgttatagcttgttactcatagtttctttttgatcattttttcggtctccgaggtgaaatgacttattaattaaaatttgtaaactcacatatgcatattgtatatgtgtagaaatgtatcacactttgtcttggaattacattaa

SEQ ID NO: 14229 - DNA, 455 bp, Homo sapiens
gatgcaaaaattagcagggcgtgatggcaggtgcctgtggtctcagcctcctgaatagctggaactacagatatgcaatgcctttcaaaacgccaacattttgatactcattgcagggtgtcactcttccatagtcagggcatttgagaggaatgatttctttgacgctggcatcaccaagacccagctgttcctcagcgttcacgacgccgtgctgtttgccttgtcaaggaaggtcataggctcctctgagttaagcatcgatgaatccgagacagtgatacgggaaacctactcagaaacagacaagaatgacaattcaagatataaaatgagcagcagttttctaggaagccaaaaaaatgtaagtccaggcttcatcaagatccaacagcctgtagaagaggagtcggagttggatttggagctggaatcagaacaggagaatggcatga

SEQ ID NO: 14230 - DNA, 456 bp, Homo sapiens
tttttctttttttcttccagtaactgtaggacagtgatttagagattccttatagggtataacttttttgtattataaccacttcatcaatagatgtatctgttgatcgtacttttgatttataggggatagaattgggttagtgcttccattttctgtccaagtaaagaagctaggatatttatagagtacaaaaagaaattgaaacagctggtacagatatttggcattggagagcagctctgaacaaaggtgaattatagtctagtggtcaattttgtggcctattctttacaaagaattgaacctgatacagttaaccatctaccccaaactattatttgtttaaaacacaatctattggctgggcgtggtggctcatgcctgtaatcccagcacatcgggaggccgaggcgggtggatcacgaggtcctgagatcgagacaatcctagcca

SEQ ID NO: 14231 - DNA, 113 bp, Homo sapiens
agtacctggtgagcgtccctctgcgaatgttccgcctctggggttcacgggcatgatggctcagatcccactggcctggttcgtgggccgctttttccagggcaactatggca

SEQ ID NO: 14232 - DNA, 437 bp, Homo sapiens
cttttttcggctggaatggggaatttgtgaggtaggccggaagtggtgttgcggagggaagtgtggggagagcagaggcgcastctgctggagagacctgaggcttgcagcgctgggcccggccgggtcgctgcggctgggctggaggtcaaggatgcattccaggaaagttctataaaaatataccatcaactccaacctgatatttgacctagccatggaaaacctcattggctcctcactggatcagaccataaaaatgatccaggaatgaaaatctaagataaattcccaccacttcaagatgttcttatacaagtcaacagtctagcagatcagccagtctctttcatcatcaagcagacatactcaaggtaccaacacagcaaaggcacaaaatgtctctatatcagtatttttcatggtatatgtgagac

SEQ ID NO: 14233 - DNA, 413 bp, Homo sapiens
ccaaatgtctgagttaattcatctaggtactcccaaagtttatgtatttaaaagggacagtggtttctaatatactttctatttgaaaacatcaacaaataaaataattatttaaatatttttctttttaagaacatttgagagcttctaaatgtctagmgagggaaagtatatwatgattggtggagttaratttattatttatatgaataattctagctatgatgtgttatgtcattaaaaaatattggctcacgcttgtaatcccagcactttgggaggctgaggagggcagatcacgaggtcagtagatcgagactacggtgaaacccgtctctactaamrtacaaaabattagccgggcgtggtggcgggcgctgtagtcccagctactcgggaggctgaggcaagag

SEQ ID NO: 14234 - DNA, 338 bp, Homo sapiens
  misc_feature 276,278: n=a, g, c or t
taggaaaagtctatgtatggctggggggggtggggtggcttcagagagctgggggaccccttccccccaagtcccccctgcaggccaagatctttgctaaaggccattccctccgcaggcatttggcgtcgggtgggaggggaaaacgcatcttgttaattatttttaatcttatttattgtacatacctggggcaggggcttggggaggtggaggggggagaagggtcccctctctctgcccctcccactccttttctacggcgatttgtctgtntncccccasccactgcccatcccccattgttgtctggatgtggttctattttttatcggtct

SEQ ID NO: 14235 - DNA, 458 bp, Homo sapiens
tctgatactggacatgctagtaacttggagaggagaataaaagaatgtctcctggaattttacattcccattaatgtcctcattcaattggcagacctaggatgtatggttaactctcaggccattatgtttttcatggctcatttcccaaactgcattgttggtaggtgccttgctaagactgtaatgcagtgaagaagatggtggggcatttttagtaattggaactgtaacattaatttacaagattgaaccggggatgtctggatgctgacaagggagagccaagtactgttaatgccatcaatcctctaggaaggaattggtggtttttctgaagtgtgggggaaagggtggtttcttgctggatttcatggccagtaagtaaatttaaatgcttcatttttaatttggatgtttctgctagagacctttgatttggaaattagttattttgc

SEQ ID NO: 14236 - DNA, 407 bp, Homo sapiens
ccaagatgttttatcttttatgttaagagatcaaagcttataattttcttttttaatttttgaaggagggatcaactccagtttccaatgtctatgtgtctatgtgtgtatgtgccatacatatgtattcacatgaagaccggcatggccaagttctgctggaggagcactcaagtgtgacgaracagggccactggaccctgcaggctgtggtgtatatagtgcagctttggaggtggaactctattttcacacttttctatggagccttccgagtcccaggttttcacttgaggctgtctgtctggatggcggttttcagacctccattaacatccctacccagcattctgtacttcgggggccttctctcttgttataaaactttttaccaagtgaaacatcga

SEQ ID NO: 14237 - DNA, 470 bp, Homo sapiens
tgtcccttctagggttattgcatttggattggggtccctctaaaatttaatgcatgatagacacatatgagggggaatagtctagatggctcctctcagtactttggaggcccctatgtagtccgtgctgacagctgctcctagagggaggggcctaggcctcagccagagaagctataaattcctctttgctttgctttctgctcagcttctcctgtgtgattgacagctttgckctgaaggctcattttaatttattaattgctttgagcacaactttaagaggacataatggggtcctggccatcccacaagtggtggtaacctggtggttgctgttttcctcscttctgctactggcaaaaggatctttgtggccaaggagctgctatagcctggggtggggtcatgccctcctctcccattgtccctctgccccatcctccagcagggaaaatgcagcagggatg

SEQ ID NO: 14238 - DNA, 477 bp, Homo sapiens
atcacacaataaacgccagctgtggwggaacgtgcagaggcgctgcgcacgccaggcgtgtcgcgcgcttggcaaccctcgccgctcccgcagcgcagttaacgtggacaagctggggcaacctggacgagctggggcaacctgatctcggctgtcggagtgggtgtcctcaagaaaggtgacttgtcctcgcggacgccaggtgttgccccttagatacctgccacctcccagcctccgtttcctctctgggaaacagactcctcatcacctcctccagttttctgccccttcttcacctctcctgacgctccatccgtaccttttgcaagggaacgtgccataattcggctatgctctattttcttgtctaatagattgtaagctccttgcgggcagcatctatgccttcttaaatctgtttctagtttctaccagcaagcttgccccgargattttgcagaatatctgttaaat

SEQ ID NO: 14239 - DNA, 213 bp, Homo sapiens
taaatgcctaatacatttcagacatcatgccaggcacggggatgacagggcatggtggcgggcactgtggtcccagctacttgggaggctggggcgggagagttgcttgaacctggtaggcggagattgcagtgagccaggattgcgccactgcactccagcctgggcgacagagtgagactccgtctcagaaaaaaaaaaaaaaaaaaaaaa

SEQ ID NO: 14240 - DNA, 487 bp, Homo sapiens
cttttcggctggaatggggaatttgtgaggtcaaggatgcattccaggaaagttctataaaaatataccatcaactccaacctgatatttgacctagccatggaaaacctcattggctcctcactggatcagaccataaaaatgatccaggaatgaaaatctaagataaattcccaccacttcaagatgttcttatacaagtcaacagtctagcagatcagccagtctctttcatcatcaagcagacatactcaagaaagaggaatagtgaagtgaaatatacagaagcatgttcaagttcatctgttgaatctggaattgtgaatagtgacaatattgagaaaaatactgactccaatctgcaaacttcaacttcatttgagccacatttcaaaaagaaaaaaaagaaaaatttgaaacattaagggaaaacagttgggtaaaagatccatttgcttttcgaaaccctgaatcaataattgagcta

SEQ ID NO: 14241 - DNA, 464 bp, Homo sapiens
ccatagtcctcattgccactgctgctgtccagggtctgatttcactaccctgagtctcatttccttatctctcagtggaagataaagccactgcctagcacccaggattgttacagggatcagattagatgctcaggaagatgctcttgggacactgcaagggacaggattcttcagrsgtcgcttggaactgtggtgcctctgtgaggtggatgtcccaggcagagccagccagccagccctgacctgagctcgctgctgaccctgccacagattggctgtgtgtstctggacaggtggcttggccactctggacctctaccaaataaagagctggccggccaggcacagtggctcacacctgtaatcccagcactttgggaggccgaaggcggttggatcacaaggtcaggagattgagaccatcctggctaacacggtgaaacccatctctaccaaaaata

SEQ ID NO: 14242 - DNA, 454 bp, Homo sapiens
  misc_feature 275,406,409,415: n=a, g, c or t
atgttacactaagggaatcctgaggccctytgagtttatgctaggtactgaggagaatttccatcaaagtcacactaacagtaaawggaagaagaggwsagatgmagagaagcacagagrtgcacagcctgccaggctcaggaacagcagtacttactgaagcagragatagacgttggrmatcatcctctgtacargcagtaaggagccagccttgaagattttgcaggaagggatgagcagaggacagctggtgtcccctaaccacgcakgangtagaggtctaatctgggtccaggaactttgaaggatctctaaatttctttgagastcagattcctcatctgaaaaaraaattttgcaaaatgcttatrgattattattaattacatgtgataraattgtntgntartanttatgcacatatcaatattggttstgtataagtacacat

SEQ ID NO: 14243 - DNA, 474 bp, Homo sapiens
acacttttggagacggggtctcactgtcgcccaggctagggtgcagtggcatgatcatggctcactgcagcctcaatgtcccgggstcgggctgtcctstcgcctcagcccccctaggagctgggactacgggcgtgtgccaccacgcccagctgatttttttattttttattttgtaraggtctcactgtgttagccaggctggtctcgaactcctgggttcaggcggtcctcccaccgcagcctcccaaagtgatgggattacaggcctgagccaccatgccctgccttgcaggcactatttttgtctgcattttatagatgaagagactaaatctcaaagaggttaaataatttgcccttgatttgcscaagacsctatggctcttaggaggtagaacctggaatttttttcagaacgtattttatgagagtattttcaataccttattttatactgtagtctataggagg

SEQ ID NO: 14244 - DNA, 470 bp, Homo sapiens
  misc_feature 438: n=a, g, c or t
tataatacaggatgtaacaatgtcattctggcatttgttatgaatgcagcccatgggcgagggaaaatcacgggtcccgcaagcacactctgtaacaatgcctcttcccaggaggggccccccaccaggctgacgattgtcttcaggctccatcgatgttttccgttgtttaaagacacacattaacgtaaagtctcctcccattctctctgtaaattacagcattcagaagaagtggcagctgctgtaattaagacacagttaattgcctatctccttaattgcagtgataggattttgacagtttggtaaataagaattgtttggtttcctctggcaacttcagcctcagtcagttctctcctgcaagtgctgagtcacccagtctggggacaaagggctgtgttccaacggagacaggatggggcaggaactsanggtgagaggggggcagtgtttatgattcacct

SEQ ID NO: 14245 - DNA, 367 bp, Homo sapiens
tagaaaacatgaaattttccaaatatttccgatcagagaatcacaagagcagcaaatgtggtttcatcaagtgggaagaaagcagcaatttaaaataactttttgggagactgaattgagtaataataaaacttcagtctttcgctaataataataataataataataataasmacaacttattgaatgtggccagctcactagatgaggaaagaggaaggcattttctgcattcttgcctagttttccttataagcaccactaagttaatagctctgtctttttggtgtttgcactatgtaatgcttttaatactttttaattgtgcttttttatgtattaaatgtttttccttttaaaaaaaaaa

SEQ ID NO: 14246 - DNA, 81 bp, Homo sapiens
tgcagaaggagatatttatatataatagcagatattattagtgatttaaatgtgaataatgatgtttacctggatggaaag

SEQ ID NO: 14247 - DNA, 262 bp, Homo sapiens
agtctccctgcagcttcaagtggcataagagagggcccacagcctgattacaacttctgccacctagatcctgaatccatagatgccatctctgstccgaagtctgatgacaagaataatgatgatgactgatgatgacaaactgttctaaatgccttctgtgtattatctcawgcgatcctcagagcaaccctttgaaaaacattcagctctattcagtccttgctccttggctagcctacaatactacccaggtgttcag

SEQ ID NO: 14248 - DNA, 227 bp, Homo sapiens
atatcaataggaaaatggataatttatgatatattcacacaatatacatcataggctagtgaaattmtaaccacatgcaacaatatggatatatctttaaaatatttaatgaaaaagtatgcttggcgcggtastcacacctgtaatcccagcactttgggaggatgagggaggtggatcacctgaggtcatgagttcgagacaagagcgaaactgtctaaaaaaaa

SEQ ID NO: 14249 - DNA, 410 bp, Homo sapiens
  misc_feature 335,354,387: n=a, g, c or t
aataaaagcataccaggaaggcccctagtgaggggggaattttgtaaaagttttcagctgtaactctcatttgcacaattttctctatgtatttatatttcaatcaacatgatgcatgtgtattaaagccctgtgtaaatgcaacggtgcacacaggttcaaagcgcaggcaatatttatwgagcaactattatgttccatatgctgtgttaaacaccatgcatacactaagaagcagagggatgctgcccttgcccgggacgagttggcccttgtcagtcagggaaaggcagacaccaacagaacagcaataaaaaggccgggcaatgggccangcgcggtggctcatgcttntaatcccagccttttgggaggccgaggcgggtngatcactgaggtcgggagttcga

SEQ ID NO: 14250 - DNA, 502 bp, Homo sapiens
  misc_feature 491: n=a, g, c or t
agcccagccccgcctcttctccggcagatcgcggccgagcagtctgcccagagacttagcgacagacagacgctgggacccacgacgacagaaggcgccgatggccgcgctgctgagccctgcgcggggcagggggtctggaaccagacagagcctgaacctgccgccaccagcctgctgagcctgtgcttcctgagaacagcaggggtctgggtacccccatgtacctctgggtccttggtcccatctacctcctcttcatccaccaccatggccggggctacctccggatgtccccactcttcaaagccaagatggtagctgccatccctgggagcctggaaccaggcaatgttcgggggaggcaggggacaggctggaacctggtgaagtcttaaagtagactcctcctatcggggtgtagaagggaatctgttaatcaaacagagcaatattagaaaggctacagaggtcaactcagtggaacacgnttctcccaaac

SEQ ID NO: 14251 - DNA, 272 bp, Homo sapiens
acagatgactctcgttcgccctgaccggcttctcacagtgtctcaggccactgcgccaccgcgctggtgctgagcagaagcgggcagaagtggggtctgctttcaggacttcatttcccccactcgttccggccccgcattctccacgtctgccctttggtctgagttaaaactgcgatgctgaaaagtgcgagctctttccacgaggaggagccacacagggtggcctccgagggtgagtcgctctgctaagcaagggcagccgctgcacg

SEQ ID NO: 14252 - DNA, 462 bp, Homo sapiens
gctcaggagcactgtggtagagcactggccctgccttgagaagagacacaggtctcccgtccctgcaccagctgagagagacttgccgcaaagcacaaggctggcagagatttatgtatgacttgcacagacacaaaaatatacagacaatcaaaacattgatatattcaaactctcctttaaattccaatcttattgcaacaactctgtgaattgcaaggtcccagaatctgccttctcacatactctaccctcattcatccttttgggctaattgatgagcatcttatttcttatctctaaaaattatcagcaaaggctacttcagatggccactttagtcctttcagctgtagtcaggattatttaacttacctgtatatcaaaagtgaagaaaaagttagttcataagtaaaggcactaaatcctttcctgacaatggcagagtctctagrggtagaa

SEQ ID NO: 14253 - DNA, 431 bp, Homo sapiens
ctcctgamctcaggtgatctgcccgcctcggcctccccaagtgctgggattacaggcatgaaccattgtgcccagccaagagatggaatttaaaagcaaaatgcaggtatagtaggagcaaatggatgaaaatagatataccattcaagtaataagcctaagaaaactgctgtggctatcttaatatcatatgaggtggattttaaggtaaagaatattataagacatgaaaagggacctttgtagtgttaagagagttaattcatctggtagacataataatcataagatatatgtcctcaataatagagcttcaaaataaatgaagcaaaaatttacccagcactttgggaggccaaggtaggcggattcacctgaggtcaggagttcaagaccagcttagccaaaatggagaaacttgtctctactaa

SEQ ID NO: 14254 - DNA, 100 bp, Homo sapiens
acaaaaattagctggcsgtggtggtgggtgcctataatcccagctagttgggaggctgakgcaggagaattgcttgaacccgggasgdggagattrcagt

SEQ ID NO: 14255 - DNA, 391 bp, Homo sapiens
cagtattctgttattttttgcagtcgggagccgtgtggaagctagcccattacctaaattgagatgatagaatttgcctattgaaatctcaaggactggccaggtgcagtggctcacgcctgtaatcccagcactttgggaggccaaggcgggtggattgtctgagctcaggagttcgagaccagcctgggcaacacagtgaaaccccgtctctactgaaatacaaaacaaaacaaaaaattagccgggcttggtggcacgcacctgtaatcccagctactcgggaggctgaaacaggagaattgcttgaacccaggaggtggaggtggcagtgaactgagatcacaccactgcactccagcctgggtggcagagcaagactccatcacat

SEQ ID NO: 14256 - DNA, 288 bp, Homo sapiens
  misc_feature 187,271: n=a, g, c or t
gtatctagccatggctggcagaggtttctagggtgggtccccagccgtggcgtgaactgaggatgacccggggcagctggcaggagagagccttggcctgacctggcacagaaagggcagcttcagtctctgcagtgtccattrtctgctgttmcttcgagggttccaggctgtgtgtggggcccangcatgccccacccasccctcctgggsccaggcagcacctggrgcccacagagtctktgtgtagccaggwagccccgctcaggtngccaccgccggggcact

SEQ ID NO: 14257 - DNA, 171 bp, Homo sapiens
tattctctttaagagaaaagaactgttttatttgtctttgtattgtttgtggccccaggtatatcttgtgtttgataggatctcaataaagttctgtggaccaagtgaatgaataatacaaattctactgtacagaatagaatgactcacctagcaggggttttcgagttt

SEQ ID NO: 14258 - DNA, 364 bp, Homo sapiens
  misc_feature 7,313: n=a, g, c or t
tttgtanaaattggatattactaatatatttgacggtagaaactgtggagttataggaaattagaaaattaaaaataatcacaaccaaacgtgaatcttaactaagtataaaatagatgaattttgtagaggagtcccaccttattctgttgtatgttctaaaaggtttgtagatrtctatctgtggcgtaattgtaatctgaaactttgtgtttagtggcaagaaaagccgtcccacagcattaagagattctttaaaaaattawgacctctgccaggttcggtggctcatgcctgtagtcccagcactttnggaggccgaggtggacggattacttgagctcaggagtttcagaccagcctg

SEQ ID NO: 14259 - DNA, 436 bp, Homo sapiens
  misc_feature 150,430: n=a, g, c or t
cattcattgaatttagtctgttcattagctcattgtcattaactgctgtaggaattgatgaggattttctttttctatttgattaatttagtgctttgatgcaaacaactttccttctactagtatgaaaaagtggttggtctggaaccngtcaacatctgtacttcttaaaattatttttttaaaggttcatcatattattctttctgcctagtttatggttgctgaagttaagaaaactggaactaggtgtggtagctcatgcctgtaatcccagcactttgggaagccgaggcagggggtgttgcttgagttcagaagttcaagaccagtctgggaaacacagtgagacttcatctctactaaaaataaaaataaaaaataaaaattagccatgatggtgtgcacctgtagtcccagctacccaggnggctaa

SEQ ID NO: 14260 - DNA, 425 bp, Homo sapiens
  misc_feature 381: n=a, g, c or t
caatacasataatcttctgattttcaggggtacattcttctggcaaagctactataagttaaaatgasattagtcaaattttctgscagawgaagtcacaaaagaggattctttttgaagacctggtagtcagcctcttgtagataagaagacacttttagctgggtgcggtggctcatgcctataattccagcactttgggaggccgaggtgggaggatcatgaggtcaggagatccakgccatcctggctaacatggtgaaacccgtctctaccaaawctacaacaattagccaggcatggtggtgggcgcctgtggtcccagctactcgggaggctgaggcaggagaatggcgtgaacccaggadgtggagcttgcgntgagccgagatagtgccactgcactacagcttgggcgacagagc

SEQ ID NO: 14261 - DNA, 359 bp, Homo sapiens
  misc_feature 182: n=a, g, c or t
tttttattttttgagagggagtcttgctctgtcacccaggctggagtgcagtggtgcaatatcagctcactgcaacctccgactccctggttcaagcaattctcctgcctcagcctcctgagtagctgggattacaggcacacgccaccacaccctgccgaaaagagtgtttttagagagtngtcaattgtaatgaagctgccaggaggtcaagtaggtdgaggattgaaaatacccattagatttggagatgaagaggtttttggtgattttaatgagagttatycagaaatggggatggcarccacattggagttgcttgaagagtcagagtctaaatggacactgagtgtatttaa

SEQ ID NO: 14262 - DNA, 269 bp, Homo sapiens
  misc_feature 234,259: n=a, g, c or t
aaakgaaaaggaacaaggaagaaagtggaaccaattagcaagctaagggtcttgcggtgtcacccaggctgtcacaagagtgcagtggtgtgatcatagctcactgtggtctccaacttcagggctcaagcgatcttcttgcstctgcstcccaaaktactgggattactrgcgtgtrccaccgcacccagatgagactaacgttttaatgtcaaaaaacctataaaatatttngaaaaaaakcgtttaatctctaagngcsgctatgc

SEQ ID NO: 14263 - DNA, 138 bp, Homo sapiens
  misc_feature 19: n=a, g, c or t
ctccaactcccgacctcangtgatctgcccgcgttggcctcccaaagtgctgagattggccttcactcttgattttaactgacatgtcagttaaatgctactgcattccagcctgggtgacagagcaagagtctgtct

SEQ ID NO: 14264 - DNA, 491 bp, Homo sapiens
caggaaaggacgtgaagcagagaagggcagagggctggtgaggagggaagaggctttcattcattgcttcaaaagtatttattggggccaggtgcagtggcttatgcctgtggtcctagtgctttggggggccgaggtgggaggcttatttgaggccaggagttccagaccagcctgggcarcacagcgagacacccatctcaacaacaacaacaaaaaatttatttttaattagccgagcacacacctgtagtcccagctactaggaggccgggggggaaggatcgcttgagcccagcagttcagggctgcagtgagccatggtcatgccactgcgctccagcttgggtgacagagcaagaccccatttcttaacaacaacaaagggtcaggggcagtggttcattcctgtgatcgcagcactttgggaggctgaggtgggaggatctcttgagcccggaagttccagaccagcctggggtaacataggg

SEQ ID NO: 14265 - DNA, 345 bp, Homo sapiens
  misc_feature 17: n=a, g, c or t
agttctgagcagggcgngactcaggtgggcgggatgcgaagagctatggggaaggattcgaattccggtggatttaaatcgcgggaggagaagctaccgcggcctaaagaagacctctgttgaacacagactgcagttccagccaccacagctaatctggatcatgaatgggagccaccgtggtcttggcaagtccgaaaacatagctgagtagctcgtctagaaaagagatttgtgttcagctgagttaaaagaagtatttacctcaaacctctcctcttgcacaaccaacccccgttataaaaggaagtgcaaaatggaataaactgattttaagcaaaaaaa

SEQ ID NO: 14266 - DNA, 394 bp, Homo sapiens
cttcctctcctagcctaaggcgtgcaaacagagcgccactgggaggctgaaacctttaggccgatgcttgcttgcaaggtcaggcaagctggattctggtccccacctttgcagagagaacagcgatgttgtgcgcccatttctcagatcaaggaccggcccatcttactacctccaagagtgcttttctctctaataagaaaacatctactttgaaacatctactgggcgagaccaggagtgatggctcagcctgtaattctggaatttcgggaggccgaggcaggaagattccttgagcacaggagttccagaccagcctgggcaatgtagcaagacgctgtctctatttatacaataaaatttttttaaaaaaggaaaaaaaaaaaaaaaa

SEQ ID NO: 14267 - DNA, 467 bp, Homo sapiens
atagaaagatctccaagaggcattgctaaattattattaggggaaacaatacttgtatttgcttgtataatgcataaaatatttctggaaggatgtagcagaaattaactgctgctgtctaaggaggtggaggcatgaggtctgggtagctgtgggacgggaagaagaggaagattttwcactataattatctttttattgtgatattttaaaatatatattcctttaaaaatatgtattattgttgttacgttgtaaaagctctgcatttattttactgttactgaaatctcaatattatgtggccaggcatggtgactcacggctataatcccacactttgggaggacgaggcagatggatcacctcaggccaggaggttgagaccagcctggccaacatggtgaaaccccatctctactaaaaatgaacaaattagctgggcatggtagcacacgcctgtagtc

SEQ ID NO: 14268 - DNA, 295 bp, Homo sapiens
ccatgttggtccccttggccactgtctctgggcatgcaagccagtgtcctggttcagtgcctcggccagagctggggcaggagaggggcctctgggttagagctgggggtgtctctgcagggtactggcagccttgccacactgtcctcattcccagatggaaagacctgagtgcctctcgccattcctctgtgttagaattggctgaagtgtttttgtgcagctgacttttctgacccatgttcacgttgttcacatcccatgtagaaaaataaagatgccacggaggataaaa

SEQ ID NO: 14269 - DNA, 476 bp, Homo sapiens
awtattgtgattctgtttattcttccagaatgctgaastcsttrttascccttcagattgttaggagtggttctsatttgtgtctgccagaatactgggttctwagttgacaacctakaatgtcagatttctggttgatywgtaacacagtcattctaggatgtggagctactgatgaaatctgctagaaagttagggggttcttattttgcattccagaatcttgactttctgattggtgattcaaagtgttgtgttcctggctgatgatccagaacagtctcgtatcccaaatctgtcagcatctggctgtctagaatgtggatttgattcattttcctgttcagtgagatatcatagagacggagatcctaaggtccaacaagaatgcattccctraatctgtgcctgcactgwgagggcaaggaagtggggtgtwcttcttgggacccccactaagaccctggtctgaggat

SEQ ID NO: 14270 - DNA, 440 bp, Homo sapiens
gaaatgggctgtctttcttttcctttcatgtaatgtctgatttttatgtggaagagaatgtaagtagtgctgtataaccctgcggatgctatgccctacagggaaagcaaatatttgcaagtcagactgaaaaatgtccagaccctgtactgattaagtagaaggggaatctaaccacttwgcatttgaaagaaaatgcagcatatagcctgaggaagaacttgatcctgaagagacaacttcctccagcagctttataagtttatggaagacagaggtactccaatcaacaaaccacctgttttgggctataaagatctcaatctcttcaaactcttcagactggtttatcatcagggtggatgtgacaatgtatctctatggttttgaggagtactgccgttcggcaaatattcagttcagaactgttcatcaccatg

SEQ ID NO: 14271 - DNA, 467 bp, Homo sapiens
aggctgagctgaaggcacttagtgccacaaccgcaccaagaagcacgacctgctgaggctggcaaaggatgaggtgacccggcaggagctgaggcagcgggtgcgcatggctgacaacgaggtcatggacgcctttcgcaagatcatggctgcccggcagaagaagcggactcccaccaagaaagaaaaggaccaggsstggaagactctgaaggagcgtgagagcatcctgaacctgctggatgggtagccctcacccctgcctcaggcttattatctggcctaggggaggggaagggaggcccacttccttctttgggcacaggaaacattggcctgtggctgtccctcaaatggcggcagtctctagagggccgtggcctttcccctgagttcttttggcctagctctgtacaaccaggacacaggaagccctgcttggctagcctgaggcctagtctctgctt

SEQ ID NO: 14272 - DNA, 263 bp, Homo sapiens
atgaactgcttcaggtgggggagggaaacttatttttatttgcctgatttaagtgtctgagaaacaaatctttgttctcttaggactagcaatggaacaamtttaccagggttttgagcattacctttcctttcctttataaaacatgctcagcaaactgcaccagtkwaactacagtttggtaaattgttatgttaacaattatgacatctgcaatgttttataaagcaactaatttaataaaatcactgttgtgacggaaa

SEQ ID NO: 14273 - DNA, 62 bp, Homo sapiens
gatggaagctccggccgcggagtgatggtggcctcagcgaagatgggccgggcagggaccat

SEQ ID NO: 14274 - DNA, 278 bp, Homo sapiens
  misc_feature 21: n=a, g, c or t
aattaaaggacttggccaggngcagtggctcacgcctgtaatcccagcactttgggaggctgakgcgggcggatcacaaggtcaggagatcgagaccatcttggctaacatggtgaaacccgtctctactaaaaaatacaaaaaattggccgggcgtggtggcgggcgcctgtagtcccagctacttgggaggctgaggcaggagaatggcatgagcctgggaggcggasttgcagtgggccgggatagtctcgatctcctgacctcgtgatccgccc

SEQ ID NO: 14275 - DNA, 396 bp, Homo sapiens
tgattctgccagcggctcctaaaccgccttacagctgagttagaagatgaggagaggcagcagggatttccctgscttgggatgtgggaaacagaagaaaagttgagaaaatggttgggaatcgctgttagaactctagaaattctaatctgactttgsmactgtgcccagctcatggcccagagggtagagtgcctcctgtggaagtttaggggcaaatttgttccctgacctggagagggttagaaagaaccaacagctgcsccctccccgcccccgtgttgagacaggttctcaaggctcaggggaagatgcatacctcctatgtaagaatgctcttcscttgctgttattcatacacactttccacttcaaatatacccaaatatggctttc

SEQ ID NO: 14276 - DNA, 164 bp, Homo sapiens
aatacttttcctcagaggagcaggcaacagtgtgggataaacagagtcacgatcagaggaactccagggtctggtgatggcagggatggggggagagagagaaaatccacaaattccaatgtcacaaaagcaataaaacaaactagaaaaaaaaaaggttttac

SEQ ID NO: 14277 - DNA, 479 bp, Homo sapiens
cattgttcttcttggtggatctgtcaggtctttgtgtagctagcagaaaagtctcttccaagtcctatcgatctataaggacttttaattcaaaatgcttattatgccaaggagtcatattttggggtggaattccttgcactttttaaaatgcagattgctaagtgaaagaagctattctgaaaaagwatgatttctgtatgattccaaccatctgacaatgcaaaaagcaaaactatggagatggtagcttgccaaggattgcggggagggaggcgtgaagagttagagtatgggagacttttagggcagtgaaactacactgtaggatactgtaatggtggacaccattgtcaaaacccatagaactgtacaacataaagagtgaaccctaatgaactatggactgtcattactaataatgtatcaatattgatgtatcaattgtaacaaatgtcccacatgaatgccagatgtta

SEQ ID NO: 14278 - DNA, 523 bp, Homo sapiens
actttctttccctctccgttttggtgggctggttgaagatgaaatccactgaggagggaagtccagcaccctgtgtgccagtccagaactggcccatctgtagaccccctgaaaatcatatgggcttggatttggatattctcaacagaaagggttaaaggctgatggtacctaaagcctggtacttgaattttgatcaagataagctgccttaagttctcttcattacacaaatgatcctagataattgatagatcctgtggttcaactggatttctagatagaagctggattcatgtgatgccagaggagtaaaatttcaagagactgaaaccagatctgagtttcgctgttccagtctggacctctttggtgctgtaaatcctggatatactgtagatgagtactgcgtttttcttttatggcctctcttcagcttctggagacctcactatcctattatgtctttgtgtgaagacatgctgctttgtaattatcgaaagtgtcgcatcaaactctctgg

SEQ ID NO: 14279 - DNA, 458 bp, Homo sapiens
tggataggagcttccagatgggttttgttaggggtgggggagaatggctctggctacgacttgggacggaagtggcctgagaagagtcgagtgatatggcttgtagggtgaggcgtgggatccagagagaagcaccccaccacacacacccttccccactcccgtgatgaaacagctaggttaataggaggacagaaccaacgggtctgtgggactggcccacccctcttcccccttcccctgcgccctccctccctccacacctccacccgtcctggggtggttggaggcctggtctggagcccctatcctgcaccctctgctatgtctgtgatgtcagtagtgcctgtgatcgtgtgttgccattttgtctggctgtggccctccttctcccctccagacccctaccctttcccaaacccttcggtattgttcaaagaacccccctccccaaggaa

SEQ ID NO: 14280 - DNA, 316 bp, Homo sapiens
tatttttagtagagatggggtttcatcattttggacgggctggtctcggactcctgacctcgggcgatctgcccaccttggtttcccaaggtgctgggattacaggcgtgagcactgcgcctggcccaaaagacatgattttcaagagagggatggccccgatacccagcactgtggtccagtagcatggsctgtgtggttgaaactgacaatacagaagtaggcttgagggtgaggaaacagaggcgagccttcaactcccttcagggtttattattttcttgtgtttagcctcattaccagtggtgtgcaaaaa

SEQ ID NO: 14281 - DNA, 500 bp, Homo sapiens
  misc_feature 466: n=a, g, c or t
aagaaaaaccacgtatctagaaaatgctcctttaagccttttttgacgaggaggaggggtgcagacacttgcctgcggcaaagtgaacctggaaggagcggggcgtgtgtaggacagagcccaggagaacgggcagccgggtggccgggccaggaagcagggcctttctggccctttccgmagagggctggataatwgcctctcctttctaaaaggatccgttttctgggccgggagcggtggccctcgcccataggctcacgctcgtaattccagcaatttgggaggcccaggcaggcggatcatctgaggtcaggagttcgagaccagcctggccaacatggtgaaacccgtctgtactaaaaaaaatacaaaaattagctgggcgtggtggcgtgcgcmtgtgatcccagctactcaggaggttsaggcaggagaatcgcttgaacttgggaggtggaggttncagtgagccgagatcgcgccaccgcactccagcc

SEQ ID NO: 14282 - DNA, 398 bp, Homo sapiens
agtgctgagacctggctgctctattgtaagctttggaaacacaatttatgcaacagatgtccagatatgattctatttatggaaaaaagtttatatgtgttttacaaatggttttaccatcttatattaaaatgaccttttgacaggtgtgcactgttttgtctccagtgagcacataccatgcggattttatatgtacatcagtagtgtgaatccactggcacagtgtgtgtaaatgccagatgtggtgagattttatcttataaatgtgatcagataaaataactcctgacagaaactgtaaggaaaccagctgaatgtttgacctgatgactgatgttgtatggtttatgttaaatgtatattcttttaatcaatgaataaagcattaaaaatca

SEQ ID NO: 14283 - DNA, 267 bp, Homo sapiens
  misc_feature 5..7: n=a, g, c or t
aaaannnttcggttcctgggctgctgtctcatagacatcagcttgsagggaagctgggggctctccgaattgccctgctccggggcccctcctgstgcgtgactcacaggcacattgcagagagaagctgccgctcccagtaagtaatgaaaagagacatgaagaattggtattwmaaatgaccaccatgtwgcaaaaggcatagggatttccagctttacaacatgctatgaattatcctcctctgtgttaacacttgtgttaacc

SEQ ID NO: 14284 - DNA, 409 bp, Homo sapiens
agctgtcctgggggagcttgtttgcggcacggctgcystgccactgctgtgctgggggcccggtcgccaggcaaaaagccmtacccacgtttgaggggagtcatgagccgtttcctgaatgtgttaagaagttggstggttatggtgtccatcatagccatggggaacacgctgaagagsttccgagaccamaacttttctctatgaaaagctctacactggcaagccaaaccttgtgaatggcctccaagctcggacctttgggatctggacgctgctctcatcagtgattcgctgcctctgtgccattgacattcacaacaagacgctctatcacatcacactctggaccttcctccttgccctggggcatttcctctctgagttgtttgtctatggaactgcagct

SEQ ID NO: 14285 - DNA, 75 bp, Homo sapiens
aaaccctcagggacctggtatagacgcagaatctgtttcacacaacaactgctatttgaaggaaaaaaaaaaaaa

SEQ ID NO: 14286 - DNA, 157 bp, Homo sapiens
atcctggaatcttcgcttgtggagctgtggaggcaacggagtttttccgcgctttttctttcagcctcagagcctctcttcagcttctggagacctcactatcctattatgtctttgtgtgaagacatgctgctttgtaattatcgaaagtgtcgca

SEQ ID NO: 14287 - DNA, 165 bp, Homo sapiens
tcatctaaattgtgtgttctgtacatgtgatgtttgactgtaccattgactgttatggaagttcagcgttgtatgtctctctctacactgtggtgcacttaacttgtggaatttttatactaaaaatgtagaataaagactattttgaagatttgaaaaaaaaaa

SEQ ID NO: 14288 - DNA, 445 bp, Homo sapiens
ccttggaagcaagtggggtggcatgggagagaagggaggaggtgggcacaggtggtgagcttatgtgtgggcactctactgcctcacagaagccagccaagtkccaaggtcagcttggctggtctgaggccaccttcttagccaaaaacctagggttcattttcaggactttgataawgaacaacaaaatggggacttctttgggcagatgctaggtcagttgttttcacctaatatcctcttttagctgcatgtatatttatttataattataaccctggtggactgcagccttcatctttattgggaatgagtttgttataaatcagaaatgggtccatgatgaccactgttttccaaacccagtctgttccctgctccctcgctggcaagccccaccacacaggagtgaggccaggggctaggagttctaagaacagaggct

SEQ ID NO: 14289 - DNA, 434 bp, Homo sapiens
cctcagcctcccaaagtgctgggattacaggtgtgacctaccaggcctgctcctcaaatttcttaagtaaagttccttttgaccattttagatgatctcctaggggaatgaaggtttggggaaagagactgggaaggatttggcccattcctaggagagcctaactggagaggttratctgggaaacctggttgggtgtcttcagcttgataaaagcagggttttaggtagatttgcgtaacagagccagctgaattgagtgggagggagcagggcagaaaggaactgggatgtgagaggcaattctgagaggtccttccctgcaacggatgaggttgtttgagtttgagagaggctgagtttaggatagcgagtggtggagctgcaccttcgtatgtgatggtgccgtagcatgcatttgactaccatgaact

SEQ ID NO: 14290 - DNA, 391 bp, Homo sapiens
  misc_feature 203: n=a, g, c or t
tctgctttatttatatggctttctcacttttattttgtagcatgggttgcatcgacttttttactagagaattttactagatatttgtcattcaagttttcatctgctttataattgatacaccttgagggtcacttttctaatacttttactataatgtggtaccacctcagcsctaataaataatatttttacctaatgtnaaatctttttccagctaactaaaaactgtgtacaaaaggattgcttgtaaatatgcatgtaaatagttctgttaataacccactgttttacatttggtacatctgtgtctgctaatacagttagctttctcacttttctgcttgtttgttcagtctgaattaaaattagactttgaaaataaagccta

SEQ ID NO: 14291 - DNA, 339 bp, Homo sapiens
  misc_feature 330: n=a, g, c or t
aagagcccacataaaaaacgctctaaatcaagggagagacggaagtcaaggagtcgttcgcattcacgggacaagagaaaagacactcgagaaaagatcaaggaaaaggaaagagtgaaagagaaagacagggaaaaggagagagagagggaaaaggaacgtgaaaaagaaaaggaacggggtaaaaacaaagaccgggacaaggaacgggaaaaggaccgggaaataagacaaggaaaaggacagagagagagaacgggaaaaagagcatgagaaggwtcgagacaaagagaaggaaaaggaacaggacaaagaaaaggaacgagaaanagacagatc

SEQ ID NO: 14292 - DNA, 418 bp, Homo sapiens
acaataataacaaaatctgtggaaatggatataaatattcatgtcaattgtctcatatttgcgtgttgctttacacttcatacagcatttatatttcttatttaatcttggccacaacatgttcatctcatggattaaaatgagagacctggctgggcacagtggctcatgcttrtgatcccagcactttgggagactgtagcaggaatatcgattgagcccaggagttagagaccagtctgggcaacatagggagatcccgtgtctataaaataataataataaaaaattatctgggcatggtggtgcatgcctgtggtcccagctactcgggaggctgaggtgggagactcgcctgagcctgggaggtcgaggctgcagtgaaccatgattgtgccactgcactctagcctgggtg

SEQ ID NO: 14293 - DNA, 305 bp, Homo sapiens
gaggtgcccatgtgggtccgctgtgtcccctgtcatcatccttgtttttttctcattttggccaagggcaggctccctgggacagcagggaacaactgcggagatattagtgattcataggtttgtacagtgttttatactttgcaaagcactttattagctcacacctgtcamactcacatgaaactcgtgttaggccctgggaggccgacggtaactctcaccgtgccctcagatgaagcacagagaggttgttacttgcccgggccatccagtgggctgggctgggtcttgtgtccccatct

SEQ ID NO: 14294 - DNA, 491 bp, Homo sapiens
tttgttacagaaaatgttcaattaaaagtactttaaatacgtgtgacagaaactcacacatggagtctcaggagcccgacttctctttttaaaatgaaagagcctgggtgtgttggctcactcctgtaatcccaacgctttgggaggccaaggcaggaggatcacttgaggccaggataggtcaacatggtgtgagaccctgtctttaaaacaaggcagacacaactctgtgaatgtaaaatggttgcattgtacactttaagtgggttacttttattgtttgcaaattatagctctatgaagctgttataaaaactaaaaagaaattaaaaaaagatccttgaacttcttttagtgatacctaaaaatacacaggctgaatccaaacaagggtcgggggagtagtttctgacccacctgatgctaaacaatttttttcagtatttgttgcgatatttmatgtgagactttacatgccactgttgttggta

SEQ ID NO: 14295 - DNA, 433 bp, Homo sapiens
acaggacccccaccttcgctcctgggagccccgctgcaccccaggagttccattccagcctccccagtgcgagtgcggccgagcgctgacttttgggggctccctcccccgtctcactgggtccctctgcggctcccccgcccgctgtcccggttcagacgtggctgcaccccggaggggcgccggccgagacctgagacgtggcgctccctctctgccggcctcggcttcagtgcttgaatttcagccacatccctaagctgccatctcagaccagaggaacagggaggggggctttctggaaagaacatcacctggaagaaatcaggacatgactgtgggccatgagtgaccttcaaaggaaagccgggtatctgtggtctttaagatgtggtaagattgtattaaaattatagaaaaaaacctcgaaaaa

SEQ ID NO: 14296 - DNA, 356 bp, Homo sapiens
aaaatataatatgcattcattttacatttgccattatctgtcacagtgacttatcaggctgagccctgtctttgttcatataatccaaatgattgtagaataagatgtaaagaaaactaagtaggtagttttcttaaaagggtgtaatttagaatacagtgttcatctggtttcatctttcatgccttatcataaactttacatataataaaagctttatggctgggcacagtggctcatacctgtaatccgggcactttgggagaccaaggtgggagtatctcttgagcccaagagttaaagaccagcttgggcaacatagcgagtcgtctctacaaataatttttttttttttt

SEQ ID NO: 14297 - DNA, 445 bp, Homo sapiens
tttcctaatgacaaaatcttacaggcataaatatggaattactttgccgttggaatgcaggtgtttattttgttaattgtgtttaagagtttttagatattagatattagatttagatgttagtgtgtctataaaatgatggtgctaattaaagactttaacctggccgggcawggtggctcatgcctgtaatcccagcactttgggaggccgaggcgggtggatcacctgaggtcagaagttcaagaccagcctggtcaacatggtgaaactccgtctctactaaatatacaaaaattagccgggtgtggtggtgggtgcctgtaatcccagctactcgggaggctgaggcgggagagtcgcttgaacccgggaggcggaggttgcagtgagccgagatcctaccattgcaccacagcctgggcaacgagagcggaacttcgtt

SEQ ID NO: 14298 - DNA, 190 bp, Homo sapiens
aaaaaaattctccgcccctttcctcgatctcgctccccccttcggttctttcgaccggtcccccctcccttttttgttctgttttgttttgttttgctacgagtccacattcctgtttgtaatccttggttcgcccggttttctgttttcagtaaagtctcgttacgccaaaaaaaaaaaaaaaaaaaaa

SEQ ID NO: 14299 - DNA, 379 bp, Homo sapiens
aaaaacaattagaagaaaacacagaggaaacacatcatgatactggtataggcaaagattttttgcataagaccccaaaagtacagtcataaaggtgaacattgacaaatgggattacatcaaactaaaaatcttttgcacagcaaataaaacaatcaactactgaaggtgaaaatacaacctacaaaataggagaaaatatttgcaaactatgctctaacaagaagctaatattcagaatatataaagaactcaactcaatagcagaaaaacaatgtaatttaaaaatgggcacaggccaggcatggtggctcgcacctgtaatcccagcactttgggaggctgaggcgggtggatcacgaggtgaggagattgagac

SEQ ID NO: 14300 - DNA, 454 bp, Homo sapiens
  misc_feature 433: n=a, g, c or t
tttccatatgcactcatgtgtgtatgtgtgtagctttatgcaattttatcacatttataggtttacttacaacgagctgggcaaattgtgcaatttccttaagcccaatttataaaactagggtgtaaatactaacttcctcagaggagtgttgtgagaattagagataacgtgtataaagtgtgtagaggccgggcacggtggttcacgcctgtaatcccagcactttgggaggcagaagcggtggatcacctgaggtcaggagtttgagaccagcctggccaacatggtgaaaccccgtctctactaaaaatacaaaaactagctgggcctagtggcacatgcctgtagtctcagctaggcaggagaatcacttgagcccgagaggtggaggttgcagtgagccgagatcatgtcactgcactccagcctnggcaacaagagtgagactcaa

SEQ ID NO: 14301 - DNA, 363 bp, Homo sapiens
  misc_feature 196,233,338: n=a, g, c or t
caatagtagtttgttgtaatggtggcaarggaagccaggaggtagtgagacattgaatttagattgctttttaaagctttgagtagcagagagggtgaaagctagagaatttagttttgaggaargatttatcttggggttgaaagaaaaagtcagagccgggcacgtggctcactcctgtggtcccagcactttnggaggctgaggcgggcggatcatgaggtcgagagttngaggccagcccgaccaatatggtgaaacctgtctctactaaaaatacaaaaattagccgggtttcgtgasgcgtgcctgtrgtgccagctactttggaggctgangcgggasgatcacttgaacccggga

SEQ ID NO: 14302 - DNA, 456 bp, Homo sapiens
ttccctaacacttaccccatggctgcacagttggtggggtcctgccggagaggaagagacactcagaccagagaaggggtgtgcatgcgcctactcgcttgctagaagtagattctggacagtcagctcttcatctgcccaactgtgtagcatctgcattgcccagtctttcatgtgatgccaaggctgatgcaggatttgttctctgtccagcagtcacttcggccagagctgaagagttgccccgtctctgttccatgtctcctttaagagctctggtgataaggacatgatgcttttactgaactttcttatcctagcacatgcttcaatagttcaaggaacttaaaaaatacttttccttacctttaccccatccctgtctttactcctcacacttactgtaagacattataacataataaattaaaagtcacacgaatctcaccacataaa

SEQ ID NO: 14303 - DNA, 431 bp, Homo sapiens
tttgtagccaggaatctctagtgatattttgcttcgggcatcgtgggggaagaccataatcagctattttattcttgaaatttaggaaaaataattgctctatcttaaacagtgagaaaatattttttgaagtatggcagctttcccgaatccccactttatatcttcctatgtatctgaaatcttaggaccttcgatggttccggaatcgaatcaccctgcagcaatttattttagaaaataaggcaaaccggctgggcgcggtggttcatgcttgtaatcccagcactttgagaggccgaggcgggcggatcgcttgagctcaggagttcgagaccagcctgggcaacacagcgaaacctcgtctctattaaaaatacaaaagttagccaagtggcgcgcgcctgttgtcccagctgctcgggaagctg

SEQ ID NO: 14304 - DNA, 453 bp, Homo sapiens
atatctaccaaaggaaaatgagagttttcaaagccttataaatataattagctcagtgttctaaaagtaaaaatatacaggaaaagtacagaaaaaaagtaacaagtataaaaaaattttaaattattttaaaagtacaggaaaaatgtacccaaaaatatagaaaagaattgactgggaaagtgtgtaactatgcttacaaactacttcaagtagagagatcatcatgagtaattattttcctctgtattattttctactgtttcaaaagactcaatgcacatagatttatttttttaacttagaaaaatattgggttattgtgtaaataagtattaacaaatatctccattgtattactttttaaatgtctttcagggttaaaaatggtccttacacttttctttaaaaatcatttktcttacaagaatatagtggttctcaattgtgaga

SEQ ID NO: 14305 - DNA, 425 bp, Homo sapiens
gagggggtgagggatactgaggcccaggcatggagctgccggatccggtgcgccacggctgggaaacttcagccgggccgtgttcagtgattccaatcggaccggtccagagtccaatgagggtccggaaaatgaaatgtctccagtttggcactgcagatgtcactttatttwaatacctactatttcccactgtggtgggtgagcagcattatgatacttcacatgaagtattcaatcttgcctgactactacaaattcattgtgatcactgttatcatcctaataaccttaattgaagccatccggttgtatctgggctacgtgggtaacctacaggagaaggttcctgagttggctggcttttggcttttgagccttctattgcagttacctttaattcttttcktgctctttaatgaagg

SEQ ID NO: 14306 - DNA, 436 bp, Homo sapiens
aagaaatacataaatacattttgtaatgccatagctaccataggcagtgatgctccagtggatctgggcaaagtaaattgaaaaccttgtggagaggattcaccattccagatgtcatgaagaacactcatgaatcatgggagaaggtcagaatgttaacattaattaacagtggwwtggaagaagttgatttcaaccctcatggatgactttgaaggttttaagacttcagtgaaggaaataactcagatgtggcagaaacagcaaaaaatagtatcagaaatggagcctgaaaatgtggctgaagagctgcaatctcctcatcaaacttgaacagatgtggagctgcttcttaggggtgcgcagagaaagtggtctcttgagatggaatctactcctggtgaaaaggctatgaacactgttgaaatattggcaa

SEQ ID NO: 14307 - DNA, 405 bp, Homo sapiens
  misc_feature 147,367: n=a, g, c or t
cttaacccttcaattacgagcggscggcgctgcgtttccagggcagaggaaacgaggcgccgcgttggsttggacggcgggaacggctccggagcgagaacgcgcgtgagagagcccgagagagacggagagcgagcgagcgcgcgngagagactgagagcgggggggtgggagagagacttccagagagacagagcgagaggccgagacggaggctgtccctagcacaggccagggtgtcttgggactcgaatccctgggttgggctggccgggagtggggctttcgaaggaagcgggtgattttccacgtcgtccatatctccccggtgtgggaatggcggtcgtgcactctgggggtggcgttnttctcgttccctacttgggggtggcctttttcagcgga

SEQ ID NO: 14308 - DNA, 260 bp, Homo sapiens
ctaggtgttctaatcaatgtacaagactttaccatacacgcaactatagtttttctaaaccttcatcattttgtgattctttgagaaagggcttttaggaactttatgttctaaaaaatttttttaacaataataagataaaagaaaaacctgtgattcatatgtccccactggmattactcagcaggagcccccagctgccaaaggttggcagtgatcctgcaagttcaagggctctttctccctggggatgtcctttg

SEQ ID NO: 14309 - DNA, 477 bp, Homo sapiens
acctgcagaatcaaacattattacagtgggttgtggagtgccagatgacttatattcaccttaaagcttgagagtcagtgcttagctaagaggctctcagcccaggcttccagttggatcaaatggtcatattcagttactaccatcacctgtgccctccccatagcgtctgtctawtggtgtcgggggaaacatccatgctgtttcaattaactaccctgcccccaaggtgattctagggtgaggagaagtccagcatgagggcttccatatgcatttgtgaaggttgatggcagactgttccaaatgagaataatggtttccgtgatatgataaaagcaatgctattgaatatgatgatgactgatgagaagttttgcatagcattcgctgtaaaaaagccacttataggctgggcacggtggctcacgcctgtaattccagcattttcggagactgaggtgagcagatcacctg

SEQ ID NO: 14310 - DNA, 496 bp, Homo sapiens
caaatctgtgttattggaaatgtcttcaagtcattttgcattgtatttttgatatgagaggcagcttattgcgatgtgtatggccatgtttcattctcaaatttaattctataaatacaaatcctaaatacatggctacagcaactgcactggaacatttttgctatggttttagggattragaacttgccttgcaggtttccttcctcaaaaggagcagggcagtcctttccctgttgagtcaattagaatttttacatagaggtgagactgtgaattattttggttattttcagtgatgtagattagtgtgaatgaccagggtggaatgtttttgaaggaatataaagcaaaaactggttgacattcacaaactgttcttttgtgaacatattttggacccttaaatatgactaaaatcacagcaatattgttacatacgggttatatgccaactctgtttgaaatatactctggaraaacagctgaattgtct

SEQ ID NO: 14311 - DNA, 378 bp, Homo sapiens
gaaagatatcaactttcctagtttgcatttacactggctaataggataataaaatgctgtgtaaatgttaaactggaagtttctctgagttatttttastttaaaatttcatgtgattatgccattttgaatatgtatattacatgtaattgtataatgttaacatcgggtaggcaaaawtcttggtattaaatttaggatgttttaaaaattattaagaagatattaatgtctgctttttgatagcatatattttcatgtaatgtttagtgtattaaaatcaaccattcaagatttattttattgggtgacactattgactgtgttccaaaatgcccatagtgttaggaaatgtggtgtgagttttatttgtgggct

SEQ ID NO: 14312 - DNA, 409 bp, Homo sapiens
  misc_feature 370: n=a, g, c or t
acaggcatgtgtgctcaaagtacattgattgctcaaatataaggaaatggcccaatgaacgtggttgtgggaggggaaagaggaaacagagctagtcagatgtgaattgtatctgttgtaataaacatgttaaaacaaacaaaaattgttatttttcttttccttcggtcagtgcacattagcatttgaactacctggggattctttatcagaactgttcttgttgaatatttatacttaattgaaataattccttaagggaggttttgtttaaaacgtattaacaggaaattgtgtatgagatatttaatgaaataagaaattcaacmagaatgattaagtcacttcccaagtggttgtcatttgttanaccctggtttactgtcttgctattatgacatttcatttg

SEQ ID NO: 14313 - DNA, 442 bp, Homo sapiens
tattgattaccagacttttatgaaagccaaagactgcttgctagtaggaaaaaattwcaaataataaccaaagctgaaaaatggtctgtcataaattatttccccggtaatttttgaaaggaaaaatgtataacaagtactatttacatatctgcatttaaaaaagcaattcttagaatacttcctttacattattctcctattttagacattttgtgaaagagaacaaattgtccagtggcctcctgtcagatcaacaattattatactccttaattccatgcaaatttaaatgaatgctataaaattttaaatctgtagcctgggtgtacgtttcactcaagttctcctactgaggactcttgactaacagcatactggcagtttcaccttaacctgctcgttaaataatgtgttggtgtgagatatcaggaatgtctca

SEQ ID NO: 14314 - DNA, 459 bp, Homo sapiens
cacacgattgtccagtggtcagacagaccgggaacaatttgcccagcagggagcactgtggagccacacctctgagccatggtgattttcctgctgctttgaaggaagagcgagagggcaaattacctctttcccagaccccgcaccagctgttgtcttggtttccaagaagggaagcacaaccactttgtttacattccaagtgacctggagtaacaaccggggaccagttctctggaggccaaggctacacctgggacaactggctgaggttgaaagtgagttgacagmcgttgcsattcaccagcgggtcctgggtcctcgtcctcatccttgtstttgtcctcttggcttcccctgggagtcatcagcggggttcgaacaagatttgctggttccggagcttgggtatgttcagcctggttttttctgggttattgaaaaatgttttaaggtgaa

SEQ ID NO: 14315 - DNA, 66 bp, Homo sapiens
ttttttttacctcctgaatagtctggtctgctgctggccccaagcaggatgtggcgtgaggctgga

SEQ ID NO: 14316 - DNA, 371 bp, Homo sapiens
acagaacacatttggcacccacagcaacacaggcagaccacaaagtctccagaatgaggaaatgttggaagcaaataatatattcagctgagcattcttcctggcagtgggagcaggagcctgatttggaccttaaaagcttagtggcaacaacaaataagcatatggcctggaaaatcmacatcccaacaggctaaacaaggcagtcataatttatcgtgaggaagggctgatcaggaagtggacagaagcatctgtatggaagccacacctcagtccacaggctttttcaggtgactcacctatttccaagctacctagctctccctgctgattgtttcaagtgcaaataaacatgctgtatgatacaa

SEQ ID NO: 14317 - DNA, 458 bp, Homo sapiens
  misc_feature 404: n=a, g, c or t
attgaacccaaagtcggtggtatatgactcaccctccttccaagtctcctgcgcgcgtgtttttaaaataaactcacccgaaacgtccgtaacacacggacctccaggagcagtgagaggtggcttagaagcccctggtttggggtgggtggaggaggagggcacgtgtctgcctcccctaggggtgccctccttcccccatcccaagctgctgaggggaggcccttgtcatgcctcagttcctgccttcatctgctttccggagaaaaaccatatcaactcctagaaacgctccttaggggcttgggaccttccatttggcactgagcatcttgtggggccttaactggctgagacatcccggccctctacatttgccctgttggccaggcagtccccttccngcaattggagggcgacgctaacttcagaatccatagtggcgsttgccgcagtct

SEQ ID NO: 14318 - DNA, 429 bp, Homo sapiens
acctgtcatggctgcctaactgacaacctgtttcctgttaaccaactccttttccttacccctccctagttcctgcttttccacacatggttacctttcttgctatataaactcccaattttagtcagtcagggagaaggatttgagactgatctcctatcttggctatggcactcatttaaagtcttcttcgctggcaatactccttgactcagtgattggctttctgtgtgattaaaataacaagaatgagtctgggttccaaggtgatgacaagattaacacaagataattcaataaatacttgctgactgaaggaatagaagaataagtgcatgaatggtgaagagaaatggaaaagtcctctaagtatcagtgaaaaaaacacagggtttgtcatctactgccttcagaaataaacatggagts

SEQ ID NO: 14319 - DNA, 299 bp, Homo sapiens
ctttgacactggactaggatgcagcctcccttctgtgtccccttgagggtaccctgggtcccctcatcaggggcagaggcatgaaagagtcggggctggatggccaggggcttctgggcccgacgcctagtgcagcccctggggtcgtggtttgacatttgtctgcctggtagcaaacaaggaatccttgcctttaaggtgacaggccctccacaggcttccagacttgaaggaaaaggtttaagaaagaaaacaaaaccaacagttagtggagtcaaagcccagacactgtaaataga

SEQ ID NO: 14320 - DNA, 452 bp, Homo sapiens
  misc_feature 397: n=a, g, c or t
gacaggttgggagaatgaggtcagcggtgctggggaacagatggatggggcagtggggacagggcttgggcagacaccagcaggaataatttgaaatgtgtgaggtgactccscggagccttgggcttgggcatttgggaaaagaatgatgtctggaagggcttaagggacacagtggacgaggggagagtcctcatctgctggcattttgtggggtgttagtgccaaacttgaataggggctggggtgctgtcttccactgacacccaaatccagaatccctggtcttgagtccccagaactttgcctcttgactgtcccttctcttcctacctccatccatggaaaattagttattttctgatsctttcscmtgcctggtctagctcctctccanacagccatgccctccaaatgctagagacctgggccctgaamctgtagacagatgc

SEQ ID NO: 14321 - DNA, 235 bp, Homo sapiens
gaaaggattgtcgacactgtggaagagaaccccaacagagagaacaccatgaaagtgtggaaggattgcattattgaagatgccatcatcgttattaaaaactgtgaaaccatcaaacctgaaacaacaaatacccgctggagaaaactgttcagatgtgcatgacttcacaggatttatgacagagtcaatcaaagaaatcatgaaagagatgtggatatggaaaaaaaaaaaa

SEQ ID NO: 14322 - DNA, 156 bp, Homo sapiens
gggcgccatgttggagggttggtggtagcggcttggggaggtgctcgctctgtcggtcttgctctctcgsacgcttcccccggctcccttcttttcccccccccggtcgcctgcrtgccggagtgtgtgcgagggagggggagggagtcggggggg

SEQ ID NO: 14323 - DNA, 392 bp, Homo sapiens
ttgtaggcatgagctactgcacccggccagagtatcttaattttaatgaaatatactttatcaatcttttcctttatggttactgcttattgtgtcctgtttaagaaatcaatgcctggccgggtgcggtggctcatgcctgtagtcccagcactgtgggaggcctaggcgggtggatcatgaggtcasgagtatgagaccagcctggccaacatggtgggaccccgtctctactagaaatacagaaattggctggatgtggtggcgggcacctgtaatcccagctactcaggaggctgaggcaggagaattgcttgaacccaggaggcggaggttgcattgagccgagattacactactgtactccagcctggttgacagagcaagactct

SEQ ID NO: 14324 - DNA, 277 bp, Homo sapiens
tgtttgttttgcttctactaagactgttttgtttcaaaaaggaaacaagttttgtgtttgctgtctacgctggagtcctgaactgtgggtagaaaacacgacctggctttgtagaaaggacacagggctgttttatgaactaagcggtgaggctcaggtggsggctctcgcagagccmcctgatgctgttgttctttgagggcttaaggcctgatgaacgtaggcacgtgatgcataatagtcttcaatggtacacttaactagtctcttctgtgta

SEQ ID NO: 14325 - DNA, 420 bp, Homo sapiens
  misc_feature 379,394: n=a, g, c or t
tgttctggtgcgagcccaatgctgccagcctctcagaggctgtgcaggctgcgtgcatgcttcgctaccagaagtgtctggatgsccgttcccaggcctccacctcctgcctcccagsaccccctgctgagtctgtggcacggcgtgtagggtggactgtsmgcagggtgttcaatcgstgtggggctccctgaagcccaaacggctgggggcccataccccatgaagaagcccccaccttccctccacctgcttgtgttgggccccagggaactaaagggtgtgggtcagggaggggtctagaggctattcctaggcctcaggctcccaaatatgcccctccccagtagctacggttscctgcctaggagctgggganggagagatctaatcncttcaaggaagtgataacactggagt

SEQ ID NO: 14326 - DNA, 461 bp, Homo sapiens
tacttcttcactatagagcatttacttttagtctctagatgtatattttggaatgctatacttggcataacatagattaaaatcataatgcatgactaaaaactccttggatttatttcccattttaaaatttttagcggtaagttcagatttataatctttctctagacttcacatggtctgaatgttgsctgctgaagtagcaacctaaaaagtatcccctgcttatgcttctccagttggccctccatgtccataggcttcgcatctgtgattcagcccactgtgggtcaaaaatatttggggaaaaaaatggatggttgcgcctttgctgaacatgtacaaacttttttttgtcattaaacaatatagtataacaactatttacaaagcatttacattgtattagctattataggtaatctagagatgatttaaagtgtatggtaggatgtgcacag

SEQ ID NO: 14327 - DNA, 452 bp, Homo sapiens
  misc_feature 389: n=a, g, c or t
ttaaaacttttggctcatcttaccagattttttacaaagatgcagatgttccttaaaagtggctgaaagattaggagttccttaaaagtggctgaaagattagggactttrtgcctgatgtgctggaatatgcccgagttctgttaaatctgatttaassatattaaatcaaawamttttctgatgtattcttatgccctcattttcatgtaatgttactactatgaagaagtgtaattaagamwtttgatatgagccttcacagtctaaagagtgcttcagtgacaacagttttattagattatggtgatgggcctggctgtgaaattcccacattcatgaacgactctgctttttactggctaaaaacaggattttaaatgcaatrncctttgggactctcagataagttgcctcttcaaccctgaggttatttgatgattgctggggac

SEQ ID NO: 14328 - DNA, 423 bp, Homo sapiens
aggaactattcagtaaaatacttttaaaaagcctcaggcaagaacatgattttccagattaggagaagggacaacatggcagagattcctgtaagtcttgggttatttctgagtgctggttatcgtggcatctgaaaatgtaaataagtgatgtaccctgtgggtarctctgctarsaggcaccccggggacctgctggtgamcctgsccttstcstgctgcgaacatcccaggccagcgtgacactcacagcagcgtggacgtctctctgcaaacgcccaaatgcagtgtatgaaatgtcatccctagaaatggcttcatttgggataaagctttgaacttgcgtgcgtgccccgcaccccgtggcggactgagtcactgctttgctgttgcggcgtggtgagtaaaactttctcaggggag

SEQ ID NO: 14329 - DNA, 218 bp, Homo sapiens
tggaggatagcatagttggagatttcaacaccactctctaaataattggtagaataagtaaaacacaaatcagtaattaacccagttaacacttaaccactccaacaacagcatgwtacacattctttactggtattcatagaatgtttactaaaatagaccatatcttgggccataagataagtttcaataaatttagaattttttttttttttttt

SEQ ID NO: 14330 - DNA, 375 bp, Homo sapiens
gacgccaggggatgcaaacccttctgcccctttttgctacccctgaagcttactgttagtggtcgagtttttctggaagtgggcttccgcgatcgcgggaccaacgccctgagctcttgtgcccaaaggggatcgccaggttttttgatgcggatcgaaagggactggccccggagcctacaacctgacgcaggtgggacttggggaaatgtcgagaaacctaggtctgggacttgagttggcttccagggcacacattcttgttcagaagaaacacattgcaaaaatcgggaggtgacgggcagatgaagtgtcggcgcttcgctcgggactccagtgcaacctatggggcttttggaaatgaggaagtcgatg

SEQ ID NO: 14331 - DNA, 277 bp, Homo sapiens
cacacctgtaatcccagcgctttgggaggccgaggcaggcggatcacgaggtcaggagattgagaccatcctgactaacacggtgaaacctgtctctactaaaaatacaaaaaaattagccgggcgtggtggcaggcgcctgtagtcccagctacccgggaggctgaggcaggagaatagcgtgaacccgggaggcggasttgcagtgagcggagatcgcaccactgcactccagcctgggcgacagagtgagactctgtgtcaaaaaaaaaaaaga

SEQ ID NO: 14332 - DNA, 402 bp, Homo sapiens
ttataggtgcctgccaccatgcccggctaacttttgtatttttagtagacgaggtttcaccatgttggctaggctggtctcgaactcctgacctctggtagatccgsstgcctcagmctcsstgttgggattacagatgtgagccaccgcacccagccggtgttggatactgtttacctagagtttgtctaaaagactagcctttgcttttttggtggcaaaaaaattttttttttcacctagaaactgggagccctctaaaggcagggaaaggaaactgaaatattcaattttgcacacttagtgccttgtaggctggcagaatcagcagaatgtaacgggtactatattcaggaggacctgagtttaartcctgtctgtaagatttgggcaatttactta

SEQ ID NO: 14333 - DNA, 82 bp, Homo sapiens
agastgggaaaacaacgatatggcaggagccagtcttggggcccgcttctaccggcagatcaaaagacatccggggatcatc

SEQ ID NO: 14334 - DNA, 420 bp, Homo sapiens
ttttcttatgttgttgggtggggtataccagcataaactctaaagataaaatctatgttagattgtcaatcaactgtgtttttgaacagcataattgtgtagcagcacattgcaaaaatgcattcatccaaagcgacacatgtggcaacgtagaccacgscagkaaataagccmcttcgtgatcacctgactccatttctccgtgtgctccattggctgcggctgcaggaggaagatgcctgacagccctcatgctctccgcagggggcgctcacaaagatgccaggggtgtttattgtgtttatttttttaattactaaaatcagtagctaagaaagggtccttgaagcctcctaacctgggttggacctttgaaaaatatatttgtagcacatattatagatggaaagaagaagatat

SEQ ID NO: 14335 - DNA, 410 bp, Homo sapiens
agaactcactgcaagcaaaaaggggaagaaacgctcacaaaagggaaggcagcaggaaaagtaatcgggttgctccgcctgcattctgcccctgtggaggagacctctggttctgcaactgcctgggagagtctaagtcggtgatggagagttaactggcctggtggacacatacctaccatgtcctgcaatctagcttaaagcttacactttaagaaacagaataacaagaatagattctagagctgagtttaaaccctggctccaccactgataagctgtgtgaccttgggcaagttgttagctggcacccagtaagtgcsacataagcatctgttaaaatctccatctgtctacattctttatctattcctcagttagttcagaacctaaatgggaaagaaaggtgt

SEQ ID NO: 14336 - DNA, 455 bp, Homo sapiens
atctaaaaatgttgttttgagacaattcttctgtgatgcttcctcctcatgctcataaatgtttaaagtcttgggatttcattttcaggctgaaatagataacaagaaaaaaatttaagtttaaaatgtttacattgcgttactaaattaataccaattcaaattaagtgacctatagtaaattaatggcaatgggggggaggggattttaaagtgattggcatattatgtgatactgtatcagtgatttagtgaaataatatgtatcatagcacaactctgttgggtattaaggcttcatcttagtatttccctgcgttgctctttgaaataaaattactaccataaaaataacctcttatcatattgatgtgtttaatttactcagttggcttctaatttgcgtaacaagattaatgtagtattttttgtactattattggaagcatgccttc

SEQ ID NO: 14337 - DNA, 434 bp, Homo sapiens
ggacccgattagtggataccactctttaaggttttagcaagccaactacttggcattttaggactctgtcattttcaacccatggctccaaggtcacagtgcttatttggatcataatagcaaaaaaggaaaagcatgtggaggctcatgagtggctggtttttattggctaggcccaratgtggctcaatttgttttttttttccctttccattagctagaacttggtaaggtggcsacatctgactgcaagggggattsctgggaaggtggtctaggtgtttgcccaggaagaagaagaaacaggtttgatgaacagctggtccatctctgccacatatttacctctcggaaacttcattccacccttacttttmacttctctgagctcttattttacttataaagagcactatcarccttaggatttaatt

SEQ ID NO: 14338 - DNA, 406 bp, Homo sapiens
ggaattttccgagaaggcgcttctgaatgccgaatcatgaatctctcctcttaaaaagctgacttttcattttggaaaaagggggtcctgggccctttaacagcttgccaggtgctcaaacgctgcttcccagaatgcgtggcgctatgtaaatgagacggtttggggagcgaggatgattcatactatatgaagtgaaggcaacgttttacaaggacatctctcacgataaatgagtggggagaacttatagcccttgaagtcaaccatctcacacctttccaaaggacgcgaccataactctaaaaggctccagatggaccctgggaaggacaaagagggggtgccccagccctcaggscgccagcaaggaagaaatttgtgatacccctcgacgagatgaggt

SEQ ID NO: 14339 - DNA, 448 bp, Homo sapiens
cttgctattttccatttcattaatgatagccatcctagtggatttgaagtggtaccttattatcgtggtttttattgcattctctattgactaatgatatcgagcatcttttcatgtattttttggtcatttggtcatttttcttttttaattttaaaattttgagacaggctctcactawgttgcccaggtggtctcaaactcctgggttccagcgatgctcatgcctcagtctcccaaaggggtgggattacaggtgtgagccactttgcccagcccatttgtatatctcctttggagaatatctaggttcttttgaaggtagctgcatataaactagccaaattaacagactgtggtttttagatggctttccatatctacaagaactatttagttctcaaaactgggaagaaatgtttcagaggcatcattaattcataatcta

SEQ ID NO: 14340 - DNA, 466 bp, Homo sapiens
cccggaggaaccacccccgccctcctcagcctgatcctggaagagactcggggccccccagcctccgccaacccagagacggggtttcgccatgttggctaggctggtctcaaactcctgagctcgtgatcctcccgcctcggcctcccaaagtgctgggattatgggtgtgagccamcgcacccagccttggttctccctttcttcatctggataaggaaggctggactgcaccttctctacaggctgagttggacattcgcagatctaccctcccaacctgcattctgcctcaagcagcaacgcccaccccaggctcaggccacatggagaagccacccctagttccagtggtggatgtggcacctcggcctggccaatcagagctcccttgtcctaggttcctagtgattggtttgagatggacacgtgacccaatgagcggcctttcctgggagttctacca

SEQ ID NO: 14341 - DNA, 314 bp, Homo sapiens
agtccgcgcccgccgccgccatgccggacagctgggacaaggatgtgtaccctgagcccccgcgccgcacgccggtgcagcccaatcccatcgtctacatgatgaaagcgttcgacctcatcgtggaccgacccgtgaccctcgtgagagaatttatagagcggcacacgcaaagaacaggtattactactaccaccggcagtaccgccgcgtgccagacatcactgagtgcaaggaggaggacatcatgtgcatgtatgawggccgaaatgcagtggaagaggggactacaaagtcgaccaagaaaattatca

SEQ ID NO: 14342 - DNA, 481 bp, Homo sapiens
cactgagccctgggatgtgagcccatgaacactcagaccaggaaggacttgacttcccttccaggtccactcccaactgggaggaggccacaggggagaaatggctttctggtgtgtttgagcagaaagcaccttgaagagctctgacccctggcttcccaggataaaatgattcctggaccggcaggggctgggaagggtgtgaggtggcagccaggggtgaaggcaccatcgggatgggattttggagcaagtgtaaagtgtgctagagcagaacaagactaataacaaataataatgataataataaataatgatgcatcattgaatacataccagacactgctcgaagcagtttgcacgtgtgttggtttttaatggtggtaaaatgcacataacatgaaatttaccattttaatcactttaaagtgtacaattcagtggcacttagtacattcgcagtgctatgcaaccatcacca

SEQ ID NO: 14343 - DNA, 416 bp, Homo sapiens
tatatatacttatggggtacatagtgatgttttcatacatacaatgtatagtggtcaaatcagagtaattagcatatccatcacctcaaacattgatcatttctttgtgttggatattcaaaatcaaatgaggccgggtgcagtggctcacgcctgtaattccagcactttggaggccaagwgggtgtgtggatcacctgaggtcaggagttcaaaaccagtctggccaacatgtgaaacaccgtctctactaaaaatacaaaaattagccagatgtggtggcatgcacctgtaatcctagctacttgggaggctgaggcaggagaatcacttggactcgggaggcagaggttacaatgagccgagattgcaccactgcactccagcctgggcaacagtgagactatgtctcaaaa

SEQ ID NO: 14344 - DNA, 464 bp, Homo sapiens
tatgaggaattgtccaagttggagtttaaatagtatctgcttttgtctcaaagcatctaagttattctgacagaaaatggtaagtcagctttgcaggcagatgcgcctctgggcctcctaccttgctccgcagctttctggssatcttgtctcccaggccatgccactgctctgccacatgtcagcaaatttctttccaccagtcttatagcatcttacatgatcaaatcatcacagaataaccccgtgatagattattgatagcaatagagaggggcggctttgtcactgatttttctctcagattccttttccatctctcatccataaaggaaggactgaaatccaaaggcattctccttttgtacctacagtatccagaacccacgtgggcagccttctgcttatgacaataattggcccattgcatgcagagagaatgtcttcatagagagaatgtcatt

SEQ ID NO: 14345 - DNA, 274 bp, Homo sapiens
  misc_feature 154: n=a, g, c or t
acttgtgatcggaggagagccggatcgtccttccttgaaccctctgggtagggctgtgctgagsggctgggcggggagcacaggccgtgtccgctcgcttgcaccttttcagactgccgtgtcaggcctcgagccgggcccacctggagccctnccctkccsacccgcscccagcgaccgatatccgcccccggsccagaagggcggcttcggtcatccccagtcccgtcgcggccactgacccttgagatcagccctcscctcccsascttcc

SEQ ID NO: 14346 - DNA, 289 bp, Homo sapiens
cccacaggctgggtgtggtggcttatgcctgtaatcccagcactttcggaggccgaggtgggtggatcatgaggtcaataaattgagaccatcctggccaacatggtgaaaccccatctctactaaaaccacaaaaattagctgggcgtggtggcgcacacctgtagtcccagctacttgggaggctgaggcaggagaatcactggaacctgggaggcagaggttgcagtgagccgagattgtgccactgcactccagcctggtgacagagcgagactccatcaaaaaa

SEQ ID NO: 14347 - DNA, 383 bp, Homo sapiens
cattcaattctgggatattttcttaatttattaatttgatttctatgtttttcattcactctttctggcattctgttaattccatttgggctctctggactgttgtsctccagttttssmttatttattttccatttctgtmtttttacttcattttttgagamgatttscttagcttaatttccagatctttacggagtttttaatctcatctaatatttttaatttctaagagctatcttttgggctgggcgcggtggctsacscctgtaatcctagcactttgggaggctgggcaggtgggtsacttgacgttaggagttcgagaccagcctggccgacatggtgaaacccatctctactaaaaatacgaaaatyatctg

SEQ ID NO: 14348 - DNA, 313 bp, Homo sapiens
cttctctcaaccatggacagctgctcaagcacacttaacatgtgttctgatgtgttcacttagatgtatttgtaccctcaaaatcgcatgctggccgwggtgctgtgtgtgatttgcgtaagtgatgttccactctgsgtctcatctgtstctggctctcttcagctttaaccctatmcctacatgtggaccgagttcactgcttctgactccggcttctaaatcaattttctatagacatgtctatagaaaattgcttgaacccgggactcagaggttgcggtgggctgagattgtgccactgcaccccagt

SEQ ID NO: 14349 - DNA, 418 bp, Homo sapiens
ttctgcagtgttggagtggaacagctaggaaatgacaagggtggataaacaatgtttggcttctcttaagtaagacttaattttttttaggtaatgaaaatattagtacttttgtatattgattgccagaacaaagccagaactctgatgcaagtttgtatacctgagaaggtactcaartcggagggatagaagsttccttttgatgctggggtgggttgttctgaggtaacaatgatttatttctgtatttctttttctttttggagacggggtctsactccgttgcccaggctagagtgcagtggtgtgatcattcctctttgtagcctcaaccgcctggctcaagtggtcctcccatctcagcatgtagctgggactacaggcatgcatgtgccaccatgcctggctaattttt

SEQ ID NO: 14350 - DNA, 428 bp, Homo sapiens
ataatatgatacgtatgttaacaattaatggaccaatatggatacattagtattaactaaaatccctatttatttagatttcaatttttacctaatgtccattttatgtcttaggatcccattattgtatttgctttttaattgggcattctcttgaaattaagagaagtgacattttaagctgggtgcggtggctcatgcctgtaatcccagcacttcgggaggctggggcgggcggatcacttgaggtcaggagttcaggaccagcctgtccagcacggcggatcgtgtctctacaaaaaatacaaaaactagctggggttggtggcacacgcctgttgtcccagctacttgggaggctgaggcgggaggatcgcttgagtctgggaggcggaggttgcagtgagatsggattgcaccaccgcact

SEQ ID NO: 14351 - DNA, 325 bp, Homo sapiens
  misc_feature 69,260,264: n=a, g, c or t
tagaatgctcagaatggttcttggggccgggtgtggtgcctcactcacgcctgtgatcccagcattttnggaagccgaggtgggcggatcatgaggtaaggagatcgagaccatcctggctaacatggtgaaaccccgtctctactaaaaatgcaaaaaattagccaggcgtggtcgcgggtgcstgtggtcccggctgctcaggaggctgaggcgggagaatggcgtgaacccgggaggcggasttgcagtgggcgganattncgccactgcactccagcctgggcgasagagtgagactccgtctcaaaaaagaatggttctt

SEQ ID NO: 14352 - DNA, 182 bp, Homo sapiens
cctgtgtacccgaggggtaatgattaaatgataaagataagaaaagcgcccatgtaacacaaactgccattcaacaggtatttcccttactacctaaggaattgtaaccattgctcagacattgtaggatttaactatgttgaaaactacaggagaggccgggcgcartggctcacgcctgt

SEQ ID NO: 14353 - DNA, 162 bp, Homo sapiens
  misc_feature 130: n=a, g, c or t
aggttccacaatggtacaggcagcatcacgctgcacaatggtttccaggcagtgaaagagggtgattcagcaagccactcttcttctattttctttaacstccccttcactttttatttttatgggggtnggtggtgcttgctatatgcttacctttttctt

SEQ ID NO: 14354 - DNA, 514 bp, Homo sapiens
  misc_feature 254: n=a, g, c or t
gtttgctttgagatgtctgtgagcacatccttcctctaccatccctggttagaatggcgttctcactcacctatccacgctgcagatgagggtgaagaagtaaaaccatttaaaacatgcatcgcagcaaaccaacatggcacatgcatacctgtgtagcaaacctgcacgctgtgcacatgtagcctagatcttaaagtataaaaaaacaaaacaacaaaaaaacatgtgtaaccaacacacaaaaccctacncaaccaaacggcactggtctctttcagagccttccctcaccaagccctaccctgtccccagagatgaggccatgacatgacagtactttagagagttttagcaacgctttgttttttgagcccatgtgctcatatgagcttgttcaaaccccagagtaggggcctgaatgactggacctttacacatcagcgctggcccagaaggttacagattggcactgggagtctcccaggaaggaactgctgagcactttttagtt

SEQ ID NO: 14355 - DNA, 96 bp, Homo sapiens
attagttgtcttttatttcttctccttgtggacagttgttaatgaaaggagtaaggatttccctttttttgttttgtttgttttgttttttttaac

SEQ ID NO: 14356 - DNA, 352 bp, Homo sapiens
agatttgtgtggggccacaaagccaaactatattagggcatataaagagttttgggctgggtggggtctctcacgcctgtaatcccagcactttgggaggctgaggcgggcggatcacaaagtcgggggatcgagaccatcctggctaacacgttgaaaccccgtctctgctgaggatacaaaaaattggccgggcatggtggcgggcgctgtggtcccggctgctcgggaggctgaggcagggagaatggcgtgaacccgggaggcggacttgcggtgaggcgagatctcgccactgcactccagcctgggcgacacagcaagactccatctcaaaaaaaaaaaaaaaaag

SEQ ID NO: 14357 - DNA, 498 bp, Homo sapiens
  misc_feature 124: n=a, g, c or t
agaggaacctaggacgctccaggaatcgggtgtgcctggccctggccgggggctgcccccgggagcagcgtccaggcccatggcggatgcagtctagaggactgcctggaggaggcggcgccgnggcgagacctccagagcgcaaggccggcgggagaaaagctgaggaagtgggaaatctgtggctggagctcagcagattgcaacacttctacatcaagaaaatgtggcaataaggctgccaaaccctcctgtcttctgaaccgaatccttgtagattctggatatcgcaccttcataggaatattctgagaatattttctcctattcgcttccaggagccgtcgtagcatccgattaggactggctgctggtgtggtgatgacctagagggcttctcccagagtctcgctctgtggcccacgcctgagttcagtggtgtgatttccgctccctccaacctctgcctcctgggttcaagcggttctcctgcctcag

SEQ ID NO: 14358 - DNA, 198 bp, Homo sapiens
gtgaaggatgctaatgggtaaaaagaaagcatctaatggcattaaactcaccggcaaaagaaagaaaactcactggtaaaagaagacttctgaaaaattcagaatattgtaatactgacaaatgggatgagtaaaccacttatattttaagtatgaagactaaaagacaaattttttttttttttttttttttttttt

SEQ ID NO: 14359 - DNA, 550 bp, Homo sapiens
ttgcccatgtcagtggagctggtggcagagcatccgcttggcagaggatggcagcccacagccccaggcgatggaggcaccccatttccagtgtggctgcttcgtgcttgctgttgacttgcagtttggaaccttgtactgcgtgcttcattcgcaggacagaagctaaatctgcgccctctgccgtcctctcagaggaagtgcctgtatttggacaaaaacttgggacctgctgaatggtggggctgaaagagctgtaacacaaatgggactgaaacacacccctcgcttaccacattgcgagagaagaggagagaagagttgcggcccttcggggagcccagacctgggagctccctgagccaggtctgcgactccctctttggatccctgcagtttctggagtctgcaagcttctgagcatcaccaccttgcctggtgctaaccacggaatctgcttgcggtgcacctggtccagccatggccttgcagtgagctggtccccaatgctggcacctagagctgcccatcccactgcagcagcagtgtg

SEQ ID NO: 14360 - DNA, 459 bp, Homo sapiens
caatgttgggagtggttgtvgctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagt

SEQ ID NO: 14361 - DNA, 334 bp, Homo sapiens
ggaaggcgcacggggcgaagatggcggcggasacaggaggcgctgagggagttcgtggcggtgacgggcgccgaggaggaccgggcccgcttctttctcgagtcggccggctgggacttgcagatcgcgctasvgccttttatgaggacggaggggatgaagacattgtgaccatttcgcaggcaacccccagttcagtgtccagaggcacagcccccagtgataatagagtgacatccttcagagacctcattcatgaccaagatgaagatgaggaggaagaggaaggccagaggttttatgctgggggctcagagagaagtggacagcagat

SEQ ID NO: 14362 - DNA, 453 bp, Homo sapiens
ttatattgatggtccttgcagtaattctactcacaaatcctgggaccccctttgctaataaggctttcattcagtaagcatgcagtgcccataaattatttgacatctactgcccaaaattacaaccaagtatatgcagctttgctttagtgccctgatataaattcacatgcagatgctgtttgaattatgagtgtgattgattttcagtgatgccatttgaggagactagtgagtttattgtgcttttctggcctccactgtgagtatctcgctactctagatgacagccctaaatactcccagttagacccattaaaaaagacatatactcactttctattcaggacagcttgaaaaaaactggccatgtcctccggcctgtgtcactgctattaccagctatataacctcttgaccgaagtgaagtttctctcctgaccagaaaggata

SEQ ID NO: 14363 - DNA, 347 bp, Homo sapiens
ttgaattgatatttcatcttgacttttaaagccctagaggctaattgttagtaacatcaatttctattaggatatccgtttggccacacaccaggaggttagagcaatggagcattactgagttcctccccctgtcagatcagcagcagcattagattctcatagaagtgcgaaccatatggtgaactggtatgtgagggatctagagtgccatgttcctcaagagaatctaatgcctgatgatctgaggtggaacagttcatcctgaaaccattcccccatccacagaaaaattgtcttccatgaaactggtcccaaaaagggtggggaccacaggtttaaagcat

SEQ ID NO: 14364 - DNA, 495 bp, Homo sapiens
caggataaaacaaaaatcatgagccagacctgggtgtaactgccctggaggcccttgctctgggtcaccctgagtaaaggacttacctctcctaagcctcagtgttctcaactgtacagtgggaccaaagacacctacttcagagtcgagaggactaagaaactgcatgcaaagtagctagcctgctgcctggcaagcaagtgagggggcataaattgctatggggtaggctatcacatgagccatctccaaaaccagaagtggctcatttaagcttcataaccactctatgaagaagacatgttcatgtctatgctacagatactgaactggatccatagaaagggtaagtgacttgccctgggtcacacaggcagtggctgagctaagatctgaatccaggccacctggatccagaatccatgctccagctttactgagggacactgaaagctttcaaatagaggaggaaaatggtcagattgccctaacagc

SEQ ID NO: 14365 - DNA, 161 bp, Homo sapiens
attgttgcacacaaacgtggcatagaaaagaacatgttcagaagccatggggccaagcacatgcgggggacggtctcaaatgcgtgatcagacaatccttcacctttgctgaaaagtgagctcagatccagcaccatgttcctcctgacccatcctgtcta

SEQ ID NO: 14366 - DNA, 478 bp, Homo sapiens
gttgcaatgtgcaagacaggctgcttgccgggccgccctcggaacatctggcccagcaggccagactgtatccatccaagttcccgttgtatccagagttcttagagcttgtgtctaaagggtaattccccaacccttccttatgagcatttttagaacattggctaagactattttcccccagtagcgcttttttctggatttgcattcaggtgttattcttaatgtttctgtcaaagcttcttaaaaatcttcacttggtttcagccatagttcaccttccctgttccaggtttatttaattccaaaggtgagagttggagtgagatgtcttccatatctatacctttgtgcacagttgaatgggaactgtttgggtttagggcatcttagagttgattgatggaaaaagcagacaggaactggtgggaggtcaagtggggaagttggtgaatgtggaataacttacctttgtgct

SEQ ID NO: 14367 - DNA, 437 bp, Homo sapiens
aatcagggtgggcaattcacagcctttctgaactgactgaactagagcttgcagtgaagtgttctgctgagactgagcaccttacagatatttttctccagaagatggtgctgggtaataaaatcatcacaattagggaatggttagtggtctctactgtggcaaatgccaactgttggaattcactttawtgkdgraaaaacccmaaaytgrgacyctwaagttttgtttagcaatgtgtttctggtatgaaacaaactactgtgtcactgtccaggtaggaaacaattctttcaactgggttttcagcataaatgggaactgatgtagaaggcaggrtttagcccttctaggcaaaagaaaagctcagttgggtttcacgagtgttcctgtgcttatattcagtctgtgcctacatgttctcatgcatgtctaaa

SEQ ID NO: 14368 - DNA, 310 bp, Homo sapiens
acttaaaatggaatgagcgtaatttgaaaaacaaaatagccctggcacttctttttgtttagaacaacgtatagaaagcacatgcctcactgagaatacttagtggaatctcgataaccacaaaagcaattaaatgcttttaaattatagaaaacactaaaatttttaaagttgttcacccttggtagcttttaagtaaggatcacttgtgatttatagttgtagcttttcttgaacacgtcctcttgcactgatgactaacaaagttagttttaaacggaggtttgctggtgggttttttttttttttt

SEQ ID NO: 14369 - DNA, 566 bp, Homo sapiens
ccttgatactgaggccatttagagcaatttgtttaatgagtggttcagccatcaccaccagtggccacctgttcaataaaattgcctagcaccacagtggagagtcatctacaccccaaggtgagctgtaagactggccaattctttgaagacctttttttctgttgggagaatggaaagcagaaagggaagccaggctctttaatgttccaagtcagctgtgcctcacacaaggctctctttttagctactaagtaacatactcaagactttgtatctgtgcagcattttatggaaatcactggtgacctataggatattactaaattatttcaatagctttatttttttcctacttggattctaggtggacattacagagttgaattcctcactaccccctcccgctgtcatttgttttattggagaacttcatgttaactagagtgtacaaaaagtctgtttcctgctgagccaatagtgatttgttttgcatatcacctaatgtgaaaagtgctcatctgtgaactctatagcaaattatattttagaaaatactttgtgag

SEQ ID NO: 14370 - DNA, 297 bp, Homo sapiens
aaccaggccagccatggtggctcacacctgtagtcccagcactttgggaggccaaggtgggtggatctcttgagctcaggaggtcaagaccaggctgggcaacatagtgagactgtctctacaaaaaaaattaagaaaattaagtgaccataatggcgcacacctgtggtcccagctgctggggagagtgaggtgtgggggttggcagaggggagggcatcgaggagttccatgctgcagggagcaatggttgtgccactgtactccagcctgggcaacacagcgagactctgtcca

SEQ ID NO: 14371 - DNA, 430 bp, Homo sapiens
aaaccttctatatcacttaattctgcccagtgaaaatcagtgaccctgaggcactgccagattctaaagtgcctttgggatcatcagagactgtctataaataatgcaaaatcttgatctggatgtcagtgtatcaaatcttatcaaatccattgacaaatcagtggtgctatactggaaatggctactcctttggatgaaggacctcatttcccagttgcttggaacaaaagagaatttacatattgctgtaagaagggagagacggcagttgttggtagacacacagataagggtgcccaagaataattctgtctggattaaaggtcccagggaagtgacggtgccatttctgtaccaagaggtgaatataatttgcatgttgagtgcagtaattaagaacaaacgactcgactccacaaattaaacc

SEQ ID NO: 14372 - DNA, 462 bp, Homo sapiens
caaaaagggaaaggtagaaattacctttgaagagtcttcaagaacagcagtgaatcagagagtagtggagtggagggattggttgaatagaaaaagaatggatggacctgaaaattaatagagctcatcttgttactttcataattttttaaacagtgaattttttaaaaattaatataattggctgggcgcggtggctcactcctgtaatcccagcactttgggacgccaaggcaggtggatcacctgaggtcaggagtttgagaccagcctggccaacatggtagaaccccatctctactaaacatacaaaaattagccaggcgtggtggtgcatgcctataatcccagctactcgggaggctgaggcaagggaattgcttgaactggggaggtggaggttgcagtgagccgagatcgagccattgcactccagcctgggtgacagagcgagactccatc

SEQ ID NO: 14373 - DNA, 512 bp, Homo sapiens
actcctggagatagacgctcaagcctgacgcctctgaaaaggcagcagcagtcgccttatccatagacctcaggaaattcgctttgaccgatgcatgcttcaggctctggctcgagctgaggggaataaccgggcagatgtctgagtccttaaaaaagacaagataaaaccaaaatgcatcaccaacacacaaccaattgatgtgctggcatcttagcttggccctgcagaggcagagagaaaagaagaggagctgttgcgatttccacatctaacagcttctggctatttcgcaactgctgggtttgagtcctactgttgccgtggctgaaaagagaagtaaaatccaacttgtgagaccacgcacaaggaattaggctttggctgcagcggttctgaagcccatgctatgacagaagaagcaggcctttgaagctatcctcgggttaagaaatggtgccctaaagaggcaagcatccctttctccgttctgctgtagacaccacatctga

SEQ ID NO: 14374 - DNA, 73 bp, Homo sapiens
ctcctaatcgaaaaaatcacacctgtaatcccagcactttgggaggctgaggcgggcggatcacctggggtca

SEQ ID NO: 14375 - DNA, 81 bp, Homo sapiens
ttatacttagcttgtcttacccatgagtgacggactgcatgtggcccaggacagttttgaatcgcagttcawcacaaattt

SEQ ID NO: 14376 - DNA, 449 bp, Homo sapiens
taggatcaatagcagcagtgttaagcaggaagctacattctgttcccaaagggatggcgatgcctctttgaataaagccctatcctcaagtgctgatgatgcgtctttggttaatgcctcaatttccagctctgtgaaagctacttctccagtgaaatctactacatctatcactgatgctaaaagttgtgagggacaaaatcctgagctacttccaaaaactcctattagtcctctgaaaacgggggtatcgaaaccaattgtgaagtcaactttatcccagacagttccatccaagggagaattaagtagagaaatttgtctgcaatctcaatctaaagacaaatctacgacaccaggaggaacaggaattaagcctttcctggaacgctttggagagcgttgtcaagaacatagcaaagaagtccagctcgtagcacaccccacag

SEQ ID NO: 14377 - DNA, 193 bp, Homo sapiens
ctaaaattacataatattatttaaaatatttttaaagattgcgtaaagattacatagaaagcttctgaaatattgtacaagtggctatctaaacaggaaatttggcagggcgcggtggctcatgcctgtaatcgcagtactttgggaggccgaggtgggaggatcacctgagcccagggagttccagaccagc

SEQ ID NO: 14378 - DNA, 307 bp, Homo sapiens
cagaaatggttaaaagggctaggcgcagtggctcacatctgtaatcccagcactttgggatgctaaggtgggcagatcacttgaggcaggagttcgaaaccagcctggccaacatggtgaaatcctgtctctactgaaaatacaaaaattagccaggcatggtggtgcataactgtaatcccagctacttggaatgctgaggcaggagaattgcttgaacccgggaggcagaggttgcagtgagcccaaattgcaccactgcactccagcctggatgacagagtgagatctctgtctcaaaaaaaaa

SEQ ID NO: 14379 - DNA, 477 bp, Homo sapiens
gactttagaaaactacttcttttcttttctttttttttcctttttaaggaagaataaaacctggattcaaacctctttccattggctcactttggtgcatcaatagctcttccaagtcatgctgagtaatgcctaaaagtgaacttgtcaccttcctcacctattcacaaaaccttctgttctgatgtgtcctatccattttctagtccaaaagtttctgacttttagcaggtcagaaactggctctaacaacttcctataggattagattctcacgaacttcagatactaggacttctggatagagaagataaagtaggttttaamatcaatggtataagaaataaatttaaaacatgagaaataaaaaatagaccataaaaaatgcatattttttgaaggactaaataggatttttatatatttatcaaaattaactcagtggacatgctaagtattacacattgataaagagag

SEQ ID NO: 14380 - DNA, 231 bp, Homo sapiens
gtcgaaatgcttcccggtgccgggagtgagcgatgagctggcttctgttcctggcccacagagtcgccttggccgccttgccctgccgccgcggctctcgcggttcgggatgttctatgccgtgagaggggccgcaagaccggggtctttctgacctggaatgagtgcagagcmaagtggaccggtttcctactgccagatttaagaagtttgccacagaggatgaggcct

SEQ ID NO: 14381 - DNA, 471 bp, Homo sapiens
cacaacttcaaaatttagtctgggcctagtgcagtggctcacacctataatcccaacactttgggaggccaggagttttgagaccagcctgggaaacatctgcctctacaaaaaaatacaaaaattagctgggcatagtggtgcatgcctgtgtttctagctacgcaggaggattgcttgagcccatgagattgaggctgcagtgagctgtgatcgtgccactgacctccagcctgggggacagagcaagaccgtgtctcaaaaacaatttagtctgaaacacaattgtgctgaatctgtctgactataactctgaccacacagaaccagggctgcccctgtaatccccacagtaagaaagttgtatggcatattccaacaagtattggttcgtctggtgtctttagagctttactctgttgaagtgactgattctcaactgaacattatgtcgttactttgataagcatt

SEQ ID NO: 14382 - DNA, 261 bp, Homo sapiens
ttgtcttatcaattttctttacaatagtaggacttctatttgctggcaaagtttgtttaccaggctgatgaatgtctaaattgcttgactcttattattttttattttattttatttttttatttttggagggtggagaggacaaaggcgaggcatctgagcaggcctctcatgggaagatgctcagatgaaactgatgctgagaaggaaaaaaaaatgctttggtttgttctcactatgcactttggatttaaaaaaaaa

SEQ ID NO: 14383 - DNA, 483 bp, Homo sapiens
tcagtgtagacattttgaaaagattgtttcctgtgctttacgatagcttagtgcaatgtgcacttctgttttacttgccattttcctgctctgttttctctgtgacatgaagcaacagaaactgagatcaaagttaagattatatcctgtttgtagtatcagatatttttctgtgtacaattataggattgtaatctaaactggaatttttaggcagtaagtcaccacaaaatgttttagataagacacaataaaattattataaataaaagcttaatgtttgtaaaaaatctcttttttagtatttcttttttcacatgaaagaagtggtggctgctaaaaaaaaagctacagtgtttattaagggtctttttgatttatgtaaatatttgtaaattggtcagtgcctgtaaatttaaatataaaaagtaaccttgaaaacagttttaactttttcaaaagaactatgtccaacatttttta

SEQ ID NO: 14384 - DNA, 412 bp, Homo sapiens
atataatatcattttccaaaactgtccagtaagttttattatttttaaaactagtttttcaactcattagttctaggctgtactctcttgtaagctttatgataaccactttagttttgtgaataataaattttattcttttgttaatacttgtatacaatttaattgaaaactgtagcwtgcacactggaccagatgagtccctcactggcacagtgccctgcacctggagtgatgtttcataaaacggaattttaatagtgtaagagcaccaagatttctctgcacctatacctagcgttggactgtgcattccaaatgaaattcctcctctttatccctgtaatgcactgactaacagaagacttactacacatttaaactgtatattgacatgctattaaatgcgttt

SEQ ID NO: 14385 - DNA, 239 bp, Homo sapiens
  misc_feature 175: n=a, g, c or t
acccggcctgccccgcgccgccgcttccggaagtgggtctcgtctcctcccaagcggasatttgtgcctgaagctgccgggtctgctacggcaccgcggggctgcagaaacccgggggccaagggcgggctgcttgccgctatggctggcagtcaggacatattcgatgccatcntgatggcggatgagaggtttcatggggaagggtatcgggaaggctatgaagaaggcagtagttt

SEQ ID NO: 14386 - DNA, 372 bp, Homo sapiens
agtgtcttctgggttatgaagtttcgacatcgcttctggacttgcagagcgttggtcagtccttatatggcggatagaggctcagtggcaccgtcagggagctggtaaacagagtgccggactccacggacaggacggggcttgggttgctcttaaaggcgacataaccagattttcttgaagtaaggtctaggatactcacagaaatgtgagggacctatgatatcggattgtgaagcacagcaagttctcaacggctacaccgccaaagggacacactataccmcaaaggcactctgtctctactcatgcctctcagccatatgttgcttttcaaatacacatacagttaaactttgacttctatttatt

SEQ ID NO: 14387 - DNA, 451 bp, Homo sapiens
atctctgagcctccgcggccttctctagcaaaatggtggagccggtacccggctgtaaggcaagctgggatgcgcggagtagcgggtggaaaactggastggagttctcactcggccgctgggtgacttcggtgcactagggatagtaacagtaccacctcgtagggttgtagaaagacmaagtgagttaatatttgtaaagtgtttagaacagcgtctactgcatggaaagtagtatttatttgttagagagactccaggaggtcttgcccagggattgacttctccsttccstgtctccascccccasattcacgtttgtgagccaagccttgcttttgcaccggccgggctctcttgcctggaaatgcatacccatctcaaacctgggctttaaaatcacctcstctgggacgccttcctctacttctcacagttcaggcctgttctg

SEQ ID NO: 14388 - DNA, 467 bp, Homo sapiens
gaaagcgtttcaaagcgtcmkgtgggagcagagtgaccctttgctgatgctggggggaggggatctaaatcctcatttatctcttctatgtctagtattttactgtcactggaggctctgtgggctgtcatagttaattgaccataattagcaatatacttttaaagtgggaaagctgaatgacacttttaagacaatgaacattatcaaaacaaaatgtataatttcttaatttgaataataaattaagcgtttaaatgctatttgtagtcttgatatacagaaataaaataattagggttggtcttttttattttaggttgttttatgttgaatgttctatatcttattagttaatttgtatattttattagtattttggaaatagcatatctgagactgaagagaaattgacaattcacttatttgtggtttttttctcagctattctgagcttatttatttat

SEQ ID NO: 14389 - DNA, 443 bp, Homo sapiens
caaaaaaattaaaaaagaaagaagtgtgaatctttgtggctctgtgtaacctttttttcagtatattttccttactattctggggttctgattcagcttccctatgatagctgttgaccaagctgtatcccaaaggtgggagggaaagacagaagactaggcsgaatacggtggctcacacctgtaatcccagcacattcggaggccgaggtaggcagatcacctgaggtcaggagtttgagtccagcctggccaacatgatgaaaccgcccctctactaaaaatacaaaaattcgacaggtgttgtggcatgctcctgtaatcccagctacttgggaggctgaggcaggaaaatcgcttgaaccggggaggcggaggctgcagtgagctgagattgcaccactgtactccagcctggacaacagagcaagactctgtctcaa

SEQ ID NO: 14390 - DNA, 145 bp, Homo sapiens
cgaaaatagaggtggaggttgtagtgagccaagatcgtgccactgcactccagcctgggcaacagagcaagactccgaagttcgttttttttcttttttttgagatggagtgtcactcttgttgcctaggattacaggcattaag

SEQ ID NO: 14391 - DNA, 115 bp, Homo sapiens
  misc_feature 24,38: n=a, g, c or t
ttattatactttaagttctagggncatgtgcacaacgnggtttgttacatacatacacatgtgccatgttggtgtcctgtacctgttaactcatcatttacattaggtatatctc

SEQ ID NO: 14392 - DNA, 451 bp, Homo sapiens
acctgtcatggctgcctaactgacaacctgtttcctgttaaccaactccttttccttacccctccctagttcctgcttttccacacatggttacctttcttgctatataaactcccaattttagtcagtcagggacaaggatttgagactgatctcctatcttggctatggcactcatttaaagtcttcttcgctggcaatactccttgactcagtgattggctttctgtgtgcagcttcaaatcctttctgcgatgtagcaagatataaatacaaattactgggaatagccatcttggatatctaccccacaggtccttaaaattcaaaactgattaaaataacaagaatgagtctgggttccaaggtgatgacaagattaacacaagataattcaataaatacttgctgactgaaggaatagaagaataagtgcatgaatggtgaagag

SEQ ID NO: 14393 - DNA, 470 bp, Homo sapiens
atttttaggagagacggggtttcaccgtgttggccaggatggtctcgatctcctgacgtcgagatccacccgcctcggccccccacagtgctgggattacaggcgtgascaccgcgcccggcctgttccttttatttcttaattcaggacactaaaccatgactgcaagggatttccttagtaaaaagaaaagattctcagagtcaaaatgttcttacaactcgggcttgacggcctttgaattatgaatggattgttcctctctctaagcctattgtcacatgggtttttaatcctggccttgctgctagaaatctgtgcttgaagtcctctctttctgctggtagcctaccagttaaaagtcaagacttggtggaactcagtttaccagactctttagcctttgagctaaactgtctgagcaacctcttagatgtgcacacaccactttgtatgaaagggttctctag

SEQ ID NO: 14394 - DNA, 474 bp, Homo sapiens
aaaacaaaaaataagaaataaagtgggcttgctgagtgctttcatactgcatcatttattgtgcatttgtatgattattatatactttacaaattttcgttttacagtaatttgtattcattcgtttttcaacctgcttatttcagttcagtgtcttgggtagstggagcctatcccarcagctcagggagcaaagtgggagccaaccctggacaggatgccttttcatcacagggcgcactcacacggcacacacacgcatactgggaccatttagctgtaccaattcacctaacgtgcatctttgggaattgagaagaaaccagaatacccagagaaaactcatgcagatatgtggaggacatgcaaaattcacacagacagtggccctggttgtaaataattgtttttcatcaatgttataatgaaattacaggccgggtgtggtggcttacgctgtaatcccagcacttt

SEQ ID NO: 14395 - DNA, 442 bp, Homo sapiens
  misc_feature 353,377: n=a, g, c or t
ttatttaaggagggctcaatcaacaggtttagatggtgtgctattcataattattgcaaaaataggccgggcctgtgattccagcactttgggaggccaaggcaggtgaatcacttgaggccaggagtttgagatcagcctggccaacgtggtgaaactccatctctactaaaaataccaaaagtagcgggcgtggtgacaggtgcctctaatcccagctactcgggaggctgaggcaggagaatcgcttgaacccgggagtcggaggttgcagtgagccgagatcgcgccattgcactccagtgtgggtgacgagcgaaaatccgtctcaaccaagaaaaaagaaaaamagnaaaagaaaacttaactggcctttngggcacatgcctgtaatcccagcttcttgggaggctgaggcattagaaaaaaaatwaacctggga

SEQ ID NO: 14396 - DNA, 372 bp, Homo sapiens
  misc_feature 344: n=a, g, c or t
agatcatgaggatggtggttaggaataggagcactgacattttaagactttgagtctaaaaactgattatgtggttcacttcttgttttatttttgccacttctgttattaccagggaatgatattattgaactctaaaaaaaaaaaacatacgcctttatgccagccaagcagaagagtwtacaatatstttgatatgctgaaagaaattgaagttaaatgaattactgtgtctgggagggaatttctattasatcacaatgttacgggatccagtgtcacgttacctgagcgagtggaaacatgtccagagaggggccacttggaaaacctctcttcatatntttgatggaagargscccaccccagatg

SEQ ID NO: 14397 - DNA, 122 bp, Homo sapiens
ctagaggttgtgggcagcatggacagtcccccactcagaagtgcaagagttccaaagagcctctggcscaggmssctccccamsagggctttgcagatgtccttgaaagacccaccctagag

SEQ ID NO: 14398 - DNA, 457 bp, Homo sapiens
tataaatatatatcttcctgattgcaatttggagaacacaattatttacttgaccttcattcaaggaccaaattcagagggaagcatcgctgatttcagtgcttgagatactgaaaacagtgagaatatggtatctgccctacctaaaagatctggcaattgaatgaaacagagaagcatataaaagataaattgtgaagcatactacttattgctgaggaagatggtatcagggagtgggtagatctaactttttagggtgagtgaagagttttcgagtaaaaagtgggaaataattatacaaatagaggatatgacatatgcaagtataatggaggcaggaaagggttggaagttggaggaaatggtgatggcaccactgcagtgaagactaaggtgcaaaagatgaagatacaatgagattttgatgagccttttccctgtataaacatgctat

SEQ ID NO: 14399 - DNA, 457 bp, Homo sapiens
  misc_feature 423: n=a, g, c or t
ttttthttgatcttggggattctggctgtgaattttgtgcacgacaattatggtaaaaaaacatttgcttggtctaaagaagatcattaatgttttgtgaccatacaagttgtaacagtggattgtttttatgtgtaggtattgttaaatacagggactgtttccaggcacaatatgaatcgtaagttaggatggacattagatgtgattatgatgataaagcgaaggtctgcggtcctatatctacagacacgtggtgagaaattagaacaaactggagacgggccattgacacatggactctgcctgggcatgttaggttaattctttgactccaagccttaaaatactcacatggagtcagcgctcacctcattcacacaattatcatagagctccctggacactgaacctctaaagggnaaaggtctaccctggagccaggagcatcagggtt

SEQ ID NO: 14400 - DNA, 296 bp, Homo sapiens
atgttttgaggtttgaggctttttttccccttatcaactcaagwctttcctggttatcctgggctgtcagtatttggttatggactacattaattactgtagcttacagaggaaaagatgtgtgttttagataaaaagagctatttcgagctaaaaattattaacagatggccaggtgsggtggctcatgcctgtaatcccagcactttgggaggtcaagdtggatggatcacttgaggccaggagttcctgaccagcctggccaacatagtggaaaccccatctctaccaaaaaa

SEQ ID NO: 14401 - DNA, 170 bp, Homo sapiens
acaaaaagttagccgggcgtggtggtgggtgcctgtagtcccagctactcgggaggctgaggcaggagaatggtgcgaacccgggaggcggasttgcagtgagcccagatggcgccactgcactccagcctgagtgacagagcgagactctgtctccaaaaaaaaaaaaa

SEQ ID NO: 14402 - DNA, 379 bp, Homo sapiens
tggaggaactgcttcctgtagggcaagaactggaaaatgcaagcgccctgaacttttttrgtacttgaactaatattaattgtttaggggcttctttctttgtcactaccaatcctccaacttgatgcagaagaaacacaaacagtaaaataggtcacagacaaatagtttagagatttaagagatacgttagagatttaagagactgaaaactattaaagtcaaattggctgatctttccgttgcattcatgatgcaaaatcagtggcaaggtgccgggcgcggtggcttacgcctataatcccagcactttgggaggccgaggcgggcggatcgcttgaggtcaggagttggagaccagtctggccaatatggtgaa

SEQ ID NO: 14403 - DNA, 477 bp, Homo sapiens
  misc_feature 337: n=a, g, c or t
catagcagcactagtcacaataaaggtagaaacagctgatcacaatggttcactcctgtaatcccaacactttgggaggtcgaagtgggaggattgcttgagcacaggagttcaagaccagcctggacaacatagtgagacatggtctctgcaaaaaaatagaaaaatcagcagggtgatggtggcatgcacgtatactcccagctactcaggaagttgagtgagaggattgcctgagcccaggagtacaagactgctgtgagctatgatcatgccactatactccagcctgcgcaacagagtgagaccctgtctggaggggtggggggagaaaaanacaccatagaaacaacccawatgtccaatarcaaattgtagtccatccatacaatggactactactcagccatgaaaaggaatacagcactcacatatgctgcatgtgaatgaaccctggaagcattatgctcagtgtaa

SEQ ID NO: 14404 - DNA, 419 bp, Homo sapiens
aattgtaaagccaggaactatccttttcgctcccctccatctccttccctcatttcctcaattcctctccttaggcttttcccctcctccatccgtagtgttgtgtcatgggaggaaagaactgagcagatctgaagaaactgagctggccagccagaggcaactagaactattaggaaagcatagactctgaaagtccctaaagagattaccaaggtttaccctctttctaattccccctcctcccgcggagcaaagccagacatggccaactggacagctcccaggtatttgctgacctgtttgaccctgtgatccaagagcgacacaatggatatgacccccggacaatgaagcacaccacggatctagatgccagtaaaatccttctggctactttgatgagaggtatgtattgt

SEQ ID NO: 14405 - DNA, 481 bp, Homo sapiens
ttatttcaggcttccagctgtccctgtgagttatcctggacatttcgatggtttttggtaaggccaaactctgataagcaaaacagagaatactgacgtatacttaaccatatgtgtaactgatacttggcaccatggaatttttcattgagttatttcctcattcttttaaaaaataagggactataaatcagttatgtagtatcttttgtttttgtagctgattccttaactttcttgtatgcctctagtaatttcagagattaaatattgctttaaactgtgatactttgatttgctagattgacaaaactgatactaatataattaagttcatctttgaaatacatctttgtgcgtagagccaaaaaaagagataaaattaataatagttcacttgttatttgagattaatttggcatttgaaatgatcattttattttacaatcatttataatgaatcaatgttccagttagcttt

SEQ ID NO: 14406 - DNA, 477 bp, Homo sapiens
ctgatcttcatttaatgcccagtctgtaactaatgttctgtttaaagctctcttaatttgttggctatgagtgatttgtgaatctgggatgtaaccctgagtgaggagaaaagggcattgagccagcataaatctgaatgggcagaagccacaaacaaatgggagcagaaaagaagggcgagctcccccgcgccgcaccccgtgtataatccagtgttaacctctgaggaacacctcggctctcccaactgaggagagacaaaagagggattctttttacacccaggctggcgcattttcaagtgacaatctcgggctctagttgcctttgagatatccactctgctctttctcccaggcctcagaccaagaaaaacatgctctcaagattagcccataggcagttcttgtgacctggctgaagaaagaaaggagacctgtttgttttaaaagtcgggcgcaaagtgtcaggtggct

SEQ ID NO: 14407 - DNA, 474 bp, Homo sapiens
ctttcctggctgtgtggtggactcttcagggacacagcagtcactgcgctgcagggacagtccccaagtgccaaggcacagcctaaaggggcctgttcccaccatggcatccgtgacaagaaccaggagccagaatgcaggtttctgggacttgtcagctcscttctgagtgccctgttgaggattcctagaagtccagacacctcacccccctaacctggatgcaccacgcagagccaataggaatacttttctgtggacgtgccatgttggaatcccagatctccctgccctgccagcccctgccagcttcctggggacccaactgaccctgaagaaagcctctgatgggcctagaacagagaaggtgacccaggaccttgcccagcctttctggacaactggaagacagttacgcttcgtcctccacctctccctccaacaaaaggatcttagcaagtgttggagaggtgc

SEQ ID NO: 14408 - DNA, 356 bp, Homo sapiens
actacatcaagcgccctggagacgctcttcgtgcaccgcttctcccatggcactatgcctttgcgcaacatcttcaagaactgcacctactactggggcttcgcgcgtggatggcctattacatcaatcaccctctctacactccccctacctacggagctcagcaggtgaaactggagctcgcatctttgtgatctgccagctcggcaacttctccatccacatggccctgcgggacctgcggcccgytgggtccaagacccggaagatcccataccccaccaagaaccccttcacgtggatcttsstgctggtgtcctgccccaactacacctacgaggtggggtccctggatc

SEQ ID NO: 14409 - DNA, 478 bp, Homo sapiens
  misc_feature 437: n=a, g, c or t
tactgttaatctttgctgaaatatatgctaacaaatgttaagcaagggaaactgaagacttagtcatgtggattgttagcagtgatctgcattctgtaaaagaggtactttcccatgatgtaggcatgaagtggtgccagtaagcgtagagcgaaatgttgactttagttaacatatgggtttagcatttccagtgcagcattatcagtgggcctttaaaaatacttcgtaagtacattagctttcactttgttgttaaattatagcagactcattatagagaacaagtttgssttgattttgtttaaaatgacttctgctaagcacccagaagataaaattgacatatttttataatataagcatactttttttgtacattgtgttcattcttgaataaaatgagttctgtgtwggmttgtagatactagasagmnagtattgattttgattcagtaaatgttttctttcaatcctg

SEQ ID NO: 14410 - DNA, 460 bp, Homo sapiens
ctataaagtgctgcagctccttagctttgctgttgttatagtgtagctggagccatagacagttagttagttatgagtgagcacagctgggtgccagtacaattttaatgatcaagactcgtggcaggcagaacaaaccatcatttgttgatcctctgcttgaaagcacgaataagtgagaacagagcagtcatatggtttcagaaagtgttattctgggatttcaggataaattttgtaaaactagtaacaaacaacacacaggaaactaatttggtataagaaacgacatatccctaaattgcttatttaacttcattataaatacatctacttaacaaaaaaatatattttgtgatcttgaggtcacttcgtttaggtcattatctcaacccaacctccccaaactctggtttgagccaatatgtgttctattgttctcagagcaccagccgactgt

SEQ ID NO: 14411 - DNA, 220 bp, Homo sapiens
taattttaaaagatgaaatggcagatgctagtaattcacagaatggcctcttgtgggggtgggtctgagggaagtcagctataaaacatttgctggagttttgttcaatggggctgtgcatttttatattatgtgtttgtaaatgacatgtcagcccttgtttcatgtttcctaaaagcagaatatttgcaacatttgttttgtataggaattatttgtg

SEQ ID NO: 14412 - DNA, 320 bp, Homo sapiens
cattttacttattgttttcattcaacaaactgtgtgaaaattaacctaacaagatctcatttacttttggtgatgcactgtattcaaagatagaggtaggagagacatgattagaaagatcttcagaaagttaatatgggaggctgtagggcattcagataggaaaatgaaagaggmatttggatgtgtagtcctgaagcttagaaaaggaagctgtggtttaaatttaactggtcaatagttaatctcatgagatcgtgtatccagggtagatggggatactgggagaaaaatgagaaggcaagcttgattggtgacat

SEQ ID NO: 14413 - DNA, 441 bp, Homo sapiens
  misc_feature 281: n=a, g, c or t
tgagattctaagagtgtgtgtgcatcttgacaatattagaggaggctgagcccaagcaggcacattctcttcgacccctccctcattcagtctgctttggagtctactgaacatcaagcttgctatgagcaggatcttagagctgaggaattgacctcccaatccgaacagttgttataatcctttcttaataggttgtgctgtggacccaatgtgagggctgtgctggtgtaaatggtgacatattgagttggggggatgctttcggggtggggggactngttccattccatcaaaggccctcttgagagtctatccagggacccattgttttactttaacagaccagaaaagatgtttgttttccatgtcattacccccaggggataccgaatgtgtgggtagaaatttctctgtagattaacaatcagatttttacat

SEQ ID NO: 14414 - DNA, 476 bp, Homo sapiens
gccccagcaggaagtcccagttctggaggcagcataggaaagagaaaatcctggtctcctgttagaagtcagagcagcagacctagagaaggtgtattcagttcttggggaggaggatgtgaggatcgggagggaggtaggaggagagagctcaaaatcccaccagttgaaggcctgtgtgagctttaattttggccatttaaacaattcaaagaggctgggagtggtggctcacgcctgtagtcccggccctttggggggctgaggcgggcggatcacttgaggtcaggagtttgagaccagcctggccaacatggtgaagcccggtctctactaaaaatacaaaaattagccaggcgtggtggcaggtgcctgtaatcccagctacttgggaggctgaggcaggataatcgcttgatcccagaaggctggaagttacagtgaaccaagatggggccactgcactccaccctggg

SEQ ID NO: 14415 - DNA, 301 bp, Homo sapiens
gcattttcggccgggcacgtggctcacgcctgtaatcccagctctttggagggccgaggctggtggatcacctgaggtcgggagttggagaccggcctgaccaacatggagaaaccccgtctctactaaaaatagaaaaattagctgggtatggcggtgcatgcctgtaatcccagctactcaggaggctgaggcgggagaatcgctttaacccggggggcagaggttgctgtgagccgagattgcgcctctgcactccagcctgggcgacacagctagactccgtctcaaaaaatmaaaa

SEQ ID NO: 14416 - DNA, 169 bp, Homo sapiens
ccagttattcaggaggctgaagtgggaggatcacttaagcccgggaggttgaggctgcagtgagctatgtttgcaccactgcactacagcctgggcaacagagtaaaaccctgtctcaaaaaaaaaaargaaggaaagaaagaaacatttatkrtgtttctacttacta

SEQ ID NO: 14417 - DNA, 439 bp, Homo sapiens
  misc_feature 173: n=a, g, c or t
cgcattatggacagacttcgtgaatgggaatttgcttagaattgtgagtagttctgaattagaaaagtatgtgaaggaaaggcagctgtaaacgtattgtgccctggagagttgtacacatgttgaatgtaatctgggcttacctgatccatttcgagtggatgtcactgccnagtctgttctcacatggaaccatgtgtgtggggtcccagcctcacagatacaatcaatcctattcccctctgacataaggaactcctctggagtggcagagtcttatcacagaaggcagccaccatttcaccaaaacaaaagttcacggcattcaattcctttttcctttagctatttatatatgcagtactctcagtcatatgcagaaatactttttttttttaattaatagttacaggcttgttggtccagtgggatttgggta

SEQ ID NO: 14418 - DNA, 343 bp, Homo sapiens
  misc_feature 180,263,297: n=a, g, c or t
cagtacctccaaggaagtctcctttgcagttgatttatgtgtactgttcccagagccagcccgtacccgcgaagagcaacacaatctgccggtcccaaaagcaggaagtgtcaaccttgcagcaggatttggacactccaggagccaaactggatgtggaagstcsaaaggtgcagaaanagagactccaaaatgttgaattttasstctgtcstgggaatsaccctgasactagctgtcgagatacttaccagtttttctgncctgattggacatgtgtaactktaagccacctantctgggggatcaaccagatcttcattccataactcgtgmttcwsgt

SEQ ID NO: 14419 - DNA, 404 bp, Homo sapiens
tttttttttcagtttttgtttttacttttgtcccgccgagtactatgtattaccagccccccaccccacagatcagttttcctagtctttgggaaacgggttgtgttttttttsstttgccgtgttggatttscggtcccggctgacacctcccttsgtgtgtgcgcccctmcccacccctgcctttrtttcggtgccctgtgtccgctctctcatgtggggatgtttgtgctgcagacaaaaagaacaaaaaaaaatttttaaataccacaagatggaaaaaaaaamcaaaaaaatttaaaaagatggaatgtagtgtttacattaaagcsgcsgttttsatgaccaatcctatgtsatttctactttgamtaatacccaaaccctaaacctcttcacggttt

SEQ ID NO: 14420 - DNA, 463 bp, Homo sapiens
  misc_feature 417,454: n=a, g, c or t
ccagaaggatgtatttagatatgaaatgacatggtgtcagggacttgttttataataatgcagccaaaaaagagagaaggagaaagaaaagggggcaagggaaggaaggaaaaaacaaaggaagaaaggaagtcagaagtaaaatgttttaattgttgaatctgtaggatggggttcattatactattctctctacttgtggttaaaaactttcattaaaaaaaagtcaggctgggccgggcgcggtggctcatgcctgtgatcccagcactttgggaggccaaggtgggcggatcacgaggtcaggagatcgagaccatcctggctaacacggtgaaaccagtctctactaaaaatacaaaaaaattagccgggcatggtggtgggcgcctgtagtcccagctactcgggaggctngggcaggagaatagcgtgaacccaggaggcggacttncagtgagcc

SEQ ID NO: 14421 - DNA, 402 bp, Homo sapiens
  misc_feature 31,46: n=a, g, c or t
aatatggattatgatttcaaggcgaastggncggcggasgggaggngtggaggatttgtttgagtacgaagggtgcaaagtgggacgcggcacctacggtcacgtctacaaggcgaggcggaaagatggaaaagatgaaaaggaatatgcattgaagcaaattgaaggcacaggaatatcacatgtcggcttgtagagagattgcacttttgcgagaattgaagcaccctaatgtgattgcattgcagaaggtgttcctttctcacagtgacaggaaggtatggctgctgtttgattatgcagagcatgacttgtggcatattattaagtttcaccgtgcatcaaaagcaaataaaaagcccatgcagttgccaagatctatggttaaatccttactttacc

SEQ ID NO: 14422 - DNA, 497 bp, Homo sapiens
ctacttttacttgttcatttctgtctcccctaccaggctgtaaatgagggcagaaaccttgtttgttttattcaccatcatgtaccaagtgcttggcacatagtgggccttcattaaatgtttgttgaataaaagagggaagaaggcaagccaaccttagctacaatcctaccttttgataaaatgttccttttgacaatatacacggattattatttgtactttgtttttccatgtgttttgcttttatccactggcatttttagctccttgaagacatatcatgtgtgagataacttccttcacatctcccatggtccctagcaaaatgctaggcctgtagtagtcaaggtgctcaataaatatttgtttgggtggtttgtgagccttgctgccaagtcctgcctttgggtcgacatagtatggaagtatttgagagagagaacctttccactcccactgccaggattttgtattgccatcgggtgccaaataaa

SEQ ID NO: 14423 - DNA, 447 bp, Homo sapiens
ataatctaggtaagacacagtagagtcctgggtaaatcagtggcagagaatgaagagatgattagtggcattttggagacaaaattaacaaaattaatttgatgtagagagagagagaaggccaggataactccaaatttcatcttaagaatgcaaccttgagctgttagaaactatatwagtgtttgttcaagtcttttgatatgtgtgtatgggtgggaggggggaggatgtggatgaaatcagttgtgctgagagtctgtagtttttatagcccaaggtggagactttgccagtaaatgggctcagaggaacctggctatagttagtcaggaaaagtattttgtcaatcttcctatttctcttatatacttaatattttttaaattaacttaccttttatatgtaaatgaatttttaaatagaaaactttgtatgattaatata

SEQ ID NO: 14424 - DNA, 455 bp, Homo sapiens
  misc_feature 346: n=a, g, c or t
caacagtggaatataatgtttaataacttgggggggttatgtgttttgtttgtttttttttttagctcttcagagaagtaagaataatgaagattttaaatcatcccaatataggtactttctgcttttttaaatattttggggtctaaatacgtacttgaaattatgtcataaagctaaacacgtattctagaaatggtagagtacacttctagtaaaatatatawacaagttgttgatcatttgtattagctttttgaaattgctgaagacaggttaaaagcttaggtattaaacgttgaatttaaagctttaatctggtagaaacatctgtactctgattatnattttctaatttttaagtatattagaaaatrtaattgtatggcatgagtagatagaagggaattctmggaagtcagaattaatattttcaaaggggctgagcacagtgg

SEQ ID NO: 14425 - DNA, 173 bp, Homo sapiens
tgaaaaagcaagtcatggccaggtgcggtgactcacgcctttaatcccagtactttgggaggcggaggcggtcggatcacttgagatcaggagttcgagaccagcctggccaatatggtgaagtcccgtttctactaagaatacaaaaattagcgaggcttggtggcaggcgc

SEQ ID NO: 14426 - DNA, 373 bp, Homo sapiens
aaaaaatgacaagtgaagtttaaaggtcaattgataacgggggggaaaataatatataacaacacattaggttaaatccttaaagagctgcaacatggctgggcgcggtggctcacgcctgtaatcccagcactttgggaggctgaggcgggtggatcatctggggttgggagttcgagaccagcctgaccaacatggagaaaccccatctctactaaaagtacaaaattagccgggcacggtggcgcgtgcctgtaatcccagctactcaggaggctgaggcaggagaatcgcttgaacctgggaggcagaggttgcagtgagccgagatcacgccactgcactctagcctgggcaacaagagcaagattca

SEQ ID NO: 14427 - DNA, 415 bp, Homo sapiens
aaaactgtcaaccgtcactttggaaatggawgcatttccagcaaagctttcccaactgaaaaggaagcatccaggctccttcatggccctgcccagagtggtggcccacggggaatttcccaggaaagcatgaaagcgtctaatgcttttgtgacacaatcaggtcaaacatgataagaaattgttcctcgagatctgaggatgaaggacaagtttctaaaacaccttacaggccctctttattttagtccaaagtgcagcaaacacttccatagactttatcacaacaccagagactgcaccattcctgcatactataaaagatgcgccaggcttcttacccggctggctgtcagtccagtgtgcatggaggataagtgagcagaccgtacaggagcagcacaccaggagccat

SEQ ID NO: 14428 - DNA, 213 bp, Homo sapiens
tatttgatcctcacagcagccttgtggcatgggcagcccaggccttctgcttacctcatttcatatacaaggaaactgatcctcagagaagctaagcagcttgctgcagttcgtgcagtggaggagagccatagctctcaggctccaatgttcagcacattttttcatttgtttttataaaatatttacttttaagaagtagcattttttttt

SEQ ID NO: 14429 - DNA, 442 bp, Homo sapiens
ctccaaacttactcttcattctcttgcctctgtgttttgcaagttctgaagcctctatctcatatttcctcacttggtaaactccctctcatccccacaattaaagccaaaggstcacatcctctgagaagttcttcttgactcaaggccttccttgtctgcatcaaataaccttaaagactctttaaagtaattattgtcttatttatctattttgtccactacagttgagtacaggtgccatgtctttcctacgttgagtgccagaggctaagctggggctcagaaaacatgttgaatgaacacatgaatatatccatactaaaattgcactaggccaggcacagtggctcacacctgtaatcctagcactttgggaggccaaggcggatggattrcctgagctcaggagttcaaggtcagcctgggaaacacggtgaaa

SEQ ID NO: 14430 - DNA, 465 bp, Homo sapiens
ctccagttgaaggtgagaaatctgtaccaatcattcaaaaagggaatctattgttttgaaagaaactctctcatatttcctttaaattgttaatagttgttatgcaactaaagaatgttatgaagaaaaatagcattgcaaaaagtaccattggccaggcttacaagtcagccacaatcagtcggtataactactgtgttattctttttctagacaaattttgactcttctacttttatgtgtaataattccagtattctatttatttcagcattatgtgaaaaatgataagaatgttaaaaagaaaataatagtgtggtttaattggtatgagatacctgcttcctcctcctcaaaggtttgactgggtgtatctctcctatgtgtgacattatgtctcctggtgttaacacaggaaatgagtgctcctttttaaaatttctttcttccaagtttttttttcca

SEQ ID NO: 14431 - DNA, 256 bp, Homo sapiens
tagtttgtctcctcttcttgttcttctttaaaatcatcgctactctttgtgttttgcttttccatatacattttagagttctgctccatgaaaaaccctcctttgattgaggtcatgcattaactatatagattagtttgaagagtaatgatattcttatgggatagatatttcctgtgtatgtcttctttaatatctatatttarggtctttttactgtatasatcatttttagtaactttttaaatgttaataa

SEQ ID NO: 14432 - DNA, 295 bp, Homo sapiens
gcattttcrgccgggcacgtggctcacgcctgtaatcccagctctttggagggccgaggctggtggatcacctgaggtcgggagttggagaccggcctgaccaacatggagaaaccccgtctctactaaaaatagaaaaattagctgggtatggcggtgcatgcctgtaatcccagctactcaggaggctgaggcgggagaatcgctttaacccggggggcagaggttgctgtgagccgagattgcgcctctgcactccagcctgggcgacacagctagactccgtctcaaaaaa

SEQ ID NO: 14433 - DNA, 398 bp, Homo sapiens
aataatgcaagctgggaagaaaaccctcactgaactcaacaatgctggcactctgactccaacctccagacaagatggagtttcaccgtgttatccaggatggtctcgatctcctgacctagtgatctgcctgsstcggtctcccaaagtgctgggattacaggtgtgaaccamcacgcccagccaagattatgtttaaatgttaagtgaaaaaggaacataaaatggattcaattcctsgagggctattagactgagggcctgagttcctcactggctgttggctggcgaacactctcaattccttgstatatgtgcctctccaacatggcagcttgtttcatcaaagccagcaaaagtgggaggaaggaggaaggaagagacagaatgaatctgct

SEQ ID NO: 14434 - DNA, 477 bp, Homo sapiens
  misc_feature 443..444: n=a, g, c or t
aaaatattttcattaccccaaaaagaatccgtgcagccattagcagtttctcaacatatttatacattttttccgcagtttaatttttttatttgtataaatttaatgggtacaagtgcaattttgttacatggatatattgagtagtcatatgttttttattcatgtcttgtatttcctaaaattcttgcaataattgttacttttataataaaaataaacatctgttacaaataaagttaatgcaacatatactataaaaataaacataggctgtgcacagaggttcattcctgtaatcccaacactttgggaggctaaagagggaggactatcctgtaatcccaacactttgggaggctgaagagggaggactatttcagatcaggagttcaagaccagcctgggcaatatagtgagacccctatatctttgaaaaaagnnaaagaaaattagccgggtgtggtggcgcatgct

SEQ ID NO: 14435 - DNA, 343 bp, Homo sapiens
  misc_feature 62: n=a, g, c or t
ctgaaattataaaatgttgtgattctagctctgctatgttatgccatcatccagtgcaagangtgctcagtttcctcgagcccaagacaaagttcattactacataaaactgaaggacttaagagatcagttgaaaggcattgaacgaaatatggacgttcaagaggtgcaatatacatttgacctacagcttgcccaaggtatgttactgtcctcattccttttattcattttgtgtgtgtatatatacacatatatacttacatatatatacacatatacatatatacatatacacatatacatatgtgtgcacatatatgcacacgtgtatatatacatg

SEQ ID NO: 14436 - DNA, 119 bp, Homo sapiens
cacacctataatcccagcactttgggaagccaaggcaggaggaacacttgaggtcaggagtccaagaccagcctggcctatatggcgaaaccccgtctctgcttaaaaaaaaaaagaaa

SEQ ID NO: 14437 - DNA, 200 bp, Homo sapiens
actgttgcctggcgacgggtccctgcgtcatggcggagaaggggactctgtggacgtgcatcgssgttggactctcgcctgtsttctctgaaggatccatgggatagtsscgcgatcctagaagtgtgctggggcgacccasctgaagaaacctcaagcggasccaagggatacagcgcaaaattcctaaggatccgcag

SEQ ID NO: 14438 - DNA, 116 bp, Homo sapiens
agaacaggaagcggaggcataagcagagaggattctggaggtctctttgttttcttatccacagagaaagaaagaaaaaaaattgtaactaatttgtaaacctctgtggtcaaaaa

SEQ ID NO: 14439 - DNA, 470 bp, Homo sapiens
tagatattgataagacactgatggtgtaaagttatgagccaaatctatgtaaaaatgtaccagttaacaaaacctgtggctattatgaaaaacttacttgaataagactttctgcttttgtgttaatgtgtccagaacccacctgtagaagttctttgtgtatgcagtcttttcaccctacagtgctttcattctgatacacttaatcagagatagtagttttctgggttaaatctagtcgcttatcctcctggatatagcagaaagatagtgggatatataggtgtgttgtataacttttststtttacaccttttcctttttttaataagaaaactgggattgaaatagaataagttgaagttaatggtaaaaattccaaacctggctgggcaccgtgactcatgcctgtacccagcacatgaggccaggagttgaagaccagcctgggcaagatgatggaccccgtc

SEQ ID NO: 14440 - DNA, 396 bp, Homo sapiens
tgagcaaatgtatccaagaaagcaagcaaatgaaaagaaacctatttatggaataaactccagatctgaaattcagtattttagaaaaatgccagctcttcttactgtatttattaaaacttgtaataatgtgatttttttcaaggatattagttcaaattgaaatggtttcacgmacacacggaaatctttaagttatttgttgaggtaccatatatttagggtgctaggggcaagtaatgttaatatgtgcaataggaactactggtttgaatgtgtaatgggtgatctctctgagtcctggcaacatccagcaaaactactgcttattctccaaagaatattgggagctctcaatcctcggtgatatgggaaagagaaatgagtatttgccct

SEQ ID NO: 14441 - DNA, 435 bp, Homo sapiens
taagaacatgtgtgggcacagatggacccagagtgcctgaggaaaaatgtccatgtaaaatgaaagaacggagcaggtagagggttgagctgaagcctggacaccagaccagtgtgatgggattcagtaggtatggcctctagggccagaggaaccttgctaccccacccatagtggssactctgccccaactgaggcatggcctcaraacatcaaagtgtgtcccagagagcaagagtacccaggaagggaagggtaaaaaagaggcattaggacagaaaagattctgtgccgacctggtagaagtgttgtatttcaaaaatcatatacttaatgaacataatgagacaggagcagagagaagctatgtgacattccctggcaacagtgcatttcatatgcagtgggcataacaagtttcagaataatcttgtg

SEQ ID NO: 14442 - DNA, 336 bp, Homo sapiens
aaaaggctgagaggagtaggaagatcaggagctagagggagactggagggttccgggaaaagagcagaggaaagaggaaagacacagagagacgggagagagaagaagagtgggtttgaagggcggatctcagtccctggctgctttggcatttggggaactgggactccctgtggraggagaggaaagctggaagtcctggagggacagggtcccagaaggaggggacagaggagctgagagaggggggcagggcgttgggcaggggtccctcggaggcctcctggggatggggctgcagctcgtctgatcgcccctcgagcctagtactcggct

SEQ ID NO: 14443 - DNA, 482 bp, Homo sapiens
  misc_feature 412,416,420: n=a, g, c or t
ctaaagtggttaagttgagaagtaaaagtataagcatataatatagtgttatggatcagaatatctaaagagaaattaaaagaaatttctctttgaagtagaggtaaagagggttggatcgggagacttgcttctcatcacaccttcttcaaaactatgaactgttatcatgtgcatgcattattaatactttagttttaaaaattaaattaattatttcaacaaacttgccttgagtttatgtaatgtgttaggcatggtatctggaagcgtgaaaattgaaacctttgtctgggcacaatcgctcatgcctgtaatcgcagtgctttgggaggctgaggtaggagaattgcttgagcccaggaattcaagaccagcctgggcaacatagaaagatctcatctctacaaanttanatwntcaaagaaaactagctgggcatggtggcatgcaccctggtcccagctgttcaggaagctgat

SEQ ID NO: 14444 - DNA, 469 bp, Homo sapiens
ctacagaagcatcagacagatactcaaactctcactttccccaaatcacatctcttaacttttcaacgccctccaccctcagctccctgcacaattcatgggaggactcatttcttgcsttgaataaccattttctaaacatcgagctcttcaccttccccaaggtggccaacagcttmcctggctgccatctttccttttgascttatctttccccattagtccctggtggcacctactctcagcccacctccctcacsacagtttccccttaggagacagcatgctggctgtgtcgcccaagcctgatgctggtgtaggcgctggaatcagcatgcagcaagctcacagtgcccctagtctgggtgcccgctgtccccgacaaatgtaaccacctccctgcctagaatacacacacgtcctccggtgcatgcacaaccacccagcatctttctttgtgatgatgtag

SEQ ID NO: 14445 - DNA, 419 bp, Homo sapiens
  misc_feature 322,390: n=a, g, c or t
ctcagaccaattagttcagagaaatgaagctgcaaatgacctttggtggctggtcagagtcctctcagccctgttgctgtcctaacaagcccagtaattgagttgcttgattagcacagtggagctgtttgagsctgctcccggatctaacaaggaggaaaacataacagggagtcaagtggtgggagaactattcaaatcaaatcaaaagtctaaacaaaagacaacacctctatttctgagagttctgaaaatgaactaattggaaattagtgattggaaattgagagctgtgcaatttcttccttggatgaggcatcantttgcataactccagtagatccaggagactttctctaagrctgcgcattgactctccacatagatatncagtaaagacaggttcttgctgcacgatg

SEQ ID NO: 14446 - DNA, 418 bp, Homo sapiens
atggtggccaagcagcacgggaaggtggtgatggccaaggtggatattgatgaccacacagacctcgccattcagtatgaggtgtcagcggtgcccactgtgctggccatgaagaatggggacgtggtggacaagtttgtgggcatcaaggatgaggatcagttggaggccttcctraagaagctgattggctgacaagcagggatgagtcctggttcccttgcccgctgggaccccaatagaactcagcccttccatgccagcccttcctgctgcctccctcctgtctggctcctggggcccatgcttagagcccaggctccagcctgagtgcttccgagctggcggactgcccaggggccatcagaggatggtggtgctgctgctgatccggggacgctgtcttccctcccatatg

SEQ ID NO: 14447 - DNA, 435 bp, Homo sapiens
atctatttttactccatgggcctctgatatgctgagatgtggcacggttatgattatggtatcaccgttacagaggcaaagggataaaggtctaccagggccaacgtaaccagaatgtgaggagagtgaagattcggtctccgctttgcacagtaccagaatgtgaggttgccactggagagtggagagtcggtctccactttgcacagttggagctgttctcctctaactcctttgctgggttttctgtttgaaattggcccctactcctctccagccctttactgggttttctgtttgaaattggcccctactcctctccagccctttattgggttttctgtttgaaattggcccctactcctctccagtgtctgctttttgaatccttctgttcgtgtgtgtgtgtgtgtgtgtgtgtgtyccctatgatac

SEQ ID NO: 14448 - DNA, 310 bp, Homo sapiens
atacttcatataagatatacataaggccgggcacagtggctcacgcctgtaatcctagcactttgggaggtcgaagtgggtggatcgcctgaggtcatgagttcgaggscggtyctgaccgacatggtgaggctctgtctctactagaaatgcaaaaagtagstgggcgtggtggcgggcgcctgtaatcccagctasttgggaggctgaggcgggagaatcgcttggacctgggaggtgaagtttgcagtgagctgagattgagccgctgcactccagcctgggtgacagagtgagactccatctcaga

SEQ ID NO: 14449 - DNA, 458 bp, Homo sapiens
aaccaaaattcaaatctcagttcctcattcaccagctgcgtmgcttgagaaagttgcttaacctttgaaagcctcaattttctcacatgaaagaaagctatcttgcagaggtgttacgaatgttagaaaaaaaattataaaaatcgccagcccaatgtctataacattttagctgcagttagtggtaaccaacttattattgtcagttttgtaaaattattaagttttctgataattaaaataatattgtacctatataaaaagtatcaaaaagcatgtaaagagatgagaacacatggacacagggaggggaacatcacacaccggggcctgccagaggctgggggcaaggggagggagaacactaggacaaatacctaatgcatgcaggtcttaaagcctagatgacgagttgataggtgcagcatatcaccatggcacatgtatacctatgtaac

SEQ ID NO: 14450 - DNA, 432 bp, Homo sapiens
agtctgccttactaccatgccgctctacgagggcctggggagcggcggggagaagacggcggtcgtgatcgactgggagaggcctttaccaagtgtggatttgctggagaaactggtccaagatgtataattcctagtgtgataaaaagagctgggatgcctaaggtatttaaaaaaaaaattagcaaaataaatgccatactataaaatgttttaaaatatgacttcaagtaagattgattaaaacagtactaaaggccagccgtggtggctcacgcctgtaatcccaacactttgggtggctgaggcgggtggatcacctgagatcaggagtttgagaccagcctggacaacatggtgaagccctgtctcaactagaaatacggaaattggccgggagtggtggcaggcacctctagtcccggctcctca

SEQ ID NO: 14451 - DNA, 443 bp, Homo sapiens
gagatccgaacgagacaccacgtcaaccggcgcggggagtcccgtgaagacatgagggcgccaggagcgcagtactggaatacctgagttttggctgggcacagaactgtctggaatacagactgcaattcccagccttctgtgcagttctgtgtggccatgtgactaagttgtggtacaatatgagtcacggaagaatagaagaacaactcagaggaggaagaagtcagacatagccagacacggctgctagcagttccaccaatgaaagaggagaccaggatgtttaaaacaggcaaacacaaggtgcgaaaaaccagaagcgaaaacttctgaggtcatttaagcaaggactatcgttatccccggaagcagagagaagttccctttgcccaacatcacactgcaagcacgtgttggagctgagattcaaacccaggcat

SEQ ID NO: 14452 - DNA, 415 bp, Homo sapiens
tattttgttttagagtcatttaatgtgtttttatgcacaataatagtgggaggttgttttgttgcatttgtttgtttgttttgttttgttttgttttgctttccatgtgggaaaagttaacattggaactgtttctagtaaaagatttttttcaggctgggcacggtggctcatgcctgtaatcccaacactttgggagaccgagggagctggatcacctgaggtcaggagttcgagaccagcctggccaacatggaaaaactccatctccactaaaaatacaaaagtagcctggtgtggtggcacatgcctgtaatcccagctacttgggaagctgaggcaggagaatcacttgaacctgggaggtggaggttgcagtgagccaagatcacgccattgcactccagcctsggca

SEQ ID NO: 14453 - DNA, 433 bp, Homo sapiens
  misc_feature 349: n=a, g, c or t
aaagagaaaaattgattaatcaaaactgactcaaaacagacactgatgctagaattagcagaaaagcccactaatatagcaattataactatattccatgcccaaatcaaaattatagagattaaaactacaatgggaccattatagatatttaaacaatctaaaagaaggcagaaaaagagcaaaaatggaaccaaaaagccaatgggacagaaagaatagaaataggtttaaaccttggctggctgcagtgcacgcctgtaatccttgcactttgtggggctgatgcaggcggatcgctgagggtcaggagttcgggaccagcctggccaacgtggtgaaaccatgntctctactaagaatacaaaggttagccacatgtggtgacacacgcctgtgatcccagctacttgggaggctgaggcacaagaat

SEQ ID NO: 14454 - DNA, 447 bp, Homo sapiens
ctttgggaggccaaggcgggcggatcagctgaggtcgggagttggagaccagcgtggccaacatggtgaaacccgtctctactaaagataaaaaaattagctgagtgtgttggtgggtgcctgtaatccagctacttgggagactgaggcaggagaattgcttgaacccaggaggcagaggttgcagtgagctgagattgtgccactgcactccagcctgggcaacaaagcaagactctgtctcaaaaaaataaaaataaaaaaaaaatcttagttccatggaattttaagcattgttccccctctaacctgtgtctaaagaattaaaagaatttggccgggtgcggcagctcatgcctgtaatcccaacactttgggaggctgaggcaggcggatcacgaggtcaggagatcgagaccatcctggccaacacggtgaaactcgtct

SEQ ID NO: 14455 - DNA, 461 bp, Homo sapiens
taattaaccaatgccggagctctacacgagccagactgttctgattgctgctttgcctctgctgtccattagggtagctgtgcccacctgaccttatcatatctagtttttgaaacatggcagggaaaatgattccacgtaacctgaccatatcagctgggtgactgaataaaacaccttctcagctcgctttcctctggcctgaagctttttgctgtagctgcttttgcaacaaaggacacagttgtaggcagtggatcctaaatggaggtttcctgggggactttagggaaagcttatattttcctgataaaactgtcaagtgtggccaagataatacttccccgttttctgactttaatgaaaatacaaggccctcaacagagatagctgacttctgactttgggagakaggtcagggaacagcagtgatgctgtcgctgatgtttttgagctattgt

SEQ ID NO: 14456 - DNA, 322 bp, Homo sapiens
gatagaaacatccagtgtaaaaaggaagttggaatgggagttggcgggcagtgaacgagtgtggggaaggattggtgctggggcaacaggaaggggcctggggcgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctgaaaaaaaaaaaaaaaaa

SEQ ID NO: 14457 - DNA, 473 bp, Homo sapiens
ttctccagctctacaagaacttctagtgctctgggcagctgcgaggggtcaagaaaccacatccccaaatccagcgggatctcagagagaaaggctgatgggaagctgcccagggctgacctggcacatgctgggaaaacccctcggtgccagggcaggaggcagagcgtctgcagctcctccctccccaacacagggggtaaggaatacagcagaacgggaatcgggcgccttcatgctgctgttaccgcccttggttcatggcttctttcacttggaaaccccaggaggtgggcattgctgtaccgcatgtgctactgaccaaaacaggccaaagctcagcgaggggtgggatcacctaaggttgtgcagcacctacgtggtggagtgaggatccgagcctccatctttcatgcattaattcattctgtctctggattcccctagaagcagaccctgaggcaaggatccac

SEQ ID NO: 14458 - DNA, 374 bp, Homo sapiens
tataccaaccatgggagaaaagggtggagtgagaacatagcaaataagaactggagtatttggtgctgcccagaaagctttgttggaaaaagatttgaagcaattggtggagtcaacagaatgggaggttagagaaagattaatgcgacggacttaaaatgggtcagagcagggatcccagbatgtccagactgaatggagggtggaaagagattaagtacaaagtgaggaagatggaagatggttgaatagtgctgaatatcaagagtgtacatatcatccaaaagagatgtttatatccactaaatgatacagctgaatgaagaaagaatgctggagaaaatgtaaggagtttgcagccaaaggagaaagag

SEQ ID NO: 14459 - DNA, 457 bp, Homo sapiens
taaatttatctttcagccaccgtgcccggcctcacaatgtagtcatttgtgtctgatctctctcagcataccgtgagtttgttccatgttgtagcatgttcaggaatgtgttcctgtgtgttgctgagtcgcattccattgtatggatgtaccacattttgtttatccatttgccagctgatgggtacttgaatggtttccagttttgactattatgaagaatgctgatatgaacatccatatacagttatttgtgtagtcatccgttttcatttctcttggatagatacccatgagagggattgtttagtcatatagtaatttatattgaactgtttaaggaactgttaaacaatttcagaatatctttttttttaagatagtgaataatgaagaggaggcagaattacccttagacctgtaatcccagcactttgggaggccgaggtgggtggat

SEQ ID NO: 14460 - DNA, 292 bp, Homo sapiens
  misc_feature 290: n=a, g, c or t
tatttggtctgtttgtagttttattactagatgatttttccggttgtccttaacaccccttcctgaggttcccttcacccctctctcttgccttccttccctttccctttcttcctgactagccccaagtcccttcatttgcatctgctatgcaatagtccctctcctttccttcttcttccctcagatttagctgatccttcctcccaccctggccttcctttcctctttcctcctcactctccccgtcatgctccctctgccccgccctcaaaaaaaaaaaaaaaaangy

SEQ ID NO: 14461 - DNA, 112 bp, Homo sapiens
actccccgcgccccgccatgtcgcgatccaaccggcagaaggagtacaaatgcggggacctggtgttcgccaagatgaagggctacccacactggccggcccggattgacga

SEQ ID NO: 14462 - DNA, 381 bp, Homo sapiens
  misc_feature 180: n=a, g, c or t
tcggttcattcccagctcggtccgggcccggccagactgggtggaaatctggctgaccttggtggtctgtcttggccagctggagcaaagggatgccaggggacgggtctcggtgcagtgactgccattagcttggggccgcagaaagtttctcccctttctcgggctcctgccaggccnttggctttcagagccaggcccgatttctagataacatttaagtttgcagaaaaggggatgccaagtcacggtggtcacggctgtgcgatgcagcctctgagatttgtattaatttttgtgagccggggaaaggccttgctgctttctccgccagactgatgtgtcttcccaagatgaaagtgcctggtaagggcgaggggc

SEQ ID NO: 14463 - DNA, 463 bp, Homo sapiens
agtcagttgtctttataatttttgtagtgctcaaattgttccattttggctaagtaacttcatattttttgttgtggttttgtttttttcaacccctttggtagttagttaattgctttctggtatacaatattccaggcccattttgtacatttcctgcctcagacctgaaatcaaccatatctctatggaagcctgtttccttgaatgggagtagtattttaatcacagtctagggcctagggaccatactttttaagatgataaaattttggctgggtgcagtggctcatgcttgtaatcacagcacttggagaggctgaggcaggaggaccacttgaggccaggagtttgaggtcagtctgcgcaacatagcaggacmwctttctctgccaaaaaattaacaaaattaacaaaagaagtagttgggcatggtgatgcatgcctgtagttctagctatgc

SEQ ID NO: 14464 - DNA, 449 bp, Homo sapiens
ctcccagtgggctgtaggcagggtcctccatgggtttccaacccccatcactggcaccaggatctcccacaggcactggtggtgtcatcacctgctggccccactacagcctgagtaggcctgagtggccgtggcaggctgagacctgtcaggccatactgacaagcagaggtcagagacactggtggggagctggcaatgaaaccctgtcctgggacatgggtttcatgttcttgtacacttcccctctggatcaggtgaggggtccagacagctgaccagacagcttgacagctggtcaagacggtcacgggagctctaggtgggcacaaccaacccctctcctgggaggcccctgccccactggggataggagcctgtgtccctggtgctaagcactctcttcacttgggccattgttggtgggggctcctttccggccagaccac

SEQ ID NO: 14465 - DNA, 96 bp, Homo sapiens
aggcatcattattatcctctttttatagacaagtttcaaagacactaaagaacctggacagagttgcaaaggcagctaaatgattcctgtgggaca

SEQ ID NO: 14466 - DNA, 444 bp, Homo sapiens
cattttcttagcaaattagccccctgtaccaataaagctcactgtaccagtgtaacagatggccatctaaatcagagatccttggagcatatcagcttctgcatatagatcagcaagtaaaagggctgagaggagcaggccaaaaatggagtttgggtataagatagtttggaaagcattgtgttaacatctctatgcaagtgggaactgttttgggaaaacaagcttttctccctctgccattccatcataagcaggcactttggagagcagctcaaggatgttgccatctggctcacatatgttgtcacgtttagggggcaaaccctccattctgccaaagaaagtcataattatgtatatttgtgagtgcagtgaaagggtgtaaatttaatgcagggctcatgtggctccatcagcatattcatgtgaaaaaccggagga

SEQ ID NO: 14467 - DNA, 461 bp, Homo sapiens
ttatttctgagctgaggttttttggcagaaagtttagttgaatcctcaaacacagctggctgtatgagctggagttttccacctcagggaactgaaatatattaattcaatcaaaaatagtttacttcctcaggggaagtgaactgattttgttttgtttacctccctcccaccccagcctttcactgtgccaagtcattgcctaaatttaatagcttgacattctgggaggccaatggctttcacctgcggagggagtggggcggtcagcaaggggtgcattttcagctcaccgtgctcaatttgagaaggaaagagacggacttgacacctcctaaggctttcaacccagtggagtagaaagccccagacactgcaacattcctgcctggcaagaggtcccctctgtgcctgaacctcactgaactgactccaccccaggctgtgccgcttcacagttt

SEQ ID NO: 14468 - DNA, 448 bp, Homo sapiens
tgattattttaataagggaaaacttcagcactctgggcaaaaattgcaacacttggatttttgtgttaacatagcctcagcttgatgttcacccacaacagtggcccatttctggggtccgatcttcttgttacagctaaagcttgcagccaagtgactaacagtgtccatcattcagaagcttagaaaatcggcatcgctaagacatttgggccttgacggagcaggaatgtgagctaaaaccctgtttgtcaagataggtttgtgaagtttgcttacctttaaattctaaarctttaaaaacttttatcacaattttttcactaaataatttgagcaggcagggcgcaatggctcacacctgtaatcccagccctttaggaggctgaggcaggtgcatcacctgtggtcaggagttttgagaccagcctggccaacatggtgaaac

SEQ ID NO: 14469 - DNA, 233 bp, Homo sapiens
atagctcactgcagccttgaactcctgggcaacatggcaaaattcaggctctacaaagaatacaaaaaattagctaggtgtcatgacatgtgcctgtaatcccagctacttaggaggctgaggtgggagaattgcttgagcccaggaggttgaggctgcagtgagccaagatcgtgccactgtactctagcctgggcaatacagtgaaaccctgtctcgaaaaaaaaaaaaaa

SEQ ID NO: 14470 - DNA, 466 bp, Homo sapiens
atactgagtgtctactctttattgagcctgtgttgtgtgtcaggaccagcagccaattctggatggaatgctgagcagttcagtcattcgttagaaagcagttgtcagcaatgggggactttttctttgctggggagtgctagatgactgaggttatattttacaaagattagtccagcagggaagatgaacaagaaatgaaaggagaccaattcagaggttatggcctaaaattcacatcactggtcacaagagaaatacggaaggcttgagctggatattgtcaaaaggggtagaaagaagagggtaaatgtgaagatgcatttaaaagcaaaaattcaggctgggcgcggtggctcatgcctgtaatcccaacactttgggaagccggggcggtggattacgagatcaggagctcgaggccagcctgaccaagatgttgaaaccctgtctctactaaaaatgc

SEQ ID NO: 14471 - DNA, 448 bp, Homo sapiens
caagagagtatatatttgcttttaactgcccctcactgttcatggccagtgtagtacatcctagtgaaaggaagaccatgcatcagaatgtttgttttgagcatttatttttagcagcagatctagaaattatattttcattttagggtatatattttttatttattatgaacattccaagactaaataattttagacatgcgtatgtgagtgcatgtgtacattgcatgcacgtgtgtatgtgtatgtgagagagtgagagactgagtctgagactgtgtgtgagagagaaggagagggagagagagggagagaaaagaaaaagacattcccttaatagcaggaggggtagaggcttactcagtctattatcataaagctctgctaatgtagcttctgagtcatgtgactgcagaaaaggctattatctcaatgaaaaggaaaccgg

SEQ ID NO: 14472 - DNA, 375 bp, Homo sapiens
  misc_feature 73,338: n=a, g, c or t
ctcttgcttatctggctgggcttttcccctgttcctctatctctccctgtctttgtgcctctcccttadmcantctgtttgtaagctgctttttctacacattcagtcctgaattttaattatccgatgttgccattttccatctctgcctgcctgtttttcctaagagagtgtgcatgtctgtctttctcttcctccctctctccccacttttcatttgcattcttcattagaatttgactagactgaatagaaattaaatgatactttgaagttctctagaattaaagaatgttcttttgaagtaaccagtgatcttttttgcttaccctcatcancagaatggatgaagatagatttgaastgtgtgctttt

SEQ ID NO: 14473 - DNA, 369 bp, Homo sapiens
acaacaattgaaaataaactgatatatttcatcacattaacaagaaaaagaaaaaaaacaatatcacatcaccagatgcagaaaaacatttgacaaaatccaacatccattaacgataactctcggcaaattaggaatagagggaaacttcctcaaagtgacaatgtctataggaaacctacagctaacatcatattccctggtaagaagttagatgctttcctggtaagatgaaaaacaaggcaagaatgcctgctcggccgggcgcggtggctcccgcctgtaatcccagsactttgggaggccgargcgggcggatcacgaggtcaggagatcgagaccatcccggstaaaacggtgaaacccgtc

SEQ ID NO: 14474 - DNA, 451 bp, Homo sapiens
ttccattcattctagaaaattataggggtagacaacagttgcgagtttgccaagaattgagctgaggtgggttgtcagccagaaaggggtacacaggggacttttagagtgaaggaactgttctgtgtggtactgtgtgttatacgcagtattagcccattctcacgctgctgtgaagaaatacctaaggctaggtattttatgaagaaaagaggtttaattgactcagttctgcatggctagggaagcctcaggaaacttacagtcatggtggaaggcacttcttcacagggtggcaggagagagaataagtgcaagcaggggaaatgccagaagcttataaaaccaccagatcaggccaggtatggtggctcatgcctataatcccagcattatgggaggccgaggcagggggatcacctgaggtcaggagttcaagaccagactagcc

SEQ ID NO: 14475 - DNA, 458 bp, Homo sapiens
ttacaccaagcctgcctcacaaggatgccaatctctcatcacttactgggaaagacccactcctcccattcatgataaggtaatgctatccaataaaaaccccaaagcaggcataaaatatgaagtagcgaaactcaggcaggcagaaagcagagtggtttagacatggctgctgtctgcagcagggmgaagttcctggcaacatgaccctgaaaataacaatgagtgactgaagctaagaaggaagaatcttccaaggactctgaaactagatattttctcaagccccacctatggacaaacacaaatcatggagaaataaagatgccagtctccaggaagcaccagagttaaattcattctggaatttaactcctggcattaacagttagctgggagattaaaacaaaccaacacaaaaacacaaaaaaataatcagtggaaaaaaaaaaaaaaaa

SEQ ID NO: 14476 - DNA, 197 bp, Homo sapiens
aaccttccagcaacaaattaaaaaataataacaaatcaaccccagcaccaaacccacccaggcaggaagaagccgcccctcctctggggccatatttttctgctgggtcacaacattctcctctccctgactggtgtcagattcatcaaacaaaaaataaatctcgaagaaaaaaaatgcactcaaaaaaaaaaaaa

SEQ ID NO: 14477 - DNA, 441 bp, Homo sapiens
  misc_feature 233: n=a, g, c or t
tgtgatgatttgattcaggtatagcccaaattagtaaggggctttagctgtaaactgaaaacaatattcacaccctctcctgggcctgtaagtctaaggtgagaatttcaggatggaaaatgcaatgtaaagcttccacaggaaagtattcgggtatgtaaggtgttatttctgaccagagccctagttctgcaataaccaaaaccaaggagtataaataacaatcaggctcngggggaatagaaagcaggctttagacaatctgtccatttctacagtaaaattggagtgagtgtgtatatctacttaaaacttaatagaagtgacttctactttttgggctattccagaagtattttaaaattattatttaaaattttgaagccccatttcaaatcttgccgaccttagttcaaagccccctgagagatcacttttaga

SEQ ID NO: 14478 - DNA, 61 bp, Homo sapiens
tatgtcaagaaattacattttgcatgtcttatggagatgctgttaattgsttcagtgagtg

SEQ ID NO: 14479 - DNA, 151 bp, Homo sapiens
cactttaaagtttctgcagtcctttgacacataggatctcatggagcctcacgtctactcccttctgcagatgaggmaaccgagaraagtggcccaaggtsacgcaactctgagatgccacatttcatttgatcttgtacacattttcttt

SEQ ID NO: 14480 - DNA, 422 bp, Homo sapiens
tacagccggagtcaggccaaggggttgcttggaaggaggctctgtcgtagmgggccaaggagacctgcctcattttgctctggtgtaggatggcctgtgggtgcccccagccttgcagacctgtgcacccctcagaggtgccagccttttcttggagagaggaggcagcccggctgctggaacaagcacctgtaaacctggattagaaactgcctggagctgagcatttctgagtgtgcctggcacgccccctgctggccactggctactggtcaggcgacacccctcggagctaggaaggaagcggtccaggaactgacccctgctgtgaccgtggctatcccattgaatcctcccaggaacccccagcattgcggggattcacacacagagacctcctttagcacacaggagcccggaaa

SEQ ID NO: 14481 - DNA, 329 bp, Homo sapiens
ccttatgcttagaaaattgaggataaggctgggcacagtggctcaggcctgtaatcccagcactttgggagaccaaggcgggtggatcacaaggtcaggagatcgagaccatcctggctaacatggcgaaaccccgtctctactaaaaatacaaaaaaatagctgggcgtggtgtcgggcgcstgtagtcccagctactcaggaggctgaggcaggaggatcacttgaacatgggaggcggaggttgcagtgagccaagatggcgccactgcactccagcctgggtgatggcgtgagactccatgtcaaaaaaaaaaaaaagtttgggg

SEQ ID NO: 14482 - DNA, 93 bp, Homo sapiens
aaagcttgttcttttaagtacttttttaaaagtttaaaagttttcttttttaagaaggtaaagcagctcaatctgcaaaactgtgtctttctt

SEQ ID NO: 14483 - DNA, 118 bp, Homo sapiens
aaaaaaaagagagagaaggaaaggagagaaggcaggaagaaggcaagggacgagacaaccatgctgtgctgtatgagaagamccaaamaggttgaaaaaaatagatgacgaccaaaag

SEQ ID NO: 14484 - DNA, 401 bp, Homo sapiens
  misc_feature 337: n=a, g, c or t
taacttttacttactgagcacctactctttgttgggcaatgtgctaaatgtttctaaactaagaaagtagtacatgcttaaggtgaaaaaaatattaaagttttttaaaatataaaacaggtcttacscgtacaccagaacttctagcctccttttcagaagctaacaatgttttwwtgcatatttttctagaaatgttatacacatgttggccgggcacagtggctcasacgtataatcccagcactttgggaggccgaggcaggcagatcacgaggtcaggagtttaagaccagcctggccaacatagtgaaaccccatatctactaaaaatatnaaaaattggmagggmttggtggcgggcactgtaatcccagctactcgggaggctgaggcaggag

SEQ ID NO: 14485 - DNA, 344 bp, Homo sapiens
cagttgagtctaggatgtaaggcattctaacaagtcaactctcctgatcttttagaaaagctagtgtcggctgggtgcagtagctcacacctgtaatcccagcactttgggaggctgaggcgggtggatcacctgaggtcaggagttcaagaccagcctggccaacatggcaaaacctggtctttactaaaaatacaaaagttagctgggtgtggtggcaggtgcctgtaatcccagctactccggaggctgaggcaggagaattgcatgaacccgggaggcagaggttgcagtgagccgagattgcgctgttgcactccaactggggccacagagtgagactc

SEQ ID NO: 14486 - DNA, 143 bp, Homo sapiens
tttgtttgtattatgtctgaaatgtgtgagagtattcgtgataacggtatttggttccaaaatcccagtaacaccacaaacagatgtggtgtattttctgctttatgatttcttatgaagtttctttsktkctttttttgttt

SEQ ID NO: 14487 - DNA, 460 bp, Homo sapiens
accgtatggattttccaagtgttccattaaaaccaggatgtagagcaccaaaagatcaggaccacgggaggagcagcctcctccacctttactaaggcacaacctggcattgtatgcaatttagtacttcagagtaaaaacctgcatgcccaatgttatgcaaagcgattctagcatgaaataaattttgtatcatggtttctgtatagtctaaagcagatttgttttcctgaagcagtcggaggtttgcagagacacacttctgcatctcgaataaatatagtattttcccaacagaaacagaggacagtagcttggctttggtctgattctaaaattagtggggtgggggggaaggatgatatttttgaaaaacacatgcttgagttgaaaaaatgcaacatctcaagctttcactgcagctcacaacatttcctggaaagagagcaatgatgcttta

SEQ ID NO: 14488 - DNA, 441 bp, Homo sapiens
caaaaccaaacaaacaaacaaaaaaaaaccacacccaccttgagccatgtacagttcagaattgtgggaatacagcaatgaaaacagtagttcctgctctcatgggtcttacatggtgagggggacaggcgatacacaaatgtacaaataattacagtcagagtccttatcatatgagaagggtcatctcagaaagtaaatggtgatgctgaaagaatgggcctcaccaccgagctttaatgggggatggttagtaataaagaaatacaagataatgtgggagctctsstcctcctctaaacattttcctcctttggtttccattttgccgacgattggctattttggcacttcctgagggcttactggggagggcagatggtgacctggcttaactacttaccgsactgcagaggtgccagcgtgatacaagccaagtga

SEQ ID NO: 14489 - DNA, 334 bp, Homo sapiens
  misc_feature 272,289,297,303: n=a, g, c or t
tttgggggaggggggacgcgggagggtgcatgtcttgggaaaagggggtgacagacaacttttgagagggcagcagactccctcagccatgagaaccagctttggggaggaggccgggaatcaaagcgagtccagttgatctcccctgacaatctggaaggttcattttgccctcagtgccagccaatccgggcaggaccctcgaagagagaccgagggtcccagaggacaatgctacaagccagcaaatgctgccacatctctgcctgatngggggtggggatgggtngggggatnggactnggccaagggatctgggtgggcatttttaact

SEQ ID NO: 14490 - DNA, 443 bp, Homo sapiens
ttttagaaacggaggctgatgacaccttttgagtacttactgtataccattctttctgccaaaaaagtctcgtgtattgtttcttgatcctatgaaggtagacacaattatccctgttttgcatttcaggaaaccaaaagcttaaagaggccataccctcaactttttcaatttagcaccaagctaatctgagagtgcttgaaggcttctctgatgagcccagagaaagacaagaggaagctgacattaaggatgaggttgatttcatttcctatgtgatacacggagtttaagatacagttgtgggccaggcacggtggctcacgcctataatcccagcattttgggaggtcgaggcgggcagatcagttgaggtcaggagtccgagaccagcctggccaacatggtgaaactccttctctactaaaatacaaaaattagct

SEQ ID NO: 14491 - DNA, 420 bp, Homo sapiens
cacttggcaagataataatgtaattgaaatttcataatcagtagctcctgctggaaacttgactaagagatcctttaatatccattggttaaatagtaaaacaggccacatggtaataacagstctcacttaattctctctcatcatttgatgtcttcaattgtttatctttaagcctcagtgtatgtctcaataccattatttaaactgggattttcatactactattatttttactttgttgctgccgttggttgttgttgtctgaracggggtctcacacggtcacccaggctggagtgcagtggcaccatgggtcatggctcactgaagccttgatatttttactttgtattttccctttttraactttgtatctgcaagccctgtggtcccagctactcaggggctgaggtggga

SEQ ID NO: 14492 - DNA, 354 bp, Homo sapiens
aagcgaagagatgggtctgcactttggaggagccggacactgttgactttcctgatgtgaaatctacccaggaacaaaacaccagtgactgcagcagcagcggcagcgcctcggttcctgagcccaccgcagctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagcagaagatgccatctcat

SEQ ID NO: 14493 - DNA, 324 bp, Homo sapiens
cgtaacccacaaaatccttcggaaggccagaggaaacctggagcttaggcctgggggagcccatccaggaacatgcagtcccagcagaccaggctcctgagaagaactttcagccaataaagcttgtgcttcccccaccgagctcacgctgtctctttgttccaagtgtggttcctatttattgaggaagaaagagctgtctggccaaaggaaatctattttttcccttcatgttttctctctgaaagttggcttgagagttgttgtcagaaaggtgcaggtgctccacaaacgggtggtaaaaaggcctcgagctcttggatg

SEQ ID NO: 14494 - DNA, 408 bp, Homo sapiens
cagttttaaaaattgaaaacaaagatctttggagatcagtgtgtggttgatggtagcattaaatgtctttcaccatggaataactttttaaattattatatcattaagaatataaaaacatcctggttttggccgggcgcagtggctcactcctgtaatctcagcactttgggaggmccgaggcgggtggatcacgaggtcaggggatcgagaccatcctggctaacatggtgaaaccccgtctctactaaaaatacaaaaaaatcagccgggcgtggtggagggcgcctgtagtcccagctactcgggaggctgaggcagggaaatggtgggaaccagggggtggagattgcagtgagctgagattgcgccactgcactccagcgtgggagacagagcaagactctg

SEQ ID NO: 14495 - DNA, 417 bp, Homo sapiens
aaaatgtgcttctacctttgctctaaaaatgatatttgtaatattttatgttacaatatgcagtgtctctcctgcagagaaatacaagagaaattttctttttgactttaggttcaaacaaaaacaaacaaaaaatatatacacccagcacagtggctcacgcctgtggtctcagcgctttgggaggccgaggtgggagttcaacccaggggttcgagaccagcctgggtggcatgatgcgatcccatttctaccagtttttttttccattgcccagtgtggtggcgtgcacctgtggtcccagctactcggggggctgaagtggggggatcgcttgggcccgggaggttgaagctgcagtgggccgtgtttgtgccgctgcactccggcctgggcgaaagagtgaaaccctgtctc

SEQ ID NO: 14496 - DNA, 446 bp, Homo sapiens
atttttcttcaatcattgagtgaaaaacctttaactttggcctgcaatagtcatttgattattttttcattttgtaaataatgttaagttttgtaataaaatagttatgttctgataccagtacagtttctatggttgtaattgaacttgaacagacttttaaaggttaaaaattatgatttaaatcttactctgagactctataaaaagaaaaaaaaggtagcatggtggaaacactatcttttcttttttgctagaataagtgtctttgtgcaaacctaaatcacagatagggaatatactacataacctgcagttcttttctttgtgaatcctgacacactgatagatgggggattgtcgatcagagaacttattaatatttagtactggaagaactctgtctccacagttgccagtaataaaaagaaacattggctactatg

SEQ ID NO: 14497 - DNA, 306 bp, Homo sapiens
gatgggcccaaaagcacaagaactggaggtttcagaagacgaggcagacgtggctcctgcttcacatgtatgacagtgacaaggttcccgatgagcacttctccascctgctggcctacctggaggggmtgcagggccrggcccgagagctgacggtgcagaarrcggaagcctgatragggactggatgagaagggctctgatccccccctgccggggagggcccagcgcatccgacaggtgctgcagctgctctcctagtgggttcagcgcggggcggggccgctgccagtgcagggctgcctc

SEQ ID NO: 14498 - DNA, 433 bp, Homo sapiens
taagacaggatcttactatgttgcccaggctgctcttgaactccaggcctcaagcagtcctcctgcttcagcctcccaaaatgstgggtttataggcatgagssaccgtctggcaacagtggcttcttgatggacatttgggttgtwtccaaattttacsataatcactgctttmttttggaatgagagtcaaagtgtttcatggtttttaaatgtttatatctagtaatcaatcttctaggaatctatcctaaggaaacaatcgcagagaaagaaaagcaaaactatccacagagatattcattgtcaggttatttagaatattgaaaaactggaaactatctggccaggcgcagtggctcacgcctgtgatcccagaactttggaaggctgaggtgggtggatcacaaggtcaggagttcaagrccagcct

SEQ ID NO: 14499 - DNA, 453 bp, Homo sapiens
  misc_feature 396: n=a, g, c or t
actattactgcacgtccattttctagaaaattcctggcatctgggttctatgtaaacgtaagaacttttcctttactgtgagttagcaatccggatgtgttttgtggaagattatgccctaagcccttagaagggaggacactgagtttgggaaaagtcactacctctgggmttcattttttgccctaaggcaatgaggttatcctgatgctgaggaatctatggcaaattttcctttctccctcaaactatcctgtcaaccttttcatattagaaggcagagaatggaaaatacacatacacattctcctttaaaaaaaaaaaatssaaggagccttgagaaatggacatgatccgtgtatttcttgacctctgagataccatggctaatcccanccaaccytgcagaaatactgcttctggargttccatttgcctccattctgagtgctt

SEQ ID NO: 14500 - DNA, 171 bp, Homo sapiens
agcgaaattagccgggtgtggtggtgcatgcctgtaatcccagctacttgggaggctgaggcaagagaattgcttgaacccagggaggcagaggttgcagtgagccgagatcacgccattgcactccaccttgggcaacaaaagcaaaactctgtctcaaaaaaaaaaaaa

SEQ ID NO: 14501 - DNA, 453 bp, Homo sapiens
cagggatattttctcaaaatttcaaatataccacattgaggaataattttcaaaggtctttcgtgatataaagccttttctactaccatgggcttcttggaagcagaagtgagaaattgctagataaaactgattatgttgaagccattcacttcttactgtgtggtacgwwttttaaaagagcaatttttggccaggcacggtggctcatgcccgtaatcctagcactttgagaggccgaggtgggtggatcacttgagctcaggagttcaaggccagcctgagcaacatggtgaaactctgtctctacagagaaatacaaaaattagccagacatggtgccacatgttgtagtcccagctactctgaatgctgaggtaggaggattgcttgggcccaggaggttgaggctgcagtgagccatgatcatgccactgcactccagcctgggca

SEQ ID NO: 14502 - DNA, 374 bp, Homo sapiens
ttcattatctttghtaacattgtacttttccttgatgttcttaaaaggtatttccctcagattactcatgtttatgttgtgagsatgtagaaacagtaatgctaatgcatggctagttgcctttttaagattgtgacaccaggcttacctatttaaagtttagtatatagagacaatytwaatggaaataactacwtgtagactattgaagaatgatctctttgtgatttaagaagtggctggattggaacttttaatatgctaatgtggaaaattaattacctttatgaaggtggtttattacaaataagcacactaacccctcggaagttgttttacctactttaaaagttttaatggaattgcacctctgt

SEQ ID NO: 14503 - DNA, 298 bp, Homo sapiens
  misc_feature 171: n=a, g, c or t
tgatttattctctgatgatcttgtttattttcttttagaattataagcagaggctgggagtagtggctcatgcctgtaatcccagtactttgggaggctgaggtgggaggattgcttgagcccaggagtttgaagccagcctgggcaacatagtgaggccctgtctcaccnaargrtaaaacaaattagcccagtgtagtggcacmacatgtagttttaactacttgggaggctgaaacgagaggattgmttgagccctggagtttgaggttgcagtgggctatgatcgcactactat

SEQ ID NO: 14504 - DNA, 475 bp, Homo sapiens
  misc_feature 78: n=a, g, c or t
cttttaactgcagatgtgtccgtctgagtgggaacagtgaacctaggggtacatatgtttgavttcttgtatttttanagaacaaaataaacatcttagtggactttggatgagaagagtcccattcgacatgaaaaattgatttattttctccgcaaaggaaaaaagggggagtgggggggaaccttttaaacaagtgagccttccaagtgggacagccctggccagtccttttgaccttagaatgaatcaattacttttactttgaagaccttaaacagagtgttgctttttttcagggaactaccccggttactgagaatcagtgtccccgctccctaatgggtcagcctgtttgagtaagccttccctagcataragaaacaacttcccaagtgacttatctctatgccaacgttttttcaatgatgagrtactttatragctctccaaggcagaaagttctcatgttaat

SEQ ID NO: 14505 - DNA, 416 bp, Homo sapiens
  misc_feature 224,256,261: n=a, g, c or t
atggcggcggcgccccaatgccggaskcggcccctgagacagcgggttccgccgaagctccgctgcagtacagcctgctcctgcagtacstggtgggtgacaagcgtcassccggctcctggagcctgggagcctgggcggatcccaagtccagccaagaktgaggagcagaagatgatcgagaaggcgatggaaagctgsgctttcaaggstgcgctggcstnsgtgggaggatttgtcttaggaggtgcatttngggtntttaccgctggsatcgataccaasgtgggctttgaccctaaggatcsttaccgtacaccgactgcaaaagaagtgctgaaagasatggggcagagaggaatgtsctatgccaaaaatttcgccattgtgggagccatgttttsttgtactgagtg

SEQ ID NO: 14506 - DNA, 432 bp, Homo sapiens
tacaatgtgttgaaaatagtactttacttttgtggcttcttccccaaagcccataacctcagtctaatcatgtggaagacatttattctgcagaatgcstgaccagtatgcctcagaactgtcaaaggcatcaaaaacaaggaaagtctgagaaacataagaaccaagaggagtcsaaggagacatgaggactaaatgtggtgtggcattttggatggggccctggaatagtaaaagaactttagggaaaattacataaatctgaattaagtatgaactttagttaataataatgtatcaatactggtcattaattataacaaatgtgccatactaatctaagatgcttataataggagaaattaggtcctaaaagataaaatttatttattttttacaacctaatttttaacactagaagttttttttttt

SEQ ID NO: 14507 - DNA, 350 bp, Homo sapiens
  misc_feature 102: n=a, g, c or t
gttttcggctgcagaggggaaggcggctaccagtgtaaagccagcctgaggttcttgatagtccacaatgggtgaaccacagsaagtgagtgcacttcsasnacctccaatgcaatatatcaaggaatatacggatgaaaatattcaagaaggcttagswcccaagcctccsccawccaataaaagacagttacatgatgtttggcaatcagttccaatgtgatgatcttatcatcsgccctttggaaagtcagggcatcgaacggcttcatcctatgcagtttgatcacaagaaagaactgagaaaacttaatatgtctatccttattaatttcttggaccttttagat

SEQ ID NO: 14508 - DNA, 342 bp, Homo sapiens
agttgggacgacaggcatgcaccaccacacctggctaatttttgtatttttggtggagacagggtttcatcatgtgggccaggctggtctcaaattcctgacctcaaacagtccatctgtctcagcctcccaaagtgctgggattacagatgtgagccaccgcacagggccaatcaatcaatcaaccaatataaattaaaaaaacaaaaaacttttgcgtcatgaacctccctggggatcaactccagataaagaactgctctgggactgtaatttgccagattccatttcatgttaaatacaaaagacttggggattttccaaaaaaaaaaaaaaaaaggc

SEQ ID NO: 14509 - DNA, 369 bp, Homo sapiens
  misc_feature 338: n=a, g, c or t
attaaattattttcccctgcttaatcaccttcagaggcagcccaggatgtgttgagttacatcgmactgcacagcccatgtctcttccacttggctgttcagcgtgatctcccctctcctcgacacggccagcccacaccggcctccgtggccgccctccccatggcaggcagggatggaggcaggctgaggcacctgtcctctgaggcctgcggaggctctctctcctgtgcttctctgaggatgtcgctccgccctactcaaggagtactagacccctctgtctgctgaggtcagcatcccagaacacggctccagctgacgattgcacttggcanccatatcytccgtgcgasaaactggtgtcag

SEQ ID NO: 14510 - DNA, 450 bp, Homo sapiens
  misc_feature 387: n=a, g, c or t
tgtttgttgagtaccttctatgtgcttggtattctgtaaattttaggcatatgaaatagaatgtacacattgttgacctggtggaacttaatgtctggacagacaggcagtaaacaaaccaataaatatctcttagttggtggcscagattctgaagaaaaatgaagtaggamaaggagtataggaatgctgtgtgtgagggtggttgggtgagttgcagaagtttgtatttgtaaaaattgataaggggctgggtacggtggctcatgcctgtaaatcccagcactttgggaggccaaggcaagcggatcacctgaggtcaggagtttgatatcagcctggccaaaatggtgaaacgacgtctctgctaaargtacaaaaattaanccggcatggtggcacgtgcctgtaatcccagctactctggaggctaaggcaggagatttgctg

SEQ ID NO: 14511 - DNA, 89 bp, Homo sapiens
actagaattacagaaacaaaattggccgggggtggtggcgggtgtctgtvgtcccagctgctcgggaggctgaggcgagagtggcgtga

SEQ ID NO: 14512 - DNA, 322 bp, Homo sapiens
tagaagcactgagctccctgtctctggaagtatttaagaaaaggctgggccaggcacgatggctcacgcctgtaatcccagastttgggaggccgaggcaggsggatcacctgaggtgaggagtttgagaacagcctggccaacatggtgaaacctcatctstactaaaaatacaaaaattagccaggcgtggtggcaggtgcctgtaatcccagctacttggaggctgaggcatgagaatcacttaaacctgagaggcagaggttacagtgagccaagatcgtgccactgcattccagcctgggcgacagagcaagactct

SEQ ID NO: 14513 - DNA, 249 bp, Homo sapiens
ttatggatgccatgttatgggagcctgtcacctgctaaccgagatgagaaattacaggttataatccccttcctgctgtctgaggagcccagcttcaaagatagccaggcaggagttattttatagaatggaagtaatttctacggggccaagcaataataaggaaattggaagtcaaggactatcttccgaatggagaagaagctccatcaaccacagaaggaaattatgatcactcctgccatcctg

SEQ ID NO: 14514 - DNA, 418 bp, Homo sapiens
  misc_feature 406: n=a, g, c or t
cacttagcaaaaatttgggcccaaaaatatatatataggagaagggattgttggtgggtagagaggcctggagatcaagagcaagagatgagataaacacaagtttggaagccattggsttgtgaggggacctgagcacttagaatagaggagacccctcagggagagcttgtatggaragagagaaaggtgcatcctgaccccatcctgggcatttctctttgaaactcagccttgttataattcatttctaattctgatatcggcagtgagggttcatctaatctattctcatcacttcttgagccgtctcagctctcactggtcctggmtcttgsctggagatgattttactcaaaattctagtccaggatttagaattggtctaartacagatgtgcatcangaggctatttca

SEQ ID NO: 14515 - DNA, 373 bp, Homo sapiens
taaagaaaagctggtaccattccaacagaaactattacaaaaaattgaggaggagggactctcccaactcattctatgaggccagcatcattctgataccaaaacctgtcagagacacaacaacaacaaaaataaaaagaaaagaaaaattcaggctgatatttttgatgaacatagatgcacaaattctcaacaaaatgctagcaaactgaatccaacagcacatgcaaagttggtttaacatatgcaaattggccgggcacagtggctcatgcctgtaatcccagcactttgggaggcctagacgggcagatcacgaggtcatgagatcgagaccatcctggctagcgcggtgaagccctgtctctactaa

SEQ ID NO: 14516 - DNA, 402 bp, Homo sapiens
tgattatccaaagaattgaaactcctagcacatccagtttttacaacagatttgcagctcattccttaccctggttaggtcactacttttgcagattttgctggcactgatctggagatctgcagatctggaggagacgggaaggagtcgattcttaaataaggatcagtgaggcatcctgtcccaagctactgtttggtggggatctgggttcatctcacccacagagggaggatctttaagaggagaaaaaagccaagagggaaagccagatttmmmtgttstaggggactagccaaatgcctacatcagctgtcccstccctgttgtctccaagtaagtttgccagaaaaggttttagcaaagtgctacaactgtgtctttataggaggataggcctct

SEQ ID NO: 14517 - DNA, 440 bp, Homo sapiens
ttagaagtgcgccttctttttgtgttatagtggtctcccagccacagccaacgctccaagtccccagctgtgacacacctactgaattactaccgtgggtgggaggccgccgtgggsctttccattacgagcctgcttgccgagccctgggcttgtgcacagacaaactgcagarmtggtggaggccactgccaggccgagataagaaagagatggggagctgctaatctccccctgtccagcctgttggtgagggctgggatctttgctcttgcagtcattccagagccctggactaggaggtaggaagatctgaattgtgggcccmaactctctttcggttattagctctgtgaccctaggcaagtcacctsatcccttggatgcsasscgttgcttctrtaacatggtcccaaaggtgcctgtcttgtccacctgat

SEQ ID NO: 14518 - DNA, 147 bp, Homo sapiens
taaacaggctgccatggagaggtctgaaaaagctaagcaactgcgagcacttaggaaatacgggaagaaggtgcaaacggaggttcttcagaagaggcagcaggagaaagcccatatgatgaatgctattaagaaatatcagaaagg

SEQ ID NO: 14519 - DNA, 461 bp, Homo sapiens
tctgacattttcgtttaagcaaatacaggtgcatttaaaacacgactttgggggtgatttgtgtgtagcgcctggggaggggggataaaagaggaggagtgagcactggaaatactttttaaagaaaaaaaaacatgagggaataaaagaaattcctatcaaaaatcaaagtgaaataataccatccagcacttaactctcaggtcccaactaagtctggcctgagctaatttatttgagcgcagagtgtaaaatttaattcaaaatggtggctataatcactacagataaatttcatactcttttgtctttggagattccattgtggacagtaatacgcagttacagggtgtagactgtttagattccgtagttcgtgggtatcagtttcggtagaggtgcagcatcgtgacacttttgctaacaggtaccacttctgatcaccctgtacatacatgagc

SEQ ID NO: 14520 - DNA, 448 bp, Homo sapiens
  misc_feature 253,290: n=a, g, c or t
cattgatctatatgtatatatgtgatgttttcatatatatatgtgtgtgtgtttaaattttgtatcatcaggactgacacccaatttgacactttttgtatstagaagaccctccaaaaaaggaaccacataagcacacaagaaaagagtgctatgatgttcttagcatttgstatcatagcctatttttatctagatttttaaatgtagcttgtcataacaaaattttaattacaattggsttgtatgagangaaaaagtatttttattgttttgagtgatgacgcagngactcagtgaacttgaaaatrgcattgcttcgtgcactttgaataccaatcaggtgttttctgtgctactagttgtcacgttgcattcatgttcacctcctgatttaagtatctcgggtgtgcccagccactaragcactctggactaatcgctaaag

SEQ ID NO: 14521 - DNA, 437 bp, Homo sapiens
ctgttgcctgtggagtctctgctgaaatgaatcaggattcgatctctaggrkgagacggaaaatgaaagcatgttgtttgccaggacactgtgggtttatattgatgtgtaacaagttgatttggaacactggactctcattctgttattctggttttgtttwttttgttttgttttawttcttttgtaaaggcaatgagctagtcccagaaaggatccttcagttacatacaatttgtttaatgaaatgtcatggctctgttcatatttttgtcttgttcttccaattggtatatacaactttcagagcctcttgtatttggaaggctggaagggcccagactttggaatagtgtcttggtttcactgtttttgttttgattktttttttgttttgattttttttaaactaaggctatataaagcttgtggattaa

SEQ ID NO: 14522 - DNA, 333 bp, Homo sapiens
agtaccgacagaagatgcgctggctgaaggcggaggggcctgggcgcggggtcgagcaccccctatccggagtccaaggcgagaccctcacctcatggagcctggccacggacccctcctacccctgccttgccggcccctgcacatttaggatatgctcctggatggggactgggctgtagccagggcctctgtcmcccaggatgtcttgtggtggcggtcggccgttctgccccccagggcaccccctgttgtaggcactggctagggasgggcaggctccttcctgmccctcgagacactcttgggagatgcattttccgtctggctcac

SEQ ID NO: 14523 - DNA, 384 bp, Homo sapiens
attcattcctcttgtcgccggtgcgttctgcctgcatctttgctccagctaagccagctcctctaggcctctggctgcccaccgcagtgtgctctggactggactctggaccatgcgttgctgggtttgctgctgtgatgatggaggtgctgcttttgtctgtctgatgtttatactttgtgggtgtggagtgtgctaggaacatctcatatgtgccaggaactgstctttggaaaagtcagtccaggttagaaacatagactgtcgccgggcatagtggctcacgcctataatcccagcactttgggaagccaaggtgggcagatctcttgacttgaggtcaggagttcgagaccggcctggccaacattgtgaaaccccatc

SEQ ID NO: 14524 - DNA, 288 bp, Homo sapiens
gcggggcccaagatggcggccagccggtaccggcgttttcttaagctctgtgaggaatggccagtggacgagaccaaacggggccgggacttgggcgcttacctgcgacasgggtagcacaggcctttcgggagggagagaatacccaggttgcagagcctgagagcctgtgatcagatrtacgagagcttagcgcgactccattcaaactactacaaacacaagtaccccccagagaccaccagcttcagtggcctgtcgttggaagagtacaagctgatcctgtcc

SEQ ID NO: 14525 - DNA, 466 bp, Homo sapiens
atatgaaggatcaagatcctcaactcacacatgtagacaaacattagctctttactctttctcaaccccttatatgattttaataattctcacttaactaattttgtaagcctgagatcaataagaaatgttcaggagagaggaaagaaaaaaaaatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttmcssctgtaggactgactgttggctaattttgtcagcacagctgtggtgggaagagttagggccagtgtcttgaaatcatcaagtagtgatgtgatctctttgcagagctataga

SEQ ID NO: 14526 - DNA, 140 bp, Homo sapiens
gggttggccgggtgtgatggcatgcgcttgtggtcccagctgctcgggaggctgaggcasgmscatcacttgaacccgggaggcggaggttgcagtgaactgagattgcaccactgcactccagcctgggcgacagagtg

SEQ ID NO: 14527 - DNA, 129 bp, Homo sapiens
cgttgtggcccacttctatgccaagcgtctgacgctcgaggagctgttggctgtggaggccggcgcaacacgcgcaaggaccacgggctggaggtgctgggcctggtgcgagtgcccmctgtataccct

SEQ ID NO: 14528 - DNA, 360 bp, Homo sapiens
  misc_feature 243,248,291: n=a, g, c or t
ctagaatatagtgagatactcaaaggaaaatgaatcattctcccaaaaagacacatgaactcgtatgttcactgcagcactattcacgataacaaagasatggaatcaacctagaaggctatcaatggtgcattagattttttttaaaaatgtggtacacatwaaccttcaaaaataatttatgactaagtcsccaaaagcaattgcaactaaaacaaaaatggacaagtagaacctaattanactanagaactttgccacagcaaaagaaattatcagcagagtgaaagntaacctacagaatgggagaaaatattcacaaactacatatccagcaaagatctaatatctggtatctat

SEQ ID NO: 14529 - DNA, 504 bp, Homo sapiens
tcgttttatttatttatttgtttatttattttttgtgacaaggtcttgctctattgcccacactggaatgcagttgcaatcatagctcactgcagcctccatctcccaggctcaagcaacccccccatctcagctactcaggaggctgagatgggaggattgcttgagcctaggactttgaggccacagtgagttatgatcacaccactgcacagcagcctgggtgacagagcaagaccctgactctaaaaataataacaataaaatwaaatwaatwaaaatgagtsactgcsgcttctatacccaatcatagaattgtcccctctttctgacagttacctaatttagggcaagtcaccatgaccttaggccttcctccaaaatcattcagctagcttcttccaaccagattctttctaacaccctcttactgacacaacccacaattctatatggtgtgtgttcttgatgcaatcagcaataatccaacatctttaactacag

SEQ ID NO: 14530 - DNA, 457 bp, Homo sapiens
cacagaccttggtgataactgtgcttcaaactgtcttaaacaatgtttgtcacctttcccctagttgatgtaaagtatataaattgttgctatttgtttgaactattattgatgctagccaagcagtatacttgatgtgaagatgtcatgctatcacaatatgctaagagctcacaamaataagatagaatttccaggacaaacatctttggaattgtgagtgaaggatatagtggcaggcttgtccctctttaattaatactcttggtatttgttgtgatgggaggatgctgttactaggagagttttgagatactgcagtggatgtgggatgtatatgaacttcttcataatgtactcstgggaactgggtaggacatatccatattgtagttcccaaggtgtctggttgagagttagagaacttttaaatttctttagccagacaggtctctat

SEQ ID NO: 14531 - DNA, 424 bp, Homo sapiens
taggctgtcaagagtgcgatttttatgcgttggggtgggtgggggaggggagttgtgggagggtaggggagggaggaaagctgtttttcatggtgagaaataataatgatgactaataataataaaaaaaactggaaaatgtaagcaaggtggacgcattgcttmtcggtactcagaaaargttatctgawtttgcgtggtaagcgctggcctgaagatgtacacaagttaaagccatattttatctggtgagccccttaactgtttctgaaggaatgaacggtcagccgggaaggtgtccggcttagaccttgacaacagacactacccatctgtcagccatgtgcagtggttagaactcttcttgaaagtccaaagagcctttaaaatgtgtataatttgtgttttgttgcttctatttcta

SEQ ID NO: 14532 - DNA, 61 bp, Homo sapiens
atggtggtcttgcgggcggggaasaagacctttctccccgstctctgcsgcgccttcgcct

SEQ ID NO: 14533 - DNA, 62 bp, Homo sapiens
cctgctcatcagctgctggggacactcggagccatccatgcgggmcttcctgctctctctgg

SEQ ID NO: 14534 - DNA, 392 bp, Homo sapiens
ctaaaatttgtaaattgaatacttttgaatgtaagcagttgaagtaaaacctgtagtgagttcttcagtcagtcaacactaaacctgttttgtaaatttgatgctagtattacactggactttctcaaaatgaagtacacctatatatgcatatagtatatgagcatgcgtatttgtacaaaagcccttcaaaaggagttcagcttttataaacaccaaaacactctctgcctgtaaaatgtttttgctgaaatttgtatcattaactctcaaatttacatcttcatgtttgagatacgcttttaggactgtctatgcatgtagactttggtcaactctctcctsstccctcaataaatcagttaacttaaaaaatatattgtgaccatttt

SEQ ID NO: 14535 - DNA, 55 bp, Homo sapiens
aaaaaaaaaaaaaaaaaaaaaaaaaaaaaaaaaaaaaaaaaaaaaaaaaaaaaaa

SEQ ID NO: 14536 - DNA, 72 bp, Homo sapiens
cgtgacatggssccggggagccgaggtgagcgttssagcttscggagmcggagggggcccggcgtacccagc

SEQ ID NO: 14537 - DNA, 321 bp, Homo sapiens
tgaaaaacattatttttaatagaaaataataggtgtaggctgggcacggttgctgacacctgtagacccagcactctgggaggccacgtcgggctgatcacttgtggtcaggagtttgagaccagcctggccaacatggtgaaagttcgcctctactaaaaatagaaaaattagccaragggtggtggtgcacacctaatcctagctactttggaggctgaggtaggagaattgcttgaacccgggaagtggaggttgcagtgggctgagatcgcgccaccgcattccagcctgggctacagaaccagactstgtctcaaa

SEQ ID NO: 14538 - DNA, 425 bp, Homo sapiens
acaagccaggtccccaccgcgcttggcgatgcatccatagcagccttggtgctgtggacactccctggggcccagcgaaggggagagtttgctcccaaaggcgcaccaatgaccaacatttgccccccggaggaaagaactggaaccaggtgtctgtgatagggcccctgacttcctctccccgtctgaagaccaggtgctgaggcctgccttgggcagctcagtggctctgaactgcacggcttgggtagtctctgggccccactgctccctgccttcagtccagtggctgaaagacgggcttccattgggaattgggggccactacagcctycacgagtactcctgggtcaaggccaacctgtcagaggtgcttgtgttccarhgtcctgggggtyaacgtgaccagcactgaartctatggg

SEQ ID NO: 14539 - DNA, 453 bp, Homo sapiens
catagagcctagaacaacgtatcagattgagaactttgcacaagcgtttggttctcagtttaagtcgggcagcagggtgccaatgacctttatcactaactctaatggagaagtggaccatagagtaaggacttcagtgtcagatttctcagggtatacaaatatgatgtctgatgtaagtgagccatgtagtacaagagtaaagacacccaccagccagagttacaggtaaggtcccaaaagtggccaggctggaggtcttctaatgtaattttgttttattttgagaacactgccattggaatgtttctacacgatcctattaagaataatgtgatgccctttcaatgcaacttttcatatttagtttattttgttagcgtgattttagctctgtttgtattatgatttttaatcaaaatcatagattaaaaatagtttgacattcaaagt

SEQ ID NO: 14540 - DNA, 498 bp, Homo sapiens
  misc_feature 399..400: n=a, g, c or t
ttattatgcttgttaaaaagcaggaaaatgtgactcttaaccagaatgaaaaagttgatagaaataaatatctaaaatgaaaaatccaccagggagtggtggctcacgcctgtaatctcagcactttgggaggctgaggtaggtggatcatttgagggcaggagttcaagaccagcctgaccaaaatggtgaaaccctgtctctactaaaaatacaaaaaaattagctgggcgtggtggcaggcacctgtaatcccagctactcaggaagctgaggcagcagaattgcttgaacctaggaggtggaggttgcagtgagccaagattgtgcctctgcactgcagcctgggtgacagtgtgagactcaatctcaaataaataaataaataaataaataaanngaaaaattcaccagatggatttagctgcagataacatactgtggaagawaggatcagtgaatttgaggatagatcaatgtaaaccatccaaaatcaaa

SEQ ID NO: 14541 - DNA, 480 bp, Homo sapiens
atttccaagctctttaagagggaaagaatagttgtctcatccaagacgtttgcttacatgatttgcttaattttatagttggaagtagagatgttttacttaaaatggagaatggcagtgtttaagtgggaatctccgcctaacagttgaaatttcggacctgaaggcttagaaaatatttctggggaaactaacgtgaaaacattaaaattctaagcaaaataaagtagataacattctataatttgtcttcatgtggtaggtacagtaggatatggaaaaagcatgctattttagacgtatgggcactcttcttccacactgcaggtaaagggcaaataaccatcgttggccaagctcgatggctcacgcctgtaatcccagcactttgggaggccgaagcaggtggatcacctgaggtcaggagttcaagaccagcctggccaacatggcgaaaccctgtccctactaaaaataaaa

SEQ ID NO: 14542 - DNA, 507 bp, Homo sapiens
acatagattatgcataaatacgcaattttgtccatgtcaatgaacctaacaaaatgctttttaaaagtatattttagattcaaacatgctttctagatcagaggttaacttgtctttttgaaatcctggagtcacttataagttagctgcaaactgtagtttcggtaattcaactgcttaagcatttctggactgtttatcaaaatatattacagaatgtgagactaaagtttaaagtctggacctttggtttaatttctagactttccaaagcttttttttttctttttaaaaagcccattgtcaactctcttagaacttcatcaagtaaatggtaccttgcaaatgtaggttgtgtctgaccttctttctttttgtgtgttggtgcctcagatgtatcatgtgctgcttgaactgattctctacagtgttccttcctagtctcaagctgatgatgtgctcaaagatgtatcaaaatccatgtaatgacaccttttagatgtttct

SEQ ID NO: 14543 - DNA, 226 bp, Homo sapiens
ttgtaatttgagccacattcccaactctaactcagcacacactgccagtcttccccaatatkycttcaattccccaccacaccttataaaattgtaatcaaagatatctcactctgtatgtatctaagaataaaaacactgactttaatacggttttactaagtttcaaccttctaattaggwgtctagtattctgcagatcactgctggtcttgatagccattaa

SEQ ID NO: 14544 - DNA, 541 bp, Homo sapiens
atggtttgttgtgagttccatgtcctcttggatcagtcactgtggccatgcatgtttggccacatgattaatccagtctgggtcatgaccttttcttcatccaaaacaaggtgatgggaagacaaaaacaatagctactacaaacaataggagtttataattatgtgctgatgtattcgaagatgtgttgacagtcgtgagtgtgtatcctaggaaaggcgagctggactctgtctccatggtggctctcaccccagggacctaggaacagcctgtcaccacacaattacttttataaccctggagatgaaaatctccttgtcctcaaaatacttccagaagaacaaccagatgggaaggaccttggttgggactctttccagttcacttggggcagagggaatttaatggctcacgtagctgaaaaggatgggctagattgggcttcaggctgcatcccaggactccaaacagggatctgtctctttggctctcagctctgctttcatttgagttggctttattcttgggctcacagtgt

SEQ ID NO: 14545 - DNA, 523 bp, Homo sapiens
  misc_feature 501: n=a, g, c or t
agttgagggctgcccgctgcgtggggtggattccccagccctcacaggataattttatcacagaggacaacatttgtagttctgcatgagtggctctcctggcgagataaagaagagacagtgagctgaggctgaggctgagaaggctggcatatgtgatgtcttcggggatcggaagctgtaagtagcacagagggacacacagaggcctgtggtggtggaggaggggcttgacgggtcctggtaagtcctgtctgtcttcaaaacctgctccccctctgatggcttcctgccccttcagtgcctgtgagccttgccttgggacctgtggggcacatgccatgccactggttgccatgtttttcaaacgtttaacccattattgagagaatccttagtagaaagccaagcctatggggaatggacatcaaatggatatgttttcatgacaggtaaaataaatgttaagactaggagattttagagctggaagacaggtcntttttttattttttggacagag

SEQ ID NO: 14546 - DNA, 643 bp, Homo sapiens
aaagattaggtggggcgccagagccggggcacctgcgcaggcttggctgcgccctctcgcgccgcacgctctgcgggttcctcccttcttccgagcctctcctctggccgccgcgcgggaagagaggccgagatggcagatgagattgccaaggctcaggtcgctcggcctggtggcgtacacgatcyttkggrargatcatccgcaaggaaataccagccaaaatcatttttgarbwatgaccggtgccttgcttttccatgacatttacccctcaaagcaccaacacattttctggtgatacccaagaaacatgatatcccagatttctgtggcagaagatgatgatgaaagtcttcttgggacacttaatgattgttggcaagaaaatgtgcttgctgatctggggcctgaataagggttatcgaatgggtggtgaatgagaggttcagatggtggacagtcttgtctatcacgtttcatctccatgttctttggaggtcggcaaatgcatttggcctcctggttaaagcacgtttttggggataattttctcttcttttaggcaatgattaaagttagggcaatttccagtatgttaagtaacacacttatttttgcctgtgtatggagagattcaaga

SEQ ID NO: 14547 - DNA, 487 bp, Homo sapiens
attttaagagggggcagttagcactgtattcccttgtttatctgtttctctttgccactcaactactagtaaggttgttaccattggtccttctgctgctgcctccaatgagaggcaaagactaggctgatggggctggcaagtgggaactctctagggcctaaaggagaggaaccagatgttccttggtggaaccagagattcgtattactggtacagaaatctccacttaagagccatggctagaatgaatatataaaagccttcaaatcgcctgcaatcccagcactttgggaggccaaggcaggcggatcacgaggtcaggagatcaagagactctcctggctaaaatggtgaaacacatctctactaaaaatacaaaaaattatccagttgtggtggcatgcacctgtagtcccagctactgtggaggctgaggcaggagaattgcttgaacccaggaggtggaggttgcggtgagttgaga

SEQ ID NO: 14548 - DNA, 367 bp, Homo sapiens
atataaatatatatataaatcttttcttcttttgtcattcaatcaaattccaacaacccaaccagggccagtcaaatccaccacagtctcgcgctgagctaggaataaagttcacgtaatcacatgagagtggagaaaagtcccccatccggcaggatgctgaacggctacattaaaaaacaaacctctctctatatatatttataaatgagaactgttggatgacacctttgacatatcagccaatatcaatcaagctgaagactccagacactgtctgtgtgactgtaacatttcttcaaggaaagtatagcgtctatggagttcagagggcacgtgtttgggggaaaatatatatgacatgaag

SEQ ID NO: 14549 - DNA, 505 bp, Homo sapiens
ctgccctgtaccctgaacctcatgagcctctaagggaaaggaggaacaattaggacgtggcaatgagacctggcagggcagagtacaagcccagcacccagtgtcccagccttactgggtccttaccctgggccaaacagggagggctgatacctccttgctcttcctagatgcccacctcctacaatctcagcccacaagtcctctccaccctagggggcttgctgcatggcaataactcataatctgatttggaggtttgccctttacaggggcagattttctgctcagttcaacaatgaaatgaagaggaactccctctttctacagctcacttctatcagaggcccaggtgcctcagagccacattgagttgctttttctgggatgaggaagtagggttaaactccccagtttcctgagggaggctcctgacaggtgccctttgtcagaccctaccacagcctggataggcagccacattggtcctcgcccttgctcggca

SEQ ID NO: 14550 - DNA, 166 bp, Homo sapiens
cattagccgggcgtggtgtcgggcgcctgtggtccccgctactcggaggctgaggcgggagaatggcgtgaacccgggaggcggastcgcagtgagccgagatcgcgccactgcactccagcctgggcgacagagcgagactccgtctcaaaaaaaaaaaaaaaaa

SEQ ID NO: 14551 - DNA, 487 bp, Homo sapiens
aatcttgatcaggaatactgatgtgtggtgtttttttcttatagtgtctttgtctggttttggtatcagaataatgatggcctcatagaatgcatttggaagtgtcctttcctcttcagttttttggaagagtttgaggagaattgatttaattcttcagatgtttgccagaattcccatatgaccctgggcttttctttcttgggaggcttttctttactacttcatgctcttgactagcataggtctgttcagattttccatttcttcatgattcaatcttgataggctgtgtgtttctaagaatttgtccagttcatctaggttatccaattctttgatatgtaattgctcatagtactcttaatcctttttatttctgtaaaatcagttgtaatgtctcctcctggtttttagttgtttttcttagtcactcttagctatcaacaaactcttggtttcatttatttttctctattgcttttct

SEQ ID NO: 14552 - DNA, 451 bp, Homo sapiens
aacggaggcggcgttcagaaatagggcgctggctttgcrgagcggctcctctccaagcctggcggtcactgccctgtgtccccttttgggcctctcctggtcctcctggttggattaggaggcctctcagcccggagtctgggtcgccgaagtacaggccccttcactgaagcgacccacggcgcaggggtttctggaagccatcgccaggctccgagtgttcagatgcagctgccaggctcaggacgcagagaactggcttccagctcgcaggagcgcctgtccgtggtgggtagggtcgcaggcgtggggtgtgcaggagcagtgggacagcactgaaacgcagtcggaagagataccacggtgtgcagggcacagggaaaagaccacgtgaggacacagagagaagacggccgtctgcaagccaaggagagaggcctcaggtgaaaca

SEQ ID NO: 14553 - DNA, 359 bp, Homo sapiens
taataaaaagggaataaatatatatcttgtatcatgtggatgccttaggctgtcagtaacagaacactccagtgaagaaaagatctcccagaacaagaagtccagaggaagggagagaaggaagacaggttcggggttggttaatttagtggctcactgatctaatcaaggaccccgacactttgcatctttatactctgccattctcagaatcttctctcatgattgtactctggctgtattgaatgcagactcaacagtgtcttatgaagaaatggaatatttcctcctgtacatcactttttgttagcaagacaacaatttcatggaaaccctccagtttttscctcaggtcctat

SEQ ID NO: 14554 - DNA, 447 bp, Homo sapiens
aactcatgaagacactgccttgatttgttgtcatgatttcaattccaaactctcaggagaagaaatctgactggcctggcttgagtcagtttgtatcctgggttcatggtaagcacatatgccagagtccatatgtttctggagatatggaatgcaatgtggaggtatggtctttgagaaagagggttcttgcaagctgattcattcaccccaaaaatgcaagtattatgatatataatggtgaagacttttattattttttttttcagtggggctgggttgtattgctccattaagatattaggggccgggcgtggtggatcacgcttgtaatcccagcactttgggaggccgagacaggcggatcacaacattaggagatcgagackatcctggctaacatggtgaaacccgtctctactaaaaatacaaaaaattagccgggca

SEQ ID NO: 14555 - DNA, 498 bp, Homo sapiens
cctatggaatagaagaaaatatatgcaaactatccactcaacaacgttctcgtgtccggaatctagaaggaatttaaacaaatcaacaagcaaaaaacaaataacccggctgggcacagtggctcacacctgtaatcccagcactttggggggctgagacaggcagatcacctgaggtcgggagttcgagaccggcttggccaacatgatgaaaccctgtctctgctggaaatacaaaaattagctgggcatggtgatgcatgcctgtgatcccagctactcgggaggctgaggcaggagaatcgcttgaacctgggaggcggaggttgcagtgagccgagatcgcaccactgcactccagcctgggtgacagagtgagagtctgtctcaaaaacaaaaacaaaacaaaacaaccccattaaaatgggggggcggcgaaggacatgaacagacacttctcaaaagaagatgtacaagcagccaacaaacatgaaaaga

SEQ ID NO: 14556 - DNA, 56 bp, Homo sapiens; identical to SEQ ID NO: 12139

SEQ ID NO: 14557 - DNA, 522 bp, Homo sapiens
tttctagttgttcattattgcactgaacaaataatgattcaatgaattcccctttatgtcactctttgctcatagttttgattcttctgaaagtagtattgctaaacaaatagtaaaataatcagctctaagtaacaaagccaactcaaaatgacttataccatatggaaaatgtgtcacatcatataacaaggtatccaatcatatcctaagctgcggaattgcttaattcattattttaaaaacatcatgattgactcaggtttttctgctctgtcaaccccagtgtgtgggctttgtctttaggctggccgtcctcttggtcagaagatagctgccatgccctcagacatttcctgtggacctggggacatcccttcctaagaatctcttaagcaaatattcccagatgcacaatgtaaatttctgctcacgtttcattggcaagaatgaggtcccatgcccataggttaaccgatcactggtgaagaaaatagttatcatgattgactgagattcttc

SEQ ID NO: 14558 - DNA, 464 bp, Homo sapiens
aaaaagtgtggttcaagcactcagggtctttgctccttccctagcccaagggcagcaagggtagtacctctgcagtggcagtggcagaggggatttcagttgcctctgggagctccacctcagagaaaggaagagttgatgctactgggaatgttcagccagggagtgggatggctgtgctgctggcctgagcctggggctctgcttgttgaggagaaggaggtccagggctcacagggaggagagactgggctcctgctcgtatggtgactgtggtatgctggaascacaggtctagggcacacaggatgtccctcatgtctgcaagcaacacctttcatagtgctgcattttctggctgccagatggagcttttctttcacactaaattgatttctgtgaaaagtctttgtcacctgcaatatgatgatgcttctaagtctatgcaccatcttaacagaagg

SEQ ID NO: 14559 - DNA, 471 bp, Homo sapiens
caaatgctgttaaactgtggattcagtcacctcttccgtgaaacctcctctcttaccctcaggcagtaatggtctcccawttctcaaagatacaaccttttattatggcatttaaattgtttttgtttttatcttccttacaagattctgtcattggacagctgattattagctagcagacacagtagaaattcaatcaattaatacattaaataatttatagaagaatgattattggcctctgccaccaagaaatggttatgtcttcttagtgatttgcctgctttttgtctccctggatttaggatgtagttttgaaaataacattgacgttccttcatagacgtwcgtacagttttcagtattcacaatggcagaagtatgatatttcgactgtgccctatttttatgctgggcaaggcctcaagaacaaaactcctgtgaccttacataggggtcttacactgaagg

SEQ ID NO: 14560 - DNA, 87 bp, Homo sapiens
atttaagattcagaataaatgggtttgatgtctggaaaaaaaaaaaaaaaaaaaaaaaaaaaaaaaaaaaaaaaaaaaaaaaaaaaa

SEQ ID NO: 14561 - DNA, 229 bp, Homo sapiens
  misc_feature 215: n=a, g, c or t
atagatttagggtgcaggacttaataatagtatagttattgtttgtttttaagaaaagctcagttctagagacatactattactttaggactgtgtagttgtatatttgtaagatgacagatgatgctgtcaasaatattgttttatttgtaataaaatatacaaaaatcacttgccagcagtagaaaaaggaccgactataccgacctttctgnattagtaaacagtt

SEQ ID NO: 14562 - DNA, 382 bp, Homo sapiens
actttggcttgtgtcagttccatccgcgggtgccggatctggacctaggtgctgacagcgagaaggcgcgaggagagtcgttttctcagctgcacagccggggcctgacggtcgccggcggtggtgacagctttgctcttgtctccgcccggatcgtccaccgctcccggcccgctccgcccagagtcctatggcggcggcactgagggccccgacccaggtattattgagtgttttcaagaatgaaaagaggcctggcatggtggctcacatctgtaatcccaactttttgggaggctgaggtgggaggatcccttgagcccaagagtttgaggctgcagcaagctatgatcgtgccactacactccagcctgtgcaacac

SEQ ID NO: 14563 - DNA, 424 bp, Homo sapiens
  misc_feature 13..14,216: n=a, g, c or t
cgttgggccgccnnggggtgtcgctgcgcccgctgccccgcgcgccctttaaactttgttttttaaacttcgggggtgtggtcgcggcgcctcccctctcggcggctggcagtccttgcctctgccccgccttccagatgctttggagtcatgagccgggagggctcgggggcagctttggtagccgaggtgatcaaaggtgagccgggagggcgngggcttcccctgggggctccggcacccgcgctgggacagggcgggcagtgctggcttggaggtgcccctagtctgggccccggccgcccttgtctcctgcgtgtgggtggcctcggsacttgtccccaggctctgggctacagcgctcatgggcggctgtgacccttgcgtgcctgcacctgagcctagtaggtgagctgcacctccc

SEQ ID NO: 14564 - DNA, 325 bp, Homo sapiens
tagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctggtggttttttttttctcacgctgatggcttggcagagcaccttcggttaacttg

SEQ ID NO: 14565 - DNA, 464 bp, Homo sapiens
cagatttgaaatgattgtgaaagtattgggaagctgcatagtattatagcagtaacttaaaaaggactgcttgttaaggcagttattcaggttacttgaggatagaataaggtcctgatggtagtatagagcagaaatttaggaaccataaatggccactgtagtgcctgagacttaaacctcactattaaaagaggcttctttaccaagaaagatactttttaggctgggcacagtggctcatgcctgcaatcccagcactttgggaggccgaggcgggcagmycacctgagatcaggagtttgagaccagcctggccaacatggtgaaacctgtctctactaaaaatgcaaaaattagctgggcatgatggtgggtgcctgtaatcccagctactctggaggctgaggcaggagaattgcttgaatctgggaagcggaggttgcagtgagccaagatcgcgc

SEQ ID NO: 14566 - DNA, 301 bp, Homo sapiens
  misc_feature 183: n=a, g, c or t
agttttcccgggacgttcgggtggaagatggcggatttacctcagctgcggaaacgcagacgctgtytccagttgcgcatgcgcctscggccccgcgagcgcaccgccctcgggtggagctagtgctcagggcgtcctcgtgccttttcttggwggcgggaaacctgggttgaggtgtgaggngcttgcggagtcgctgcggcactcgttccgcccatcgcctttaggtcctccttgctcctgaagctttcagtatttgttattgtgaaagaagttaatycacctgaaacagaggaggggc

SEQ ID NO: 14567 - DNA, 187 bp, Homo sapiens
  misc_feature 86: n=a, g, c or t
acagatcctcactctccgtgtgaggctcgcaggggcgcastcagctggctgtataaggaggccacagttcaggaggtggacgtgancsctgaggacgggrcrgccgacgtgagggtacatcatcagcaactcagcctacggcaaattccggaagactctttccaggatgaacggacgcccacagagg

SEQ ID NO: 14568 - DNA, 75 bp, Homo sapiens
gccatttctaatctttctctggggggaacaggccacagaactgtgtwmagaggtgaaccatcttaattactagtt

SEQ ID NO: 14569 - DNA, 347 bp, Homo sapiens
caaagatgaccaagtgtttgaagccgtgggaactacagatgaattaagttcagctattgggtttgctctggaattagtcacagaaaagggccatacatttgccgaagagcttcagaaaatccagtgcacattgcaggacgtcggctcggccctggcgacaccatgctcctcggcccgggagractcacttaaagtatacacacgttcaaggcggggcccatcctggagctggagcagtggatcgacaagtacaccagccagctcccaccactcacggccttcatcgctgccttcgggaggcaagatcagctcggcgctgcatttctgcsgggscgtgtgccgccggg

SEQ ID NO: 14570 - DNA, 324 bp, Homo sapiens
  misc_feature 86: n=a, g, c or t
agaaaggggagacgtgtgacgggggttctttttggtgacacagaagcgggttccagcatctaagtgaagaggctgagtccgtgavnmtaggggtcctggggccccacctgggttcrtgggagggaaaggtggtgctttggggacatagaatgggagcaatccaagractgaggcgcgctgwtctrggaccggagagtggggtttctaggtccaaggggaggctccctaaagcggggcaagcttgaaccaaaagagctggggtttcaggccgctcagtggaggcgaacctcgcccctcgctccccaagcggcgcgtascagccct

SEQ ID NO: 14571 - DNA, 84 bp, Homo sapiens
aaaaaaaaaaaaaaaaaaaaaaaaaaaaaaaaaaaaaaaaaaaaaaaaaaaaaaaaaaaaaaaaaaaaacaaaaaaaaaaaaaa

SEQ ID NO: 14572 - DNA, 483 bp, Homo sapiens
  misc_feature 436: n=a, g, c or t
gagccatttcttccccttgggcaaacgaggtagaccctcccagagaccaatgccggagaggcccggatccgagctccctttatatrgcctcccccatcasggatcscgtgggaaaacctgacacacaatggcgcggctgctccgggcaccctcaacccagcgccstgcggcaaggcctcgragcagcctggtggtcttggtgcgctccctttgccctccccgcaaccctctgcgagcactcgtcccaggagagagaccctggctagggtggaggttgcctcccgcaaagggcgctgttgctggggcctcscctccsccattctcttgtttttctgcttctgagactcgggagggaggcggcaggcgcctscgcagcsgatagagcagctattgtgascttsscttgcagagcgggaacccagccgagtgtgtacgnsggcggtggsgggggaggaggcgactgtgtgtgcaaacctcagtcgg

SEQ ID NO: 14573 - DNA, 477 bp, Homo sapiens
  misc_feature 430: n=a, g, c or t
cttttaaccaagtatctttcctgcctgsatcattttatcttcagttcatctgtcttagaatccggatagagagcatatgttaggtmttggaaagtacaagaggagagaaagcacttatgaaaggtgacattsccagaactggtgaaagttcaggaacagatttcttgaagcagaggaaacgamgtaagcccgagtggtgagtgagcagccgagccgacattcacacgcaggtcttcctggctccgaagcttgtgctcctgggcgtgctgcctggcccctcaagcagcctttcaggagtgagctccgtcagagtgattgtaccaaatggagaaaactctttccggagacgttcatcatcaatacsatcatcaagatttttcacataaagattaasacsstaaaaagaagaaaagaaaactatagaaaaagnrarccatggtggtacctaagtacatcgggtctattattttaccccat

SEQ ID NO: 14574 - DNA, 341 bp, Homo sapiens
cagttcttaagtatctttaagttcctttcctctctaacttctactggtagaatatttctaccagtagaaaaaaacaaaagaaaacccaaacaactctcaaccatgggccaagagaaactaagaaatcgatattgaaaggccaggaggggcaggagaagtggcwcaggcctgtaatctmagcactttgggaggccmgaggcgggcggatcacttgaggtcaggagttccgggccagcctggccaacatggtgaaatcccttctctgccaaaaaatacaaaaattagccgggcgtggtggcacgcacctgtggtcccagctactctggaggctgaggtggaag

SEQ ID NO: 14575 - DNA, 424 bp, Homo sapiens
ccaacagttatgcagagtgctacccagccacgatggatgacatggctgtggatagtgattaggaggtggattatagcaaaatggaccagggtaacaagaaggggcccttaggcgttgggactttgatacccaggaagaatacagcgagtatatgaacaacaaagaagctttgcccaaggctgcattccagtatggtatcaaaatgtctgaagggcggaaaaccaggcgcttcaaggaaaccaatgacaaagcagagcttgatcgccagtggaagaagattagtgcaatcattgagaagaggaagaagatggaagctgatggggttgaagtcaaaagaccaaaatactaatcactagttacaaccagagatgctccacaaggatatgctccccactgttttctttctacaatttccaaaggttgc

SEQ ID NO: 14576 - DNA, 308 bp, Homo sapiens
atcggtccagtgaggctgtcatctgggaggtgctgcgaagttggggctgcgcctgggatacatcattcactctttggggacgtgaagaagctcatcactgatgagtttgtgaagcagaagtacctggactatgccagagtccccaatagcaatccccctgaatatgagttcttctgrggsstgcgctcttactatgagaccagcaagatgmaagtcctcaagtttgsstgcaagtacaaaagaaggatcccaaggaatgggcagctcagtaccgagaggcgatggaagcagatttgaaggctgcagct

SEQ ID NO: 14577 - DNA, 84 bp, Homo sapiens
aaaaaaaaaaaaaaaaaaaaaaaaaaaaaaaaaaaaaaaaaaaaaaaaaaaaaaaaaaaaaaaaaaamaaaaaaaaaaaaaaaa

SEQ ID NO: 14578 - DNA, 408 bp, Homo sapiens
tgaaacacattttaaaaattcagaagcttgtcactcctgttaatgggaggatcagtcacacatgtgtagtacaaggcggactttgtgtttgtttttggtgttaatttttagcattgtgtgtgttgcttccccaccctgaggagaggacaccatggcttactactcaggacaagtatgcsccgctcagggtgtgatttcaggtggcttccaaacttgtacgcagtttaaagatggtggggacagactttgcctctacctagtgaaccccacttaaagaataaggagcatttgaatctcttggaaaaggccatgaagaataaagcagtcaaaaagaagtcctccatgttggtgccaaggacttgcgaggggaaataaaaaatgttatccagcctgaccaacatggagaaa

SEQ ID NO: 14579 - DNA, 469 bp, Homo sapiens
gaacaacgactttttgcctccaaagttggatctagtgatgatcagcaccagcaggaaatgacatttsgtgtctgcccactgcagccatactgtgacctccagccagacttccgcctaattgactccactggatttgtgctctgttgagtcagaggctcccgggggttggggatcgasgaggcgggggtcagctatgcagcccatcacgtgtgtttttcatctgggatgaaaaagcctggttctcttttgaaatgcttgattgtacttattgagctaaacaagtcttggtgactgttgttgatttgcctcaaaagttttaagtcctgggttttcagactactgtgtagcagctgtgtgtttaacatactgtagctttttctcccttgggggcacatacaaataggatgtgttgatgtggactctaaactgtaattttcctgtaactattttggaatgatgcatatttcta

SEQ ID NO: 14580 - DNA, 413 bp, Homo sapiens
  misc_feature 373,379: n=a, g, c or t
ggggctgcgcggcctcttcccagccagcttgaaagggtttgcgtmgcggccttgtgggcccttcaagcgctctgttaaagcgstctgtgggcggcstggccccaactcctctagtctaggcgcacgaagggagttgctcctaggtcttgtccgtgccgggwtcgcttttctttccwtcssgaagcctggcccttagatctactatcgcagagtctgcggccgccaggaagcccagattcgagtgtccggagagtaaccggaagtgctgtccccaggcctaggggcggcgccggcggctgccagggagaggcaagaattsagtgttcgtgaatagttctgaactagagaccttttgaaaccaaaagggaagatngtcttnagtctttcttgttacgaatgctatcttctttgag

SEQ ID NO: 14581 - DNA, 488 bp, Homo sapiens
gaacaaggaaagacggtagaagaggctgcggacctatcgttgggttatatgaagtcaagggttaaaggtttaggcsctcatcgtggttagcaaaacaggagactgggtggcaaagtggacctccacctccatgccctgggcagccgccaaggacggcaagctgcacttcggaattgatmctracgatactactatcaccgaccttccctaagccgctggaagattgtattccagatgctagcttagaggtcaagtacagtctcctcatgagacatagcctaatcaattagatctagaattggaaaaattgtcccgtctgtcacttgttttgttgccttaataagcatctgaatgtttggttgtggggcgggttctgaagcgatgagagaaatgcmcgtattaggaggattacttgagccctggagggtcacagcctgaggtgagccatgattactccactgcactccagcctgggggctacagaagcc

SEQ ID NO: 14582 - DNA, 322 bp, Homo sapiens
  misc_feature 173: n=a, g, c or t
attaaaaaaccttgtgtagataggagaactaaaatggggaataggccgggcatggtggctcaygcctataatcccagaagtttagaaggccaaggcaggagcatctcttgagcccaggagttcaagactagcctgggcaacataatgagaccctgtctctacaaaaaaatmanaaaaattaggcatggtggcatgtgcstgtagtcccaggtacttgcaaggctgaagtgggaggatcacttgagcccaggaggtagaggctgcagtgagccatgatcgtaccactgcactccagccagggtgacagagcgagaccctaast

SEQ ID NO: 14583 - DNA, 399 bp, Homo sapiens
  misc_feature 77,85,355: n=a, g, c or t
tatgctactttcctgtttgcactactacttttttattaaacgatgttaaataatctctctgtgaccaaagtgactanaaagaganccatgagtttactcaagaagtaaatggagctggccaggcatggtggctcacacctgtaatccmagcactttgggaggctgaggtgggcgratcacctgaggtcaggagttcgagaccagcctggccaatagagtgaaacctcgtctctactagaaatgcaaaagttggccaggcgtrgtggtgggcactgtagtcccagctgcttgagaggctaagacaggagaatcgcttgaacccgggaggcggaggttgcagtgagccgagatcatnccattgtactccagcctgggcgacaggagcgagactccgtctcc

SEQ ID NO: 14584 - DNA, 482 bp, Homo sapiens
aatttcattatttaccgaggagtcattcaggagcagattgttcaatttccatgtaatcgtgtggttttgagtgagttttttaatcctgagttgtaatttgattgcactgtggtctgagagactgtttgctatgatttcagttcttttgcatttgttgaggactgttttacttccaattatgtggtcagttttagaataagtgccatgtggcacagagaagaacgtatattctgttgatttggggtggagatttctgtagatgtctattagatccacttgatccagagctgagagttcaagtcctgacttttcttcctccaaccctccagtgagacaggaagactagaggaggctggagttgcagaaatatccctccccgaaaataggataaggttctgagcaactaagaggtctttcttggctctatgagaacctggtgggattcctgaagataaagtccacaaaaatgaagctccagacaa

SEQ ID NO: 14585 - DNA, 325 bp, Homo sapiens
  misc_feature 325: n=a, g, c or t
tagaattatgatctccattatccacgatttctttcatcagtgctttgtagttctccttgtagagattttatatctccttggttaaatgtattcctggatattttatttttgtgtgtggctattgtaaatggaattgagtttttgatttggttctcagtttgagtgttgttgatatatagaaatgtaactggctgggcacggtggctcattcctgtaatcscagcactttgggaggctgaggtgggtgggtcatctgaggtcaggagttccagaagcctggccagcaagtgaaaccttgtctgtactaaaaatacaaaaataaaan

SEQ ID NO: 14586 - DNA, 399 bp, Homo sapiens
agaggagaggagggcgathkgagaggatggagaggaccgcgcctgcggagggcgacggggagaaggaagcgagccgagcggatggcagccccggaggcgcaagacgagagcgggcaggaaggagggacatagggaccgcgggcggacggaagtaaagtgaaggagctagcagggcaaggcgggaacgtgactggacacagctttgggctctgttgtttcgagtgcgctattttgtccatccaaacagaagattatgaatggagagctacatcccatggggtggcagatgaagatgtgcaagaagaagacactaacaactgaattgcagattgaggagatgagattatggtgacagaatccatcttcggtgtatgtgcatgaagaaataagccaaatcta

SEQ ID NO: 14587 - DNA, 332 bp, Homo sapiens
tacttaacaaatttttttcctgggcttcagtccaggaattttttctggatctagcgctaagagagaggctttattaaagccacagttctttttctgccatttggtccagtggtataaggactctcccttgtgagtgccattttgtctggtctgaatgcttaggatgcatcttcacaattttatgtttttgtttcttgctactttaaaaatatttagattaccttatctttgtttgaactggtgtctgtgatgctttttattactcatgtcttaaaggttgtgtcttcaatgcctcaaagctttttgaaaaagaaacatgcctgttctgtttt

SEQ ID NO: 14588 - DNA, 280 bp, Homo sapiens
tgtcttttcaattttggagagttttcctgtggctacaaggcaagtaacgggttggaaaaagtctgactgtaagcgttggacaccttcatagtgtagtgttttagtgactttttttatacggttcttgtaaattagatacgtgtagtggtgtttcagaatgtttgtttatgcactagttcagacaactttccctgttacttgttcttgataagtgaaaactgcagggaaataaaaaatacatatcaaaacatggaaaaaaaaaaaaaaaaaaaaaaaaaaa

SEQ ID NO: 14589 - DNA, 284 bp, Homo sapiens
gagattgtgccactgcactccagcctgggcgagagggcaagactctgtctcaaaaaaaaagcactttatttgggagattccaggaaacattagtagaggcagaggaaatgagaaaggagggaaaatcatgtggtattgagcggaaaactgctggatgacagggctcagtcctgttggagaactctgggtggtgctgtagaacagggccactcacagtgggtgcacagaccagcacggctctgtgacctgtttgttacaggtccatgatgaggtaaacaatacac

SEQ ID NO: 14590 - DNA, 357 bp, Homo sapiens
atttgcttttcccagcggggaagggaccggatctgaaaggagatgctctctgattcctaaaagggtgggggctggctgggcgcggtggcgcatgctataatcccagcattttgggaagccgaggcgggtggatcaagagaagaggagttcgagacaagcctggccaacatggtgaaaccctgtctctactaaaatgcaaaaaattagccgggcatggtgttgcgcgcctgtagtcccagctactcgggaggctgaggcaggagaatcgcttgaacccgcgaggtggaggttgcagtgagctgagattgcgtcactgcactccagcctggtgacagagcgatactctgtctcaaaaaa

SEQ ID NO: 14591 - DNA, 364 bp, Homo sapiens
ttgaaaagattgtcctttcctcactccactataatgccattgttataaatccaatgtccatatatgcttaggtctgtttctaaacttttttgttatactatgttcatttgtaatagaacatcattaatttaagaaagttactcatcacaaaccttggtcctcgtagctcaatcagtaacggcccagtcttttctatatggaattggtagatggggttatttttgtgagtctcttggaaatttccacatcctccagcactctgaccactccactttccattaatctaataaaaacaaaagttttagtattaacaaaatttcatttccaattccacttaaagacaaaactcctttccatctcaaaa

SEQ ID NO: 14592 - DNA, 109 bp, Homo sapiens
ttttgttcctctgtttataaaatctttttgtttttcaaaaaaaaaaaaaaaaaaaaaaaaaaaaaaaaaaaaaaaaaaaaaaaaaaaaaaaaaaaaaaaaaaaaaaaaa

SEQ ID NO: 14593 - DNA, 478 bp, Homo sapiens
acaagatggcggcascggcgctgggggagggcgaggcggaggcggcaaaacgggcggtcgagcagaacgtgtagccgcgtcccctccagtccgctccgggcagctgctgatgcaaggaatcccctgggctcccgtccactccactgctgaccagcccattcgcctgtgctgagtcttcctgcaggcctttccttgcctctgtgggaccctgtgggggtcatccggctggagaagaaaagcctctcatgctaacgttgcagaccccagagggtgagagaaagggggacttcattcagtcttgaaacctgtgtgctcagcccccaaggcatcaggaattcttcctgcccagagaatcaaggcagcttcatttttttcgtaccttggtcagtggttctcaacctttttgttatcaaggcactttttgttgtacatatgtcctgttgcccccccctgacgagcatcacaaaaatcgacgctc

SEQ ID NO: 14594 - DNA, 507 bp, Homo sapiens
ttaaaaattttatagtgacattagagacaatggtcatacaaattatcacataaacatggacttgaaaaattaggcttttcataaaacacatcacatgtcattgactgctttttagaaatacacttccaaggcagtacatctgtattgctactgaaaagtgccatttcacagaacacagacttctttttgctctttgacatcttgaaaacatctgtttttcttttttaatacaaaactttgtgctcaagacaaatcttacatgaaactctcataaaccatgaaaatgtagctggccttcgggccttaggcatgaaataagcatgaggaacatattcccctaacttctacccccagcccagcaagttatcctttaagaaatctcctaggaattctggagtttgaaaacaattgctctatgttattcctgcttccagtctctaagtaacaagggcatttaaaagcatagtctcttaaggtccactatagtggttctttatttaaggaata

SEQ ID NO: 14595 - DNA, 238 bp, Homo sapiens
ccttctcgctaacctcttcgcccggaagtggcaacaagactgcaacatcccctcacgcctagtctgtaaagaactttgtttaacccggagcggggccagccagctccgcccctccagctggacgcgggagmaggttgaggttcatacccctgggttctctccaggcctgaggcggagagccagccgcctgcvtacctctgggctttgaaccccgggtctggtgacttcgcttaaagac

SEQ ID NO: 14596 - DNA, 433 bp, Homo sapiens
aaatactttttagatatcctagatgcatctttcaacttctaacattctgtagtttaggagttctcaagcttggcattattgacatgttaggccaaataattttttttgtgggaggtctcttgtgcgttttagatgattagcaataatccctgacctgttatctactaaagactagtcgtttctcatcagktgtgacaacaaaaatgggtccagatattgccaaatgccctttagaggacagtaatcgsccccagttgagaaccatttcagtaaaactttaattactattttttcttttgggttataaaattaatgatcctgaattaaattgatggaaccttgaagtcgataaaatatatttcttgctttaaagtccccatacgtgtcctactaattttctcatgctttagtggtttcamytttctcctggtat

SEQ ID NO: 14597 - DNA, 492 bp, Homo sapiens
aaccaaggaaattctagcaactcactcttctggtgcaagaggagagattgggaaacccaggtaacagtgcatagatgaattgcctaaggttctgcttctagttggtgtcctgcgaatcagttcagcccagagaactcatcactaccaggcccagttgaaggaggataaggtgagattccttcacaaatggtggctccaactggaattcattgtcccaaattctgagaactcctgaggaaagatccaaaagtaatatggctcaagatttttgaactgcccaggctctactcaggctcttggacagcttgcccatctcaaaggtctctcctgcctactgccggccctacccacaagatgtgaacttcagagccttcttgcaactgcttcttggctatttgcaccctctaaccctctggaagaagaatgaggactattatgaaggcaaaagcataaaaggggaaaagattagcctccagagtaggaagattgggt

SEQ ID NO: 14598 - DNA, 414 bp, Homo sapiens
aagaggtgaaataattggcgtgaaagttctaggcatattggctatgatcgacgaaggggaaaccgactggaaagtcattgccattaatgtggatgatcctgatgcatccaattataatgatatcaatgatgtcaaacggctgaaacctggctacttagaagctactgtggactggtttagaaggtataaggttcctgatggaaaaccagaaaatgagtttgcgtttaatgcagaatttaaagataaggactttgccattgatattattaaaagcactcatgaccattggaaagcattagtgactaagaaaacgaatggaaaaggaatcagttgcatgaatacaactttgtctgagagccccttcaagtgtgatcctgatgctgccagagccattgtggatgctttaccaccacc

SEQ ID NO: 14599 - DNA, 167 bp, Homo sapiens
tctaaatgttataaaacaagaatttatattctagggttgatcagctagtatttaatcaaaaaggccacactcccatagcagctactctaagctgtagtagctaataaaaaatattaatgttggccgggcacagtggctcacgcctataatcccagcactttgggagg

SEQ ID NO: 14600 - DNA, 483 bp, Homo sapiens
ataaattgaggttcatttttcacatagacttgcaatttttagacaccacattttttttatagtaacagcctcatttgcctgtacaataactaataatacagtatttcataggtacattgtatgtgcacaggaaatttttctttaaatcttaagagcctttaataaacgggatattttaatattttaatgttactacatttaaaaaatagtgttttcctacaaaattttctgtattcagtatacgttaactatgaaaatgtcaaacaatgaaatcattgaaatatatttaaggaaaaattaccaaccaaaagtaatgagtaccctctatgtgcatatttactggaatgttcatgtgaaatggtaacatttccaataacagcattttgaatctggggtgacacaaacatgatttttatttttgagctagggattttgatggagaagcacctagatgaagacaccatttcattcatgatattttaa

SEQ ID NO: 14601 - DNA, 449 bp, Homo sapiens
aagaagcggacctaagcgatabtttgcgaggctaaagaagccgagagagaagtaaaatttgctgcataagtagggtgagcaggcggccgtgggtgccctgttaaagaagtatggacatatgcatacttccagaagtatattaacatgcaagttatatgtaaacgaccgtttgagtaactaaccaaattaccgtaattgcaatcaatgacttttccccctcccgtatgctacaagactcccttagtaaatcaggccgtgggatggacgctgggttcctagaagggcgcgcaggaagacggcggacggggaagacgttctttctgactgcccttttcctacttatcttggaggacgatgcggagtttaagctccttaacatttcgggaatggcgcggtccaaccgcgttcagtcttttcgccgttagaggcccgactcgaggccgtggttc

SEQ ID NO: 14602 - DNA, 551 bp, Homo sapiens
ttttatttggactagagggaggaagaaaaaagcttgggactgctgctggaggaacagaagtgcattaggaggctcatatttcacaactggttgccagtgtctatattggctgatggctctggtttccagctggcggtggccttggttgaaacatttacctggtgtcttcagggatgctgtatcaacagctgtaagtagagctagttattcagtctgctctgagaaaggttaaagtgtgtgtctttggcttccccagggactaatccagtaacaggagagtcagagagaacacgtaccacttgggagggggtttcttcaccgggattttcgttgttattttagttacaaatggaagcatttaaaacctaaatctgtatttaggcagtgagaggagaaacagggacggaaatgaattatttatttcatcactggggtcctggaagcgtggagtgggcgttaatctcctttgaacaggagcctctgggtcgggcttgaggtcgtctgtgtgagatctgaccttatctgctcctggccagacatctcggctttga

SEQ ID NO: 14603 - DNA, 510 bp, Homo sapiens
tatttattatttttatataaaagatagtcaataggaaggtaggattggggagaaaacttagcaaatgtcacaaaggagactcctagtaacaaaatctgcgggagccttttcttttaaaataaagatggtgcatctgtccctttacagatttctctcctgtcccctgggactggggaaggtgaatctcctgcctgacaccctgtagagattagtgtatccagctgttctattcccatgattcctctgaaaaccagactgactgggaatagcagtaggggtttggccagtgagggcaggtggccaaatggtgtgcaggaaactcgcatgtttccctgggttggcttcctgctcccctgtccctgtcaccaatagcagcttcaatatgggagacgattaaaacaaaggagaaaaacaaaaaaccgtatccaaattataaccaaccaagtctatggaggaaattcacaaggcagcagagcagaggctgcagaggtgctctgtctaccgggagaa

SEQ ID NO: 14604 - DNA, 598 bp, Homo sapiens
aattgtttctaaatgaaatgtcaatatcagaatttgaacaaccacttaagctatggagttttctgaaatgaataaccattaactgtgtttggttttcagcccctgtctattaagtgtattcagtgttttcaggcctatcacaatcgtttttcctttttttaaaaaaaattgaaggctgggtgtggtggctcacacctgtaatccaagcactttgcaagtccgaggcaggtggatcacctgaggtcaagagtttgagaccagcctggccaacatggtgaaacctcatctctactaaaaaaataaaaattagtaggccaggcgtggtggctcacgcctgtaatcccagcactttgggaggccgaggcgggtggatcacataaggttgggagttcgagaccagcccgaccaccacggagaaaccccgtctctactaaaaatacaaaattagccaggcatgatggcaggtgctgtagtcccagctactcgggaagctgaaccaggagaatcgcttgaacctgggaggcagaggttgcagtgagccgagatctcgccattgcactccagcctgggcaacaagagcgaaactgcgtctcaaaaa

SEQ ID NO: 14605 - DNA, 440 bp, Homo sapiens
ccccgccccttgctctgttttctcccagctgccggaccagcgggcctgccgcctctacggaccagtccctgctcaggcgtgcacaccgagcggcggggcgctgtggaacgsgggasgactagcggaggaggatgcggaccaagccccagcgacccagggcaactcggagctacctcgggcagccctgcgggtctccgaggagaaccgaggagacgggagaaacatgggagagggtggccttttccctgttcacacacacatgcacgcagcsactggccgggacagttgasacccatcttccttccctgctccttccagtcattctacacccgcttggtgctgccagtgcgggcagggccttggagcccaaagcggatccccacacttgtccctacggtcggaaggaaagtagaggagagagagtcaggcgcggcagggct

SEQ ID NO: 14606 - DNA, 416 bp, Homo sapiens
ttttttccggcgctggctccgcatggtcagtgccatttcgcctttatcgtggtggagtccaccctggctgtggtgagttccgcctgcttggggatcccggagatagcggggggcggcaaaggaacgattgggtgctgtcgcccaggagcctctccgatccgcctcgtttcactctcttctccaggggctgtcggtcctccctgcgcggccagtggctagaggccgcastcagtgggtcccagtcaggagccaggtcgggaagtgtgtttgtcccgactccgcgcgttttctggagtggtttcatccgctgtgctcccttcttcaaaagcttggaaagcaacctttgtgagtttctttctttctgaaagtaaaaggatttctgccgttccagtcagggttggctccggccccgcatt

SEQ ID NO: 14607 - DNA, 419 bp, Homo sapiens
caaatcatttcacgcttattttctggggagaaaaatagaaaattacaccttgtttacaaatgaaatagtttcacttaaatgggactctagccaaggcagttaattagtcaaaagatccacagctgtcatatagtcacacattgtttattctatttgctatgtcgaccactgatgtgtatttaatattctgcatccttcacaggaaatgacaaatgccctgaattatttgcaaatagaattgctaatgaaaaagaaaaaaaatgttgatgttaattaaatggtgattaaaaatttatctcctttaaatctaaaaagtgcagctttaataatcagttgtcatataaataagtaccttgtactgaaatcccttgcggtttaagacctaaataaacactaatttgagaactctaaatacctta

SEQ ID NO: 14608 - DNA, 502 bp, Homo sapiens
cactttgaaagaaaactgccattttgtatttaatagcctccaggttctttcagtaatgttatttgctctgtgtgtttttgtgtgtttgttgatgtgcgtttgtgcatatgcgtgagtttcattgccggggttggggcacaattgtggactggggccatgaggcttccctggtccccactgaacccaccttagttccacatttggctgcatcttgaattatgccgactccagacttctcctccttttttgcccttggctcttgacactctaaacccctggaccatctgaatggagcagccaagttcagtcccacatttctgtactgttcctctttcacagctggaatatgtcacatgatgaagttgtatagaaacagaaccatggatggatggccaggattgccgtggtccctagctagatccccttcctatcaatcacctgatagcaacagggacagctgccaataccctgctctttactcaatggtaccagggagggagca

SEQ ID NO: 14609 - DNA, 361 bp, Homo sapiens
acaaatgaatattgaggtggtggccagggtcggaggtaagaggtgcggctgtgttcctaggagcaggctttttctttaattttctctcaaccgtctcacggagaggccgcacattcagtggaaagtgtcgttttggagtcagcaaattgggtttaagttctggctccatggctgtgtggccttgagcaggttgcttggsctctctgtacctcagtttgctctcctgttaaatgaaagagctctggagagccaggtcagaaagcgtgtggcacattgtaggtgctcattgaatgctagtgtctccagctccaccagagcagccccctcacatggaagatagaaaaaccaaggctctggccgg

SEQ ID NO: 14610 - DNA, 335 bp, Homo sapiens
caaggaaagtaaaggcaagattgagaattttggtagagaactggaaatcataaagaagaaacaaaagttctagaactgaaaatgcaataactaaaattaagaagtcaatatcaggggttcaagaccagcctggccaacatgatgaaaccccatctctactaaaaatacaaaaattagctgggcctggtggcacatgcctgtaatcccagctacttgggtggctgaggtgggagaatcacttgaacccaggagacagaggctgcagtgagctgagattgtgccactgcactccagtctgggtgacagagcaagacattgtcttaaaaaaaaaaaaa

SEQ ID NO: 14611 - DNA, 206 bp, Homo sapiens
caactattatttcttcaaatattttttcaccccccagtcttgtcttttttagggacttcaataacatgagtggcagatcttgttttacactcccatgggtccttcaggctctcatcttttttctttttccagtctattttctgtcttgwtaatattgattaatttttatttaccttccatggtcctcactgattgttttctttgtc

SEQ ID NO: 14612 - DNA, 50 bp, Homo sapiens
aaaaaaaaaaaaaaaaaaaaaaaaaaaaaaaaaaaaaaaaaaarraaaaa

SEQ ID NO: 14613 - DNA, 410 bp, Homo sapiens
  misc_feature 106: n=a, g, c or t
aattttaaatcggtacaagatggcggagggggwcgaggcagcgcgagggcagcaaccgcaccaggggctgtggcgccggcgacgaccagcgacccaagcgccgcgnttaaccacgtctcgtccacgacctccctaggtgagaattatgaagatgatgacctagtaaattctgatgaggttatgaagaaaccatgtccagtacagattgttcttgctcatgaagatgaccataactttgaacttgatgaagaagctttggagcagatattgctacaggagcacatacgagatcttaacatagtagtggtatctgtggcaggagcttttcgtaaagggaagtcatttctactggacttcatgcttagatacatgtataacaaggtgaatagtcttttaaattgaacccaaaa

SEQ ID NO: 14614 - DNA, 423 bp, Homo sapiens
cattmattgtttgttttggccaaataaaaatgcttgtatttctttaaaaagtaagcctgaatgtagagtaaaaggggaaatgcsaagattttggggtttttttgtttcctttttttgtttgtttgtttgtttttttggagaagagcatcctcttttgtgtagtttgacctaaaaatgaaccttggctctgcttgtgatcagaacatgaacttttttttttaaagaagatttgagcatttttctgtaatcacatcaaaatgatgttttctgtgtaaagcgagatacatatttctcataatgcagcattgtgagaagtcagttcggaccactgcaccaacactgtcgtatccttgttaaaatggtgtgtaccttacaaattataatttatgtgccaggttcgttttgtacttaatttgctattat

SEQ ID NO: 14615 - DNA, 163 bp, Homo sapiens
cattttagattttctatttttgaaaactattattattttcacaggccagcaaggtggcttatgcctataatcccagcaacctgagaggcaaggcaggaggatcgtttcaggccaggagttcaagaccagcctgggcgatgtagcaagaccctgtctcaacaaa

SEQ ID NO: 14616 - DNA, 495 bp, Homo sapiens
ttggtgaaaatttcagagagtaaaataaaaatctgagaaacagaagcacttgagaagaaggtaaaaatatattattatagcaacaaagtaacagtactaatactgttattattattatactgtgctgacatgtagtattatattgtgctggcatggaggtagttttgtgttgttcttataaggaggattgtctaaaaaggactctgagagttctctctgaattgcctaaacaatgagctagttagcactggggcttaccccttctcctagcaagaagagctcctcattgtcagctgcctgtgggtctaggggccctttgctccagcagaaggtgctgcagtgagccacaggactccaaatcaccaggtgctgagcagctaatattcccagacagcccttataaacagcagcacccaaacctggagtacttggtgctcaagtagtgtatttgtcttctccccgacaacacaggcaattaacaaggccaccttccct

SEQ ID NO: 14617 - DNA, 430 bp, Homo sapiens
  misc_feature 88: n=a, g, c or t
tattsaatagaatattatgcacccattaaaatgtttatataggctgggctcacacctgtaatcccagaactttgggaagctgaagcgngaggattgcttgaggccaggggtttgataccagcctgggcaacatggcaaaaccctgtctctacaaaatttttttttttaattagccaggcgtggcagtgtgcacctgcagtccttgctacttgggaggctgaggcagaaggatggcttgaaccaaggagttcagttgcaccactgcactcctgggttattttagagaccctgtctctaaaataaataaaaaagaagttagagaccagcctgggcaacatagtaagaccctgtctctacaaaaaataaaaagattggctgggcatgatggcacacgcctgtagtcccagctacttaggtggctgacgtggga

SEQ ID NO: 14618 - DNA, 352 bp, Homo sapiens
gctgaaactggatcccttccttacatcttatacaaaaatcaattcaagatggattaaagacttaaacgttagacctaaaaccataaaaaccctagaagaaaacctaggcattaccattcaggacataggcatgggcaagaacttcatttctaaaacaccaagcaatggcaacaaaagacaaaattgacaaatggcatctaattaaatgaaagagcttctgcatagcaaaagaaactaccatcagagtgaacaggcaacctacaaaatgggagaaaatttttgcaacctactcatctgacaaagggctaatatccagaatctacaatgaactcaaacaaatttacaagaaaaa

SEQ ID NO: 14619 - DNA, 83 bp, Homo sapiens
aaatttaataaactgtaccatgctgctgcatgttttcaagtacatgttgaacagtaaggattggggagttgttttttaatggt

SEQ ID NO: 14620 - DNA, 321 bp, Homo sapiens
caactttttcatttaatccagaagggtagggactatgcagtgtaagctgcatcacttctgctttcttcctactagtgacaatcatctggtcttgccctcaagcaacaattgctagagtaacatctttgtataagcaagtaaccccagatagagttgacgtttcagctttgggctgtcaaaagggtatgtcatggaccaaatcactgttagtacgggtatgtttgcatttggtcactgatatgtaaatgactgctagcccacggctggaccacttctcaatcagcaaataaagccatgtctattttgctatctcagcataaa

SEQ ID NO: 14621 - DNA, 491 bp, Homo sapiens
tcttcatggagtggtttattttaattttgagagctctatatccaacataatttaacacctggtcagtttaaagcattgttctgagttatttatatcagccctctcccttggtactatgttttaaaaatctggtgtgtattttgcacttctagcacatctcagtttggactaggcacatttcaagtgctcagtgccacatcttcctagtgtcttactagttggtcagtacaggtatgacttatgttgaattttgcctagttacgaagatatgaatcttaataataggatctcttagtattagcactcattggattttctaagtggaaatgtaatggcagtgcaatgatttaacattgtttactacagacgtttcttgaagacttctgagttatcgtaagcatgtacaaaaggttatttcttaagcttgcatttaaaatgcgtttacttcgtatgatcctcagcaagactatgagttgggaatattacatgct

SEQ ID NO: 14622 - DNA, 492 bp, Homo sapiens
taaaggatgtgatggagaagttatcaactggtgttttcagacctcagttggatgaacccattccactgtatgaggcaaaagtttccatggaagctgttcagaaaaatcaaggaagaaaaaagcaagttgttcaattttaattttcttctttctcagacctcagtcggatgaacatattccagtatttgaagccagaattttctttggaaattgttgagaaaaaccaaggaagataaaacaagttgcatttttaagcacgtttctctgctaagacaagatgctcagttgacacatttgaaaagtgtttgaaaaattcttgtgcaaatgatcaagataattctataattaacatcttaagggaatttttctaaaaaccttttcattgtttctatatattttgcccctgctataaaattccttccatgaagaaaactgctgctttcagcaaaagtcacactactcttgataaaagctgttgcaggcctttgctaa

SEQ ID NO: 14623 - DNA, 483 bp, Homo sapiens
ctaatattttgtctatgatccatttttcacctctaggcccacttttttgaccctcacacatcacggtagattaggaatttcttaatgctgtactggttttggaggtaaggaagatgggactagcccactttgctttgtcaggctgagagggaagaagtgattccattgagccaggacttcagtggccaaaactacctcccctggcttcagaatcccttccccagaccaaccctgcgtgatatcagcatgtggtaaaacactcctgtgtctttagagactgcagtctataaatgatttttctgtcttccatgggccttgcctgcaagcactttccatctttccctaggtttcaggaatgctcaagaattacgggatcttgactgggcacggtggctcacacctgtaatcccagcattttggtaggccaaggcgagtgaatcatttgaggtcaggagtttgagaccagcttggccaacgtggtga

SEQ ID NO: 14624 - DNA, 472 bp, Homo sapiens
aaagaagaaggcggtggccttcagccccgtcactgagctcaagaaagacactgatttcgagcaccgcatgccacgggagcagtggtggctgagcctgcggctcatgctgaagatgctggcacaataccgcatcagtatggccgcctacgtgtcaggggagctggagcacgtgacccgccgcaccctgagcatggacaagggcttctgaggccagccatgcccacgsscctccccagcccccacccatgccagcgcagscagggctcagatggggcctgggctgttgtgtctggagcctgcaggcaggtgggggctgcgtccctgctcagcccatcccctgcctctatccctggccacctgccaggcctccctccggctggtgtcttgagaccagcctgccaggccctccagcaggaggacagagtgccctggggcatccaccttcctgcccaggggacgtggcgctgtcggt

SEQ ID NO: 14625 - DNA, 484 bp, Homo sapiens
  misc_feature 448: n=a, g, c or t
tctgtcaggtattaatatggttagaattgttcttacaactggtaattatagtcaatagagataaaacagatgatgtactgacaaatttttgtgaacttagattttaaagaaagttgttgtataatcatatcatttaaaaatactacattagggctgggcatggtggctcacacctgtaatcccagcactttgggaggccgaggcaggtggatcacgaggtcagttcgagactagcctggctaatacagtgaaaccccatctctactaaaaatacaaaattagccgggcatgggggcgcgcacctgtagttccagctactcgggaggctgaggcaggataattgcttgaacccaggagatggaggttgcagtgagccaagattgccccactgcactccaccctgggcaatggagtaggactctgtctcaaaaaaaaaaaaattattggntcttataaagtacttgtgtggaagctttgwttccac

SEQ ID NO: 14626 - DNA, 359 bp, Homo sapiens
  misc_feature 330: n=a, g, c or t
gcttgtgcgcatgtccccgcgcagggtcgggcgctggggtgtggagactgaaccttgcagacacccgggtccgcacgtctgggatggacgtggtgagtgcacgtgcgcacgcgctgcgtaggggcggctgcgctcatgcsacatcgggagtggtgcttggagaggccacctactcaccgcgcccccaagaggccgggggtttgtccctggtgttggccctaccctgcgcgatccagtcttgtcgtttcggggcttcattaccagagccccgtgaatcctttgctagatgcttaaaaacattttccccattgtacatagctgtttccacgnaataaaaagctttacatttaaaagaaaaa

SEQ ID NO: 14627 - DNA, 52 bp, Homo sapiens
gagaccatcaactatggaaaggagatctagggaacaccgtcttgaacccgcc

SEQ ID NO: 14628 - DNA, 511 bp, Homo sapiens
ttctagccgtgtgaccttggacaagcctcttcagttctctgtattctcctcagctgtaaaatgaaggactaaactattcaaatcagttccataagcattcatcaggcaccttctcggagtaagacatcatgctcagccacctataaaattctatgatcctgaatagtatcaatgggaaaatatcagagcaaagcaaaatagtctgtttgtggcaaggttgaagagagaacccaaatagccgactgcattacctcatctcaatgagcaatgtttgtaaatatccaaagtgtttaattttgagacactcttgagaaatcctttgccaataagaaattggcagatatggttctattaacacctatcagccttgaaccttccaaaaattaaacatttaaactcactttgcaccttagtcaaatggcgtgcttctggagagaaatctgggaagatcaaagttattaacactcccgatggcaacagtttaagaataggatgtgtcaaaaaaaaaaaa

SEQ ID NO: 14629 - DNA, 233 bp, Homo sapiens
ttactttggactaaagaatatattgggcgaagaatagagggggagcttgcaggaaccagcaatgagaaggccaggaaaagaaagagctgaaaatggagaaaaccagagttagaactgttggatacaggagaagaaacagcagctccactaccgacccccgccccaggtttgatgtccttccaagaataaagtctttccctggtaaaaaaaaaaaaaaaaaaaaaaaaaaaaaa

SEQ ID NO: 14630 - DNA, 129 bp, Homo sapiens
aaaagtctgagaccagccctgccacttactagcaggtcccgtcagtttgggcttctctttctcaccaatgaaatgaataggagaagttcagctctcagatcttgcaactctgagagtccttttcccagc

SEQ ID NO: 14631 - DNA, 206 bp, Homo sapiens
atttttttcatttcttccactaaagcgtttgcgagacttcaaggtataatctatcccagatcctttcccagagagaaacttggcgatcacgttttcacatgatgctcacgctcagggcgcttcaattatccctccccacaaagataggtggcgcgtgtttcagggtctctcgtctctctcctacagaaaaaaaaaaagaaaaaagc

SEQ ID NO: 14632 - DNA, 475 bp, Homo sapiens
ctattgcatattgtcagtattccacccattgtgcgattctccaattttgttaaattagagaggaggttggtgtgtgagtcaatttttctgtcttatttatcttgacaaacaatttaagagattatctggcatttggagttggcgcagattaattatgtagattatatccacagttctcatccaaattccactataaacacaagaagaaaaaactggttggtcttaccatgtgaacatttcattttggatataaagagggaaatgaaaatgttgatgatccaaacctgcctgacccaaggaaattcctaagtgttttagttacatgtccttgaagttgtttctttacacattttgttcactgagggcctctttactggcttgggtgcaggaactcagtctcatgtttgccatcccaaagttctgccttacactgtgttggtcttatcatggccattgtttttccacatggtagcaa

SEQ ID NO: 14633 - DNA, 520 bp, Homo sapiens
aatatattttttgccctgggctttgagatactgcttcaacttgagcttttggggaactaattagtgtttcaacagtgagtatcttttcccttcaatttatctactaaattttgaatataagagttcttctttttagttctagaaagtactttgctgtaattttttgttcaagttccatttcctaggagttgcctgttctgtgtattctgcttgttgtttctatctggctgttagtcttcctgagtgcagcgttatataattttgccttcacatggctttattcacccttgggactcagatctacttccttagtgtgctttcagcagcagccattcagtgagcaataagaagacacatacacggctgggtgcgctggctcatgcctgcaatcgcagcgctttgagaggccaaggcaggtggatcacttggggtcgggagttcgggaccagcctggccaacatggtgaaacccccgtcttaatatagaaaaattagccgggtgtggtgatgtgtgcctgtgg

SEQ ID NO: 14634 - DNA, 367 bp, Homo sapiens
cagcaagcccaggcacttcgggctgtccccggcccccagagcccgggcaccgtggtcatcatcgccatcctgtctatcctcctggccgtcctcctcacggtcctcctggctgtgctcatatacacctgcttcaacagctgcaggagcacttccctatcaggcccagaggaggcagggagtgtgagaagatacaccacgcacctcgcgttcagcactcctgccgagggggcttcctgaggggttccagaggggcccacgtgtccctccacctcctccctggcccaggctgcagagcctgagctgggacacgccctgaagcttctggaccctgagagagattgtttcttttctttactatttttttttt

SEQ ID NO: 14635 - DNA, 308 bp, Homo sapiens
ttccacttcaggctgggcgtggtggctcatgcctgtaatcctaacactttgagaggcccaggtgggtggattgcgtgasttaggagttggagaccagcccgggcaacacggtgaaatgccgtctctattaaaatacaaaaaattagccggatgtggtggtgtgcacctgtagtcccagctacttgggaggctgaggtaggataattgctttaacctggaaggcggaggttgcaatgagccaagattgtgccactgcactccagcctgggcaacagagccagactctgtctccataaaaaaaaaaaaaa

SEQ ID NO: 14636 - DNA, 465 bp, Homo sapiens
aaagtaagtcaaatatatgggtagaccaaaggaagatgagttattttaacaaatgatgtttgtacagaattgtcttagcctccattccgtctcttgtggtcagaatgttgctttcctcctgctacatagagggcatctttcacaagggagttttgtttcttgatttcaagaaggggagrtcagaggccagatgcagtggctcaggcttgtaatcccagcactttgggaggccgaggtgggtgaatcatttgaggccgggagtttgaagccagcctggccaacatggtgaaacttgtctcaactaaaactacaaaaattagccagtgtggtggtgggtgcctgtaatccgagctactccagaggctgaggcaggagaatcgcttgaacccgggaggtggaggttgcagtgagcagagatcgcgccactggactctagcctgggggacagagcgagactcagtctca

SEQ ID NO: 14637 - DNA, 288 bp, Homo sapiens
cccacaggctgggtgtggtggcttatgcctgtaatcccagcactttcggaggccgaggtgggtggatcatgaggtcaataaattgagaccatcctggccaacatggtgaaacccatctctactaaaaccacaaaaattagctgggcgtggtggcgcacacctgtagtcccagctacttgggaggctgaggcaggagaatcactggaacctgggaggcagaggttgcagtgagccgagattgtgccactgcactccagcctggtgacagagcgagactccatcaaaaaa

SEQ ID NO: 14638 - DNA, 222 bp, Homo sapiens
taaaaaagaagttagagaccagcctgggcaacatagtaagaccctgtctctacaaaaaataaaaagattagctgggcatgatggcacacgcctgtagtcccagctacttaggtggctgacgtgggaggactgcttgagcctggaaggtcgaggctgcagtgagctctgattgtgatcacaccaccatattccagactggaagacagagcaaaaccttatcaa

SEQ ID NO: 14639 - DNA, 251 bp, Homo sapiens
gagagaaaggaaagaaaggaaggaagggaagggaagcgaaaaagaaagaaaaatmaaaagaaaagaaagamagagcagagaaagamagasaaagasaaaggaaggaaggaagggagggaggaaggaagggagggaaagggaagggaagggacaagaagaagaaagawawakataagawaggtaggaagggagggaggaaggaagggagggaaaaggaagggaaggggcaggcataaaaaaaaaaaaaaaaa

SEQ ID NO: 14640 - DNA, 498 bp, Homo sapiens
gttgttttgttttggatggggaaggtagttttaatttggcaagtgttgctcttcttaaaacactgctcaaattaattagctgaagatacttagtatcctcggctgcttgttagcagagaaaggactcaccttagtggtgactggtttaaaaaatataaatatatatcatttgtacacgaagaactcttcccagtggaaactggctgtgtttccgtatttctatgttctattcggagtgatcgtgaaatctaaggctgcttgatgttctgatgcttgtcaatgccgtcgtgctctgtgactccacgaaacgccaaggagcttcttccggacgcctcctcttcctctgtaacatacgtgtgaatagtcaaggtttaattttgctttaatctaataaagtcgaagtgggacttttatttttctgaaacagctttctaaaatccgcatcttccccagctgcgaggttggggggctggggtgccaaagggcgaggttccgaaa

SEQ ID NO: 14641 - DNA, 397 bp, Homo sapiens
tagtagggttttttaaacttaaatttgtggttgttttttttcctgtagattatctctgcaaatcattttgtgcattgagaagtgctggtctaagagcttttgaatatttatgatacatctgtatgttatgtaaagcacaataaaatattcctctgagactgaatattacctatttagatacctatgctcatgaagtatcaaatttttaaatagatttttataagtcttaaggaaaagaaataggaggaaaccgaaatttcctgagcacctattttgccagtataagaacttgaatttaggccgggcgcggtggctcacgtgcggtggcactttgggaggctgaggtgggcggatcatgaggtcaggagattgagaccatcctggctaatatggcgaa

SEQ ID NO: 14642 - DNA, 424 bp, Homo sapiens
tgttggtagatagtaagtgctttatatattttatttcatttaatccttataacagcctacgaaataggtactattaataactcaattttaaaaataagaaaatggaagcatagaaaagtgaactcaggcttgtagtcccagcactttgggaggccgaggtcgggggatcacgagatcgggagttcgaggccagcctgaccgacatggtgaaaccttgtctctactaaaaacacaaaaaattggctggacgtggtggcacgcgcctgtagtcccagctacttgggaggctgaagcaggagattcgcttgaacccaggaggtggaggttgcagtaagccaagattgctccactgcactccagcctgggcgacagaacgagactctgtctcaattaaaaaaaaaaaaaaatttacccgggcktggtg

SEQ ID NO: 14643 - DNA, 157 bp, Homo sapiens
cttcttcatcatctttgtggtcttccttgcttgaaccctctctactctgaggcactctgttggggtttgggaccctcctgggaaggcaagtggccagtgctgccactgagcctgtgcagggtacttgggagaaaggccctgtttccctggaactgct

SEQ ID NO: 14644 - DNA, 217 bp, Homo sapiens
atacaaaaatcagacgggcacagtggtggtgcccacctgtgatcccagctactcaggagtctgaggcaggagaattacttgaacctgggaggcagaggttgcagtgagctgagattgtgccactgtactccagcctgggcaacaagagcgagactccgtttccaaaaaaataagagagaatagaagaagctactgcatgatgttagttaccaagcct

SEQ ID NO: 14645 - DNA, 501 bp, Homo sapiens
attaccagcactcacccttgtccacctgcccagtggcaccgccatgcagaagcccagcggcctgaagccccccggccgtggggggaagcactccagccccatgggccggacatctactgggtcagcttcatcctcggcggcggtggccgctagctccaaggaaggtacgtggcacaccaaggatggggggtgaggggactggctacatgggatgagtgttcttctggaagagccccaggagcacaggccactctgtgaccaatctgatgggggacgctgagtgtcatgagctcctgtaatggggcctgatcaacactgggaggttggcagaggtttccccagggaggggacatgggcgctgaggtctggagggtgaataggtgattcactagctgaagaggaaaaggttcaggtacggtggctcacgcctgtaatcccagcactttgggaggctgaggcggctggatcactggaggtcaagagttcgagaccgaaaccagc

SEQ ID NO: 14646 - DNA, 470 bp, Homo sapiens
agggacttccaggtttctcttcttgtactaaaaacagcacagaaagcacgattttctcacgcaaaactgagaaccatgcagtggggcaccacagtcttgattccatgaagatgaatagttaccatttggcgagcactatgtscagacagtgttccaactgtggtatatttatttaacccttaaaaacaatcccggccgggcgcggtggctcatgcctgtaatcccaacactttgggaggccgaggcgggcggatcaccaggtcaggagatccagaccatcctggctaacacggtgaaatcccgtctctactaaaaatacaaaaaattagccgggcatggtggcacgcgcccgtattcccagctactcgggaggctgaggcgggagaatcacttgaacccgggaggcggaggttgccgtgagccgggatcgcgccattgcactccagcctgggcgacctaggctccgtttc

SEQ ID NO: 14647 - DNA, 293 bp, Homo sapiens
aacctagccgctgggctgtgcggacaggttcgcgtggggstcctgggcctcccgcagccgcgtgatccgccagccttgacctcccaaagtgctgggattacaggcatgagscaccgcgcccggcctatagtcagttactgagaggggttgctgttgccacatggcgactgtggtcaccgtctctcctggacctgcctagatccaaaagccagccctggaagaacacctctcattctcaagaagaagttaatgtctgccttacagtagatgtccaataaatcttctttgaacaa

SEQ ID NO: 14648 - DNA, 298 bp, Homo sapiens
aaaagtgagccagaggagagctgakgagaggagggggaggcctacgacctgggccctgggctctgaaggtctggcgtattctgacaggacacagtgagcgtctgtagaggagaggcttgaaataaaggagcacgaatattgcctggatttctggaggcctactttaaggctggccaattctgcaagaaaggcaaggaggaggagactggctcacagctctggaggasccccttctgtcagctgtggggcttgacaccacttgaacaagaaaaggagggggaaactgcaccacatcagt

SEQ ID NO: 14649 - DNA, 322 bp, Homo sapiens
tttaaactgactgtgcttcagtttcctattttgcaatggggataataagaagagtgccattctcattcctagaatagatgaatttattaagacggaaagtagcatggtggttgccggggaccaggaggaggttagtgtttaatgaggagttaaaggaatggggagttcgtgtttaatgggtacagagtttcagtttgagaagatgaaaaagtgctgaaaatggatgacagtgacggctgctcaacagtggcagtatacttaatgccaccgaactgtttgcttaaagacagttaaagtgctgagttttattgctatgaatatt

SEQ ID NO: 14650 - DNA, 486 bp, Homo sapiens
ctctactaaaaatacaaaaactagctgggggtggtggcaggggcctgtaatcccagctactcgggaggctgatgcaggagaatcgcttgagcctgggaggcagaggttgcagtgagctgagattgagccactgcactccaacctgggcaacagagtgagactctgtcttgaaaaaaattaaaatccaaatgaaaccaattcctagtttccacttacggcatctaaggtggttgtacagaaactatcttatggatttgtgagtaaatttagtagactgcttctcttgaaatataggctgggcgtggtggctcgtgcctgtaatcccagcactttgggaagccaaggtgggcagatcacttgaggccaggagtttgagaccagcctagccaacatggtgaaacctgtctctactaaaaatataaaaattagctgggcgtggttgcgcatscctgtaatcccagctactccagaggctgaggcggaaga

SEQ ID NO: 14651 - DNA, 478 bp, Homo sapiens
gttattggtgatgctaatctaaacacatggagcatttgtgatatttctgataatatttcttgtatggagtgatggaagatttaagcttattttagtttatctttttaaaaactttccttcaattgtagttttgggaataaaactttatgtttttggacccatttctagctttttaaaaaattaaacctttgatcatttatcagaatttattttagggtaaaagtaactttttaccagaaagaacatgtaaatttctaagactgtgtcttagattaaaatgaagtaagaacatagcactttggtaagaattatttttcaaagggccaggcgcggtggctcatgcctataatgctcagcactttgggaggccggggcaggaggatcgtctgaggtcaggagttcaacaccagcctggccaacatagtgaaaccctgtctctattaaaaataaaaaaattagccaggcatgatggcactca

SEQ ID NO: 14652 - DNA, 447 bp, Homo sapiens
gatgagatgaaagaggtggagtttaaagcaagtgagatatgataaacaatgatgaaagcaaaaatagggcagttgaaccagagtcagccagttggcataactgccaataaatgaggcagtgtagaataactaataatgattggaatcaaggaaaagagagcatagaggaatcagctaaattagtatgttttatccatagttacatgactaacaaatgattaaaaagaagttattctctagataattttttaaataaaagtactgttaatatataaactaagttattcattcactgtttttcttcacagtaagaatgacaaaaatctgtgttctttgtacttatcaagtgactcaaattttggccacttcactgtcactgatggcttatagaatgactctagcagtactcaagttattgaactatcaaatgggtttttaattgatatt

SEQ ID NO: 14653 - DNA, 438 bp, Homo sapiens
  misc_feature 389: n=a, g, c or t
gggtgcgtggtcgtgcggcaagtgagcgatttggtgaacagacactcccttctgtaggtaagaatatctcggggggcgaattaattgaagaagcaccgtcatcccttggtcttagcagtgtcgcctctctcttcccgggtttggagagctgggggcgggttcctggctctgcgggcctgggctacactctgagccgcgtgaggagctctccccctacgccgcagcccgcgtgctgggattcacccaagtgggtttgtctggaattcccatttgcagccttctggaagcgcagattaaataaaatcatgattcccgtaaagtgccagcacctcctatggttacatcccacgttcacvgattttaactgaaaaggcattttagcatagaantccaaattccaatccaaggatggagaaaaggtccttcctagtgggaaaa

SEQ ID NO: 14654 - DNA, 388 bp, Homo sapiens
tcctttcgctgatgcaagagcctagtgcggtggtgggagaggtatcggcaggggcagcgctgccgccggggcctggggctgacccgtctgacttcccgtccgtgccgagcccactcgagccgcagccatgtctggggacgagatgatttttgatcctactatgagcaaaaaaaaaaaraaraagaagaagccttttatgttagatgaggaaggggatacccaaacagaggaaacccagccttcagaaacaaaagaagtggagccagagccaactgaggacaaggatttggaagctgatgaagaggacactaggaaaaaagatgcttctgctaatctgtatgttgacaccttgtaattaaaatacgtaccatgaaaaaaaaaaaaaaaa

SEQ ID NO: 14655 - DNA, 79 bp, Homo sapiens
  misc_feature 76: n=a, g, c or t
acccgggtgagaggttcccgcggctcagggaagatggcggcasgtggtgctggctgctgggttgcgcgcggcgagnagc

SEQ ID NO: 14656 - DNA, 482 bp, Homo sapiens
  misc_feature 19,192,196,413: n=a, g, c or t
aagcccagcagcggcgcgnccgcgagcccctggaggaagacgaggaaggggacgatgagtttgacgatgaggccccggagagctgactttcgccagcgcccaggcggaagcgagagaagaggagcggcgagtgcgggagaccgtgcgcagggataaaacgctcctgaaggagaagaggaagcgacgcrggantgtntcatcgaacagaagaaaagaaaactccttccagacactattttggagaagttaaccacagcttcacagactaacatcaagaaatcgccaggaaaggtgaaagaagttaatttgcaaaagaaaaatgaagactgtgaaaaaggaaatgactccaagagagttaaagtacaaaaagtacagtctgtcagccagaataaaagctacttggccgtaastanaaagaccaagatctgagagattcaaggcaacaagcagcacaagccttcatacataattcattatatggg

SEQ ID NO: 14657 - DNA, 508 bp, Homo sapiens
  misc_feature 424: n=a, g, c or t
cttatatgcctggagcctattcccaggtaactgcctttttttttttaataaaaagctttattaaaaataatttttgaataataaatacatttgtaggaaattactaccttgaattttgttttaaatagtagacacccctttatcttctcctagatttacttgttaaccattttgtcacatttgctttctccctgtatccatattcttcagaattttttcctagttttaaactctagcttgtgtgattttaatactgcttctcctgttccctctttttttgaattacctgatatttcttatgtttgttgtgtatgtctcttgaaaatggcagatttctgtattttaatgctttacctaattggatagtttttaagataatagcacttatattgatttgattttcccttctttaccgatttatttnacatttttatttsctctgtttcttactgtkgcttattatcaacttgtgattcattcccttaccccgcctcccagttaatgtgga

SEQ ID NO: 14658 - DNA, 329 bp, Homo sapiens
tactcatttcttataagaagtaaagatatattggccgggtgcggtggctcgcgcctataatcccagcactttgggaggctgaggcaggcggatcacaatgtcaagagattgagaccatcctggctaacacggtgaaacctatcgctactaaaaatacaaaaaataagacgggcgtggtggcgggcacctgtagtcccagctattcaggaggctgaggtaggaggacaccgtgaacttgggaggcagagcttgcagtgagccgagatcatgtcactgcactccaacctgggctgcagagtgagactccgtcccaaaaaaaaaaaaaaaaa

SEQ ID NO: 14659 - DNA, 398 bp, Homo sapiens
gagaataggtttggtggtccgagatccgaggcaacggtggctcctcgaggtccacggtcccggagatgggatttcgccatgttgcccaggctgatcttgaactcctgggctgaagatatccaccctcctcggcctcccaatgtgctgggattacaggcctgagccaccatgcctggcccaagtgttcattgatgatgagagatgggcttttcgcatcaaatcacaaaaatatgctgagtaatgtgaggattcttgcttttctggaagctaacacatagtcagtgccaaagtagtgacagaagtggattgagaggaaagagagaggccaagacaatttgtaactagaatccgtttttcccttttcctttttttaaacaaacaaacatacaaaaaaaaaa

SEQ ID NO: 14660 - DNA, 116 bp, Homo sapiens
taatttttttgattccaagttttggtcttgtaaccactataactctctgtgarcatttttccaggtggctggaagaaggaagaaaacctgatatagccaatgctgttgtagtcgtt

SEQ ID NO: 14661 - DNA, 274 bp, Homo sapiens
  misc_feature 209: n=a, g, c or t
tattttaaggaattgaaacctagcaatcttattggagagacaagaattggtctccagctgcctttgatcaagattcgggtgcaagtggagcaggagccatatacctggagggaatgtgctttgtcacaccaaagaggatttttttttcttcaaacttgtatgttgcctaggtttcaaattctttgccgcaastgatctgctttcattrnctggaattctgtaggagatactggtgacctaagctaagttgcactcagcatactcagtgtcaagc

SEQ ID NO: 14662 - DNA, 497 bp, Homo sapiens
ttacatttctgagtttccatggcagagttgtgagtggggctgtgatataatttaacttctcctaaattgctgacaccgataaccctataaattaacagatggcggagggaaatctcctggcttcttcctggctagttttttttaatggtctgatttttgtaataggggttttgagtcccagccaggtatccctccacgggcagcggtgagagcttgtcccatttcatcgtctccgatgctggctgcgtggatttcacttcaatgaggatggagtgtcaagaaaactgttcacgtccctgctgagcgcgggcacctttgcagaagctgacgggtgggggccccagggtgcggcgcttggcggggctggtgagcagcttccagcggcacctgttggcgggattgcagtctgatgagcgtgcccagctgggtgcagggttccctgcaggttccttggttccctgcaggcccaggctgatgggccaggctctctgtttcca

SEQ ID NO: 14663 - DNA, 484 bp, Homo sapiens
tattattgagatagggtctggctctgcagcccaggctggagtgtagtggcgcgatctcggctcactgcagcctctgcctcccagtctcgagcggtcctcctgcctcggccccccgggtggctggaactacaggcatgtgctaccatgcccagctaattcctttgtatttttggtagagatgggatttcactatgttgtccaggctggtctcgaactcctgagctcaagtgatctgcctgcctcggcctcccaaagtgctgggattacaggcgtgascaccgtgcccagcccaaggtggtattattatcaatcccactgaacatatgaggaaactgaggctgctgagggtaggtgatttgcctgcagttatacaacttgtaccttgcgtgggagtcacttccttcttctcactctgcctgtytgtccaccatctaggggaccatcttcctgtggatcttctggcctagcttcaatgctgcactca

SEQ ID NO: 14664 - DNA, 461 bp, Homo sapiens
aaaaaattttatctgttctttttcttgctcagggctggtaggttggatctgaaccattaaaatcaaatggtccactaggcgtatgatctctttgagccaaatcagttcctgaatataaaggaggaaatgatgaggatgtactgaggcaacggggaagtatagaaacatccaagacaaaagccaagggatgcaaaggcagagacacaggtgctttttggtgacccagtggatatggcaaccagtgtaactgccatacaagaaaccctaggagcaaacccacaccactcattctcagctaagagattttacacaggcaaacgtgtcttaaaccatctataaatcagttattttatatgacagtcaaaaccttagaaaccttaggatcattatatctattttctgcctattaattgctgtgaggtttgatttgaccaatctgggacaatttattcatcagcttc

SEQ ID NO: 14665 - DNA, 481 bp, Homo sapiens
acattgttttgttttttgagtacttccttactttctggcactagaagaagttccagactcatcttgtatatttcctgccccagccctagaatcagccatttttccaaggatccctggttctattttttggtgaatcatgttagaaaccaagatctggttactcagtgtgctcattgctgttggaatatcatgacttctaggccttttcagtgtatagacctggaaaatatatgtatgtatacacatatataactattatctgtatctatattgaggtaaacatgagttcatactgatgactttgactatcagtactatatagttcattctggctttactctgctatctattacctccctctccaaaagtgagaaatctggctcacgccatctgacatctattaacttatttgttcagtcccatcgtccatgtacagcacttttagaattgttaacctgtatctccatgagaaatgccttta

SEQ ID NO: 14666 - DNA, 126 bp, Homo sapiens
rgccgggagcggtggctcacgcccttaatcccagctctcagggaggctaagaggcgggaggatagcttgagcccaggagttcgagacctgcctgggcaatatagcgagaccccgttctccagaaaa

SEQ ID NO: 14667 - DNA, 442 bp, Homo sapiens
gttagtttcttccgggtcattgacagaagcgtcaattcctgggagtagttcgttggttttctttcccctcatccttttgcctgctcccggcgaggggtggctttgatttcggcgatgagctcccagaaaggcaacgtggctcgttccagacctcagaagcaccagaatacgtttagcttcaaaaatgacaagttcgataaaagtgtgcagaccaagaaaattaatgcaaaacttcatgatggagtatgtcagcgctgtaaagaagttcttgagtggcgtgtaaaatacagcaaatacaaaccattatcaaaacctaaaaagtggttgaataaagaaacagaaaaaatagaacatactgaaaataatctaagttccaaccatagaagaagctgcagagaaatgaagaagtgatgatgatttagattttgatattgatttagaa

SEQ ID NO: 14668 - DNA, 90 bp, Homo sapiens
acatttgagtcagtggactgagtaaggaagatccccctcagtgtgagcaccatccaattggctgaggatagaacaaaaaaaaaaaaaaaa

SEQ ID NO: 14669 - DNA, 425 bp, Homo sapiens
ctttttccttttagtagctaaaatgctgaaaggcaatcctaaaggaagaaacaaaaatgtggtatactcactagctaacatcagatgttgaactactaagctctaactgaagcagcagcatacgttgacggctgcatctgaatcgtccaaatgtctttggttgstttgatcagtttgtacagtccatgggacagacacattagctggcttaccaactaacaggcagcaggaccatatgttctgaactaaaaaccaactatgtaatctggcagtggaggagtttgtgtctcaatctgagtttttgtcctatgacaaatggaatgcagtatgaaactatactattacattgcaaatttgataaatgacatggaatgagaaattcccctggaaaacttggatttgagatttttcataaaaatatgttc

SEQ ID NO: 14670 - DNA, 448 bp, Homo sapiens
ggcctggagacaggcatcccagggtataagcttccagctggatcacctttaactagcttacaaaaagacccttacacaaatactttccatttgtgagttaaaacagggttttttgacatcgaataaagcttcttttgtaagaagtttcttttatattgtaacaattggtgttgttagactgactatgtgttttatgaattgatcaatgagccatacatttttgctaggatgtatattttaataactacaaaaaaagagagtttaaaaaactattaagggtctgtctttaaaccacctaatagaggaatttaaaagtgaaggttgcagttgctagattttgccttggctaccttcagattcccacaatacttgtacataatgaactgtgcatgcttttacattctctaagggcttaacttcttaggcactgtaagactataagahcgca

SEQ ID NO: 14671 - DNA, 172 bp, Homo sapiens
gcaaaaattagccgggcatggtgacgtgcacctgtagtcccagctactagataggctgaggcaggagaattgcttgaatccgggaggcggaggttgcagtgagccgagatcgtgccactgaactccaacctgccaatagagcgagactccgtctcaaaaaaaaaaaaaaaaa

SEQ ID NO: 14672 - DNA, 308 bp, Homo sapiens
atttttttcctctggtttttagtaaatgttttttttgagattgcttagcaccagaatgatttgcaaatttgaaaataggaactccactaggaatgccggatagaagagtgcttcacatttgtagagggagacaagaactaaatatcacgacgtctttctgagccttttggtttgctaacgtgccccaaattcttattccaaacggtataggataattatgtgtaaatgaataccagctctacttagttttatttcatatttgtgtatctgaatatattaaaatatcttttttttttttggagggggag

SEQ ID NO: 14673 - DNA, 387 bp, Homo sapiens
  misc_feature 232..234: n=a, g, c or t
gcggggtgtcgtttcctttcgctgatgcaagagcctagtgcggtggtgggagaggtatcggcaggggcagcgctggcgccggggcctggggctgacccgtctgacttcccgtccgtgccgagcccactcgagccgcagccatgtctggggacgagatgatttttgatcctactatgagcaagaagaaaaagaagaagaagaagccttttatgttagatgaggaaggggatvnnnvacagaggaaacccagccttcagaaacaaaagaagtggagccagagccaactgaggacaaggatttggaagctgatgaagaggacactaggaaaaaagatgcttctgatgatctagatgacttgaacttctttaatcaaaaaaaaaaaaaaaa

SEQ ID NO: 14674 - DNA, 464 bp, Homo sapiens
ttggaaggaccagaaaactggtaagtgtgacccagatcaagtgtgaggagatgaggctggggatagtcaggggctggatcacccagggccttgtgggcccacatagggttttgggttttattctcagggcaatgggaagctgttggatggtttgatgaaggggagtgacaggatccgatgtacctatttaagaatttaagagggtcgggtgcggtggctcatgcctataatcctagcactttgagaggccaaggtgggctgatcacaaggtcaagagttcgtgaccagcctggccaatatggtgaaaccccatgtctactaaaaatacaaaaattagctgggcatggtggcacacacttgtagtccgagctactcgggaggctgaggcagaagaatcgcttgaacccaggaggcggaggtttgcagtgagctcagattgcgtcactgcactccaacctgggtga

SEQ ID NO: 14675 - DNA, 491 bp, Homo sapiens
cttgaaattgtctttaaagatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagctttta

SEQ ID NO: 14676 - DNA, 275 bp, Homo sapiens
aaattacatgagtaacaaagtgtctctaacttatatatattttgaactctgaaccctgaaaatagagacaacccttccaagtacctagggacattcataaaaattgacaaaattcttttctaaattacaaactccataagaaaattttaaaaaacagaaactatactgacaatattctctataatacaacaagacaaaaatgaacaagcaaataaaaaactaaaaactccaacatcttgtaaattacaacagctttttttcttagcccagtcttg

SEQ ID NO: 14677 - DNA, 111 bp, Homo sapiens
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 14678 - DNA, 472 bp, Homo sapiens
ctttgctgtataatgaacaatcctaaacatcaatggcttaaaacaaaatcacttattagcacataatttggtaggttcatattttgggctggccgcagtaggttttgcagatttcacctggtcttgtcattttgctgcagtcggctggcattttgaccagggctggaggactatccatgtgtgacaggaagctggttggctggggtgcctagtttcttcttggttctcttccatgtgggcttgggcttggtcaaatggtcttgggtttctctatgcaggaagagaggacagccccaattaacaagtagttttaacgttttggcttttgtcatgttcactgatgtccttttggccaaaggaagtcacatggccaagtccagagtcgtcatagaacgggataacataagggagtagatacagggagacatgatttattggtcccaatgattcataccccttaccatgtgcaaga

SEQ ID NO: 14679 - DNA, 168 bp, Homo sapiens
tacataaaaaagacatttcagattaacactaatgttacacctcaaggaactggaaaaacaagaacaaacaaaacccaaagctagcagaaaagagatcagaactgaatgaaattgagaccaaacatgcacgcgtgtgcgcgcgcacacacacacacacacacacacacg

SEQ ID NO: 14680 - DNA, 61 bp, Homo sapiens
aaaaaaaaaaaaaaaaaaaaaaaaaaaaaaaaaaaaaaaaaaaaaaaaaaaaaaaaaaaaa

SEQ ID NO: 14681 - DNA, 61 bp, Homo sapiens; identical to SEQ ID NO: 14680

SEQ ID NO: 14682 - DNA, 59 bp, Homo sapiens
ataggtgttcttcaagatgactaatgtcaaaaattgagacatctgttgcggttcttttt

SEQ ID NO: 14683 - DNA, 419 bp, Homo sapiens
tcgcagtggcaaagacttggagtcggcccaggtgtccatcaatgatagactggattaagaaagggtggcgcatatacaccatggagtactttgcagccataaaaaaggatgagttaatgtccattgcagggacatggatgaagctggaggccatcgttctcggcaaactatcacaggatcagagaaccatctgcatgttctcactcataggtgggaggtgaacaatgagagcacatggacacgggaagggaaacatcacacaccagaacgtgtcgcgggggtaggggggtgggggaggaataacattaggagaaatacctaatgcaggtgatgggttgatgggttcagcaaaccaccagggcacgtgtacatctatgtaacaaaactgcacgtttctgcacatgtaacccagaactgaa

SEQ ID NO: 14684 - DNA, 448 bp, Homo sapiens
ccatagtgaaaagtttcttatattcactgaccaaagttgattcgtcattataattactgtttagcgcttttgtttgtttgtttttgagacggggtctcgctctgtcacccagcctggagtgcagtggcccgacctcggctcgctgcaacctccacgttctgggttcaggtgattcttgtgcctcggcctcccacatagctgcgattacaggcatgcacctccccgcccagctaattttgtatttttgatagagaccagtttttgccatgttggccaggctattttggtttgttttttgagatggagtctgttgcccaggttggagtacagtggtaccatctcggcttgctgcaacctccgcctcccaggttcaagcgactctcctgcctcagcctccggagtagcttggattacaggcacctaccaccacacccagctgattttgtat

SEQ ID NO: 14685 - DNA, 320 bp, Homo sapiens
  misc_feature 35: n=a, g, c or t
acactttcgcacacacaaacacgctaggacgctcntwcttcgctactgcatccccgaaccagcagagcgaaskactgcggggttctgttaacctcagcatcgtggggcgavrgagccattgtgcatcaaggagaggccggtgcctgcgctgccgtctctggcacctaacccagcagaccgctcaccccatcggctggaatgcttgctgattcctctgcacacttctaaggctgagaacctgaggacccagctggaaaatgccgtctgaacgctgccctcaggtatcccctgtagggatatgtcctcacatgccgtagtga

SEQ ID NO: 14686 - DNA, 399 bp, Homo sapiens
ctctaataccttttctgtttgtagtttttgttactctttcacattgtggtcatttctgttgttttctttttatttttaaatttgtctgtatccgttttacttctcacatctctttcttttgataagggtagtgccttggattcagcagaagctccagctgggagatccaggaaccattaataaacctcagagagatgctaagaatagagaacaagaacagaagcaaggggtgtgctaggcgtcaagggtgaaattacttgtgacttcgttttgtactcttagtaggtccttagttcactgcctctgactttttttatattgttggcttagattgcattcgaagacatattttgactgattatagcagcatataacatgctgaattaatcacttgctttt

SEQ ID NO: 14687 - DNA, 314 bp, Homo sapiens
ataatggcctccagttccatccaagttgtggcaaaatatattattcttttttttatggttgagtagtattccatggtatgtatataccacatgttatttatccaataattggttagtgggcccttaggttgattccatatctttgcaattgtgaattgtgctgtgataaacatacacatacaggtgtctttttgatatagtgatttcttttcctttgggtagatactcagaggaaaagaagtcattgtctgaaaaagacacttgcacatgcatgtttatagcagcacaattcacaattgcaaaaatatagaact

SEQ ID NO: 14688 - DNA, 97 bp, Homo sapiens
ataatggcctccagttccatccaagttgtggcaaaatatattattcttttttttatggttgagtagtattccatggtatgtatataccacatgttat

SEQ ID NO: 14689 - DNA, 92 bp, Homo sapiens
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 14690 - DNA, 340 bp, Homo sapiens
attacaatttaactttggggtttgggtaagacaaacatttaatgtataggattttggccaggtgtggtggctcacgcctgtaatcccagcactttgggaggccaaggtgggcggatcacgaggtcaggagatcgaaaccatcctggctaacatggtgaaacccatctctactaaaaatacaaaaaaaaaattagctgagcatggtggcgggcgcctgtagtcccagctacttgggaggctgaggcaggagaatgacgtgaacctgggaggcggasttgcagtgagccgagatctctccactgcactccagcctgggcgacagagcgagactccatctcaa

SEQ ID NO: 14691 - DNA, 157 bp, Homo sapiens
tcctttcgctgatgcaagagcctagtgcggtggtgggagaggtatcggcaggggcagcgctgccgccggggcctggggctgacccgtctgacttcccgtccgtgccgagcccactcgagccgcagccatgtctggggacgagatgatttttcgatcc

SEQ ID NO: 14692 - DNA, 444 bp, Homo sapiens
atgtttaaatcctatgtccaattcaagcctatctaactacatttggtaggattaacatttcatataacaaatggggcttaattaaaaactttaacttggaataaaggaacagggatcactttatcttctgccttcatttaccttagtccaagattcttgcaaaacaggcaactgaacaaacattaggtttatgtaggtaaaatgtgaaagcatttctcctccactttttaaaatttaatttacccagtacagcggggcaccagattacttgatctttgtattttgcagttttgagcctttgtgtcaatcccaagcacagagaggatctgccaaggaaaaacatttgcatcttcggagtagacattttgcagtttgtttaataacaacttctaaagtaagttgaattcatscattgtcactgattcaccaagtggatgttgcatt

SEQ ID NO: 14693 - DNA, 77 bp, Homo sapiens
  misc_feature 62: n=a, g, c or t
aaaccctcagggacctggtatagacgcagaatctgtttcacacaacaactgctatttgaagnaaaaaaaaaaaaaga

SEQ ID NO: 14694 - DNA, 75 bp, Homo sapiens
ataggtgttcttcaagatgactaatgtcaaaaattgagacatctgttgcggttctttttttttttttttttcccc

SEQ ID NO: 14695 - DNA, 406 bp, Homo sapiens
  misc_feature 198: n=a, g, c or t
tacaggcatgagcaccgtgcctggccagaaggtttttttaatatttaattgaacagggagatcatcgcctctcctccaggaacgcaactagaggaaaggacttgccttgcagcaagagagacctcagcgagccgggaagaggctcctccccacagaactgggcaccacccagmactrcccaccacaccaccgcgccanctcctcacctgcagcttgtggactttgtcattgagctccgcscgggcccgctcccsatcgctgcacttggactgcagctcctgcacctgcgsctccagcttcttcttsttatgttccacctcctgcttggcctggcccaggacccgcagctccccggccaggtctgsgttctctttctccagcgtctgcttattcttgtctaggttcg

SEQ ID NO: 14696 - DNA, 79 bp, Homo sapiens
caaagctctgtagcacagagaatgtggtgtcacagatacatcgccgagagaggtttctttctttctttttttttttttt

SEQ ID NO: 14697 - DNA, 368 bp, Homo sapiens
  misc_feature 319,324,329,333: n=a, g, c or t
ttattgtaatgatatttaaacattaattccagatcattgtcatcttcattgtatatgtcttaccaatttttgaaagttaaagcatatatatacacacacatatattatacacaacacatacatacacacacrcacacacacacasacamatatagtytcttacatttgctatacttattwtgagttgagtacataacaaggcaaggcagagagtgagtgtgtwtatgttttmagatttatttgatccmaccacttgaaaaaaatgtgaatttgttaccaaaacacmaagcgtktggtctaggtcctgmtgcttgccacncaganagccngtcnctgagacaatgagttttgtcagmagaaaggmttta

SEQ ID NO: 14698 - DNA, 73 bp, Homo sapiens
gaaaagaaataaaatgcctatgttgttgttctagaaaaaaaaaaaaaaaaaaaaaaaaaaaaaaaaaaaaaaa

SEQ ID NO: 14699 - DNA, 365 bp, Homo sapiens
aatttattttagaaaataaggcaaaccggctgggcgcggtggttcatgcttgtaatcccagcactttgagaggccgaggcgggcggatcgcttgagctcaggagttcgagaccagcctgggcaacacagcgaaacctcgtctctactaaaaatacaaaaattagccaagtggcgcgcgcctgttgtcccagctgctcgggaagctgaggcgggagaatcgcttgtattcaggaggcggaaattgcggtgagccgagatcgcgtcactgcactccagcctgggtgacacagtgagatcctgtctcaaaaaagaaaaaaaaaaaaaaaaaaaaaaaaaaaaaaaaaaaaaaaaaaaaaaaaaaaaaa

SEQ ID NO: 14700 - DNA, 288 bp, Homo sapiens
tctggccgggtgcggtggctcacgcctgtaatcccagsactttggggggctgaggcgggtggatcacgaggtcaggagattgagaccatcctggctaacacggtgaaacctgtctctactagaaatacaaaaaattagccaggtgtggtggcgggcacctgtagtcccatctactcgggaggctgaggcaggagaatggcgtgaatccgggaggaggagcttgcagtgagccaagatagcgccactgcactccagcctgggcaaaaaagcgaaactccgtctcaaaaa

SEQ ID NO: 14701 - DNA, 124 bp, Homo sapiens
ctgattctaggctggtcactactccgagcctgtgacgtttgcggcagscaggccgtcgacgatgcccagtgaaactctctgggaaattgcaaaagctgaagtggaaaaaaaaaaaaaaaaaagc

SEQ ID NO: 14702 - DNA, 357 bp, Homo sapiens
attacaatttaactttggggtttgggtaagacaaacatttaatgtataggattttggccaggtgtggtggctcacgcctgtaatcccagcactttgggaggccaaggtgggcggatcacgaggtcaggagatcgaaaccatcctggctaacatggtgaaaccccatctctactaaaaatacaaaaaaaaaattagctgagcatggtggcgggcgcctgtagtcccagctacttgggaggctgaggcaggagaatgacgtgaacctgggaggcggasttgcagtgagccgagatctctccactgmactccagcctgggcgacagagcgagactccatctcaaaaaaaaaaaaaaaaag

SEQ ID NO: 14703 - DNA, 60 bp, Homo sapiens
agagcattacggtgaggaccagtggsggccggtaccctggtccctgcaccggagcggggt

SEQ ID NO: 14704 - DNA, 195 bp, Homo sapiens
cataaaattccctttaaaaatgtacaattagtggctgggtgtggtggctcatgcctgtagtcccggcgctttgggaggctgaggtaggagaatggcgtgaacctgggaggcggasttgcagtgagccaggatcgcgccactgcactccagcctgggcgacagagcgagactccgtctcaaaaaaaaaaaaaaaaa

SEQ ID NO: 14705 - DNA, 74 bp, Homo sapiens
aaaccctcagggacctggtatagacgcagaatctgtttcacacaacaactgctatttgaaggaaaaaaaaaaaa

SEQ ID NO: 14706 - DNA, 293 bp, Homo sapiens
gttattcaggctgggcgtggtggctcatgcctgtaatcccagcactttgagaggctgaggcaggcggatcatttgaggtcaggagtttgagaccagcctggccaacatgattaaaccctgtctccactaaaaatagaaatattagctgggcatggtggcatgtgccgtgatcccagctcctscagaggctgaggcaggaaaattgcttgaacccaggaagcggaagttgcagtgagctgagatctcgccactgtgctccagcctgggcgacagggagactccctctcaaaaaa

SEQ ID NO: 14707 - DNA, 470 bp, Homo sapiens
catactattcaagaccaaggtagcagaaaagttacttgtatctgcttatcataagacgaaactctgcaacttggcaacggtggccagttttcgtaatgaaacagtctttagtaatttaatcttcatgcttcataacaaaccaaaaccccatgagatttccacattgcataattttgccttactaacagaatcatatccttaaggatgaccatcattcccccaactaaaacaaatacaaactaatgtatgatatttttttaagtgccagatcaatatggtctaaagcttcaataaggattgtgtgtaggtgaataaagacagctaagtgaatgtgtgtaaagtgtagcaaaagcagacagatatttatgtacagtattcatagaatggaaagttaaatatttttgcagtgtgtatttaaaagagaaactcaccataatagtgccgtctaaaaatctttgtaaagttattta

SEQ ID NO: 14708 - DNA, 345 bp, Homo sapiens
tatctttcgactttcaggaaattttatttggactgtcataactttaagttttgttttggttatttattgttgcttaaccaattatcccaaaacttaatggcctaaaactacacatctgtctatctgtcacgactgtatggattacctggggctagctggacagtttttctgctggtctcatttggcagctctcactgtgtggttaaacagtgtcagggactggtcatctggatgctcagctgcagtggaatgtctgagacggcttctttacccacaggtctgctgccttggtaattcttgatgtggsctttctstctgcatagcatctcatcctctcggatctct

SEQ ID NO: 14709 - DNA, 509 bp, Homo sapiens
ctgggcccgcggggaggaggcggggctgcgggggagagcgactgcgccaggtccgcgacaaatgaattagacacaattatccacgggagactcggttttcctctctgtaaattacggatattaggaatacttgccgcctggggttgttttgagcactttcattgtttaggtgctgtatttattgggtgtgcgttccctgggagagcccgagggagacggctcctgcaccggccccaagggcctctctgcccgtggagtgcaggagcgaaggggctggcctagctgaccaccagggccccttctggctctgaccgccctcctatcccaagtaattatttacacgtttcgcgttcgcttatgtattatgtgtaatcatggcacagtatcctgaagccgtcggagtctgtgtgctggtgcaaggtctgggacaaatttaagaagagagaggtgagctggagctgaggggtgggcgcgcagctaacaggaacgtcacctctggagagtctgag

SEQ ID NO: 14710 - DNA, 449 bp, Homo sapiens
tttttgtgtgtgtgtgtgcagaaagttgtttcagttggcctggcttctataatgttttactctctaaataacttctttatctttttcatgtataaacattacccagatgacatgacctttaccagctgttgatgtgaaataatatattatcactggttgatgtgaaataatatattatcactggtatcataagtatttcacagttaagggtagtgacatacactgtcgtagctcctttggaagagaccccaattgaacttctattggagtacaagaaattgttatttaaacctaccccattgtctgtggttggggaaaattcataacagtaagctaagtggtcattaatagggctgagttaaaatggtgtatcggatatatggtccaggaaaggaagtataggaagaaaagttgacctgatggtggccttgaagttcatgctgaggcta

SEQ ID NO: 14711 - DNA, 370 bp, Homo sapiens
ttgcatgtaggtgaaaatgacttatgacttattttatgttttcatttggggcttcttaataccgtctcttgattccctttcatcatctttttctaaaaccagccaaccacttgtcttatatgtagatatccagaactcccaattcctataagtgagtaagctacagcagggcaggatccacacaggttcctgcccctctagaagctgacgttcttgtaacctagtttggttccaagaaccacagggaggtgagaaaattattcactggataccagtgagctctaatcctaacacagatactcataactttgttgccttaaaaaaattatttaactgagtgggtgcagtggctcacgcctgtaatctcagc

SEQ ID NO: 14712 - DNA, 59 bp, Homo sapiens
ttctggaaaaagtaataataaatatagctacttaaaaaaaaaaaaaaaaaaaaaaaaaa

SEQ ID NO: 14713 - DNA, 216 bp, Homo sapiens
agttctagaccagcctggctaacatggcgaaacaccgtctctactaaaaatacgaaaattaggcgtggtggcaaatgcctgtaatcccagctccttgggaggctgaggcacgagaattgcttgaacccgggagccggagttgccgtgagccgagatcgcgccgtcgcattccaatatgcgcgacagagcgagactccatcgcaaaaaaaaaaaaaa

SEQ ID NO: 14714 - DNA, 217 bp, Homo sapiens
ttttttgtttgtctgttttgagacagggccttactgtgtcgcttaggctggatggggtgcagtggtgcagtcacagctcacacagctctgtctcctggacttaagcagtcctcctgccttagcctcccaagtagctgggactacaggtgcatgccaccacacccagtgagtttttctttttaaaaaaaaattttatttgtttattttttgagacgga

SEQ ID NO: 14715 - DNA, 50 bp, Homo sapiens
aaaaaaaaaaaaaaaaaaaaaaaaaaaaaaaaaaaaaaaaaaaaaaaaaa

SEQ ID NO: 14716 - DNA, 95 bp, Homo sapiens
aataagataaatttttaaaaaagagaagtgccatactgttttccaaagagtctgtaccattttccacttaccagcattatatgagagttccagtt

SEQ ID NO: 14717 - DNA, 80 bp, Homo sapiens
acatttgagtcagtggactgagtaaggaagatccccctcagtgtgagcaccatccaattggctgaggatagaacaaaaaa

SEQ ID NO: 14718 - DNA, 406 bp, Homo sapiens
  misc_feature 393: n=a, g, c or t
aataaataaataaattaggggaaaaaaaacccaaagtctcaatgtttatctgttaataacagtattcggatacttatgtggatacttcttttaaaaaaaaaaaaargwttatctgtatgaaaagtttcttttcctaaaaacgatttctcctagaaccatcaatctatatgattcaaaaagccaccaaaggtgttaattttgttaattatctagaaagttgtgatggttttgagggtgtatacatatgtcacagcttattaaattgtacattttaaatatatgcacttactatatatcaataaaacttttaaaaaagccaaccagwttgtaaggtatattttcaggataaratmcttattatctttgggaggtcgaggcaggcagwtcacctgnggtcaggagttcg

SEQ ID NO: 14719 - DNA, 274 bp, Homo sapiens
aaagaagaattggcccttgaccagcctgattggttgcaggaggggaccaatcagaggtacctcccatttttcatctgcagcccaatgcaaagtaatgacatggatctggagagattctcttaggagagaatctggctaagtgtctagcaggatgattgattaacaagatgttttgttttcatcatctcagagataagtacaactattctgtcatctaatctgctaactcctacattatcaatacggtagtaataaattatgaataaacataaaa

SEQ ID NO: 14720 - DNA, 492 bp, Homo sapiens
tgttctctccttgctgttttgcatttatgttcatttaactggtgggatttcttcccaagatcttcataaggctgatcccttctttgtattctagtctaggtcaaatgttacattcttagagaggaaatcctccattgccctaggaaaaagtagcctccaacacactctatctggattttttgtctacttgtttattatttttccgtcttcctagcagaatatgaagctgcaagggggtagggaccttgttaatatcattcacaggcatctagaataataatctcttattttcatttcaatgtatatttagtgactgaatggagtcttttaagagccaaatagtacttgtctcaccagtttgttttgaagattaaaagagaaactgtatgtaaagcagcagagtccagagcttagcacacgaaagctgttgagcatctatacttagtatttcttagtatttttgtaccattttcacaaamattttcctataca

SEQ ID NO: 14721 - DNA, 433 bp, Homo sapiens
  misc_feature 391: n=a, g, c or t
gacaaggcttcagtaattagcaaacttactctcagcctgacccatagtttccggagttaccctggaattttccgagcgccctacttacctgtagagcttgaagtgaaaacgtactcgggcgtcctttgtcagtcatcctccactttccactctctggcattccttcactggattatttgtagagattaccgggagcccggcgttgggcaccagagaccagcctgggcaactgagggagaccccatttctacgaaaaaaaaaaaaaaaawttaggcaggcgtggtttcmagtgcstkwaayccsagctactccatgagagattggacaaaacstgggaccagagactgattttcttctaaaatgctttctccaaaatatttttaaaagaaangggggcatttggaaaggaaattgttttgagccccccagttca

SEQ ID NO: 14722 - DNA, 135 bp, Homo sapiens
catttcagtagtgttaagtacattcggctgggtgcggtggttcacgcctgtaatcccagcactttgggaggccgaggtgggcagatcacaaggtcaggagatctagaccctcctaggccaacacagtgacacccc

SEQ ID NO: 14723 - DNA, 420 bp, Homo sapiens
agtgacggaggcgaggtccagaatggagcggactggccatgtttgttttttttttaattttatttttttaatgacggtgtcttgctctgtcaccgaggctggaccgcagtggcgcaatcgtagcccactgcagccttgaactcctgggctcaagctatcctcttgcctcagcctcctgcttagctggagctacaggcatacaccaccgcacccaactattttaatttatgtagagacggggtcttgstttgttgcccaggctggtctgaactcttgggctcagagaatcctcctgccttggcttcccaaagtgctgggattataggtgtragtcacctcactaggccaggaccgggcatctagatatagggtgtggtgggctgtttgtaaaggacgtgaatggggacggacgtgggtggg

SEQ ID NO: 14724 - DNA, 94 bp, Homo sapiens
ctgattactaatgatgtagcgcatctttccatatgcttattggccatttctgtatcttctttggataaaagtctattctgatcctctacccttt

SEQ ID NO: 14725 - DNA, 483 bp, Homo sapiens
agggggacctgctgctggaagagcagcggcccgagccggggccatggcgamstgctgagctgcgtcctaggcccccggctctacaaaatctaccgggagagggactctgaaagggccccggccagcgtccctgagacgccaacggcagtcactgccccccattccagctcctgggatacgtactatcagccccgtgccctggagaaacatgctgacagcatcctggcactggcttcagtattctggtccatctcttattactcctctcccttcgccttcttctacttgtacaggaaaggttacttgagtttgtccaaagtggtgccgttttctcactatgctgggacattgctgctacttctggcaggtgtggcctgccctccgaggcattggccgctggaccaacccccagtaccggcagttcatcaccatcttggaagcaacacatcggaaccagtcttcagaaaaacaagaggcagcttg

SEQ ID NO: 14726 - DNA, 465 bp, Homo sapiens
tttccagaagacctcttacaaaacatcccttcaaaaatgttctgtaatttttgctaattagaccagctgacagtgagcttaggtgtttgaaagcttggtgctgccatctatccgctgatgatgcagatgagaatgccaaatgaggtagtaactgggaaacactttttttgtgtgtgtatgctgaagaaataccaagtagtattaattttagtttctttagttaagggaagagcatgaaaaattcgatatttatataactagtatattatattcctcattgtctcccacaccatactgttagggatggaaatttcccattggcctgtaccatttggctgcagatgtcaagaaagttcaaaaaagtcttactaatagttattgagcatctaccatatgtctagagggtggggataaaatgttaaaaagataatgaagtggctgttctcggggagctcaatatataca

SEQ ID NO: 14727 - DNA, 448 bp, Homo sapiens
cgagtagctgggattacaggtgtgcaccatcatgccgagccaatttttgtatttttagtagagacaggatttccccatgttggccagactggtttcaaacttctgacctcaggtgatctacctgccttggcctcccaaagtgctgggattacaggtatgagccactgtgcccagcctcaagtcacccttgttagtttggcttaccaactttaaagttttggattgcttttgtcaagccactgggttgcaagttcagatggtctttcttgtttttcttagctaattgtaagtaaaattcactttggtaatttattgtgtcacatagaattgaagtttttctcttgctaatattattcctattttcaaattttggggttcctgttagcctgattttcggatagctgccacataagttgtccttgatctggataaatccataaaaattgtg

SEQ ID NO: 14728 - DNA, 217 bp, Homo sapiens; identical to SEQ ID NO: 14714

SEQ ID NO: 14729 - DNA, 73 bp, Homo sapiens
aaaaaaaaaaaaaaaaaaaaaaaaaaaaaaaaaaaaaaaaaaaaaaaaaaaaaaaaaaaaaaaaaaaamaaaa

SEQ ID NO: 14730 - DNA, 407 bp, Homo sapiens
attataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaacaaaaaaaaaaaaaaaaa

SEQ ID NO: 14731 - DNA, 184 bp, Homo sapiens
ttttatataatgcatgtattcactaaaataaaatttaaaaaactcctgtcttgctagacaaggttgctgttgtgcagtgtgcctgtcactactggtctgtactccttggatttgcatttttgtattttgtacaaagtaaaaataaactgttatgagtagtaaaaaaaaaaaaaaaaaaaaaaaa

SEQ ID NO: 14732 - DNA, 433 bp, Homo sapiens
aaaaataattagttagaaatgacactatgcaatattaaataattatagtcaatttaggcatgaattatatgcaataaagtagaataaaatgcagatataactattgtgtacttctagtgttaacttctaattctccctgattaagttatgtcaaaatgctgagccaggcatagctgaaggaaatagctttgttatgttcccagttagatcatcttctttcattttctggctcttcattgtacacaaatatgatcttcttttccattcaaacctacttcccacttattacaccatagaattgtgatttagtagctctgagatgtggtcccaggagggaaggaaaaagtagtttctgaatgttctgatttctctatttctcattccattggttggttttggccaggagtcagcaaatactgcttatgggcaaaat

SEQ ID NO: 14733 - DNA, 304 bp, Homo sapiens
gttattcaggctgggcgtggtggctcatgcctgtaatcccagcactttgagaggctgaggcaggcggatcatttgaggtcaggagtttgagaccagcctggccaacatgattaaaccctgtctccactaaaaatagaaatattagctgggcatggtggcatgtgccgtgatcccagctcctccagaggctgaggcaggaaaattgcttgaacccaggaagcggaagttgcagtgagctgagatctcgccactgtgctccagcctgggcgacagggagactccctctcaaaaaaaaaaaaaaaaa

SEQ ID NO: 14734 - DNA, 437 bp, Homo sapiens
tcgcagtggcaaagacttggagtcggcccaggtgtccatcaatgatagactggattaagaaagggtggcgcatatacaccatggagtactttgcagccataaaaaaggatgagttaatgtccattgcagggacatggatgaagctggaggccatcgttctcggcaaactatcacaggatcagagaaccatctgcatgttctcactcataggtgggaggtgaacaatgagagcacatggacacgggaagggaaacatcacacaccagaacgtgtcgcgggggtaggggggtgggggaggaataacattaggagaaatacctaatgcaggtgatgggttgatgggttcagcaaaccaccagggcacgtgtacatctatgtaacaaaactgcacgttctgcacatgtaacccagaactgaaagtataattaaacaaacaa

SEQ ID NO: 14735 - DNA, 461 bp, Homo sapiens
tacaatatggagagaagtggtgtattttgaaaacatttggggccgggcgcggtagctcacgcctgtaatcccagcactttaggagactgaggggggcgaatcacgaggtcaggagtttgagaccagcctgaccaacatggtgaaaccctgtctctactaaaaaaaatacaaaaattaaccaggcgtggcacctgtagtcccagcactttggcaggttgaggcaggtggatcatttgaggtcaggagtttgagaccagcctggcccacatggtaaaaccccgtctctactttaaaaaatacaaaaattagctgggcggtagtggtgcatgcctggaatcccagttactccagaggctgaggcaggagaatcacttgagcctgggaggcagaggttgcagtgagcagagatcgtgccactgcactccagtctaaatgacagagtgagaccctatctcaaaaaa

SEQ ID NO: 14736 - DNA, 474 bp, Homo sapiens
tctttttatttctggactctcagtcctctcactggtcatcaactgctttgggcgggagggtgtcaaaggcctgtaagttgggtgcctcctgtcctcaggaaacttcctaatcaatgcacttatcccactggctcccagctgacaaggaacagcacttccattcctgagaaatccttagaaacccaaggacagacagggctggggcccaacttaatcataaggttcttacaggaagaaggcaggagggtcagagttggggaggacacgtgaggacagaaacaggctggagcgacgggctttgaagacgaggaagaggccacaagccaaggaatatgggcagcccctagaagctgagaaagaaaaggaaatggcttctcctctagagcctccagaaggaacacggccaagccagcaccttgattttagccttgtgagacccactttgcacttctggcctccagaaatggaagatca

SEQ ID NO: 14737 - DNA, 148 bp, Homo sapiens
ggccgggagcggtggctcacgcccttaatcccagctctcagggaggctaagaggcgggaggatagcttgagcccaggagttcgagacctgcctgggcaatatagcgagaccccgttctccagaaaaaggaaaaaaaaaaaaaaaaaag

SEQ ID NO: 14738 - DNA, 411 bp, Homo sapiens
tacataaaaaagacatttcagattaacactaatgttacacctcaaggaactggaaaaacaagaacaaacaaaacccaaagctagcagaaaagagatcagaactgaatgaaattgagaccaaacatgcacgcgtgtgcgcgcgcacacacacacacacacacacacacgvtkcaatgaaatgaaaagttgattcttggcaragacaaacaaaattggtaggcamacaaragragagagaggattcaaataagcacaatcagaaactataaagatctgattttatctttaaaatcaggtaaatttaaacttaggggtgcagtggctcaagcatgtaatcccagcactttgggaggctgaggcaggcggatcgcttgaacccaggagtttgagaccagcctgggcaacatagca

SEQ ID NO: 14739 - DNA, 517 bp, Homo sapiens
ttgaagtatgaacaatatatacccttagaagaatgggtcaaataatttgggtttttaatttaaaataggagggccccagatcttactttcctgtccttgaggaacaccttcaagtttttaaagtattttagggggaaagaagatttttaattgtttctgagcctaatgaggtaataaaatatattaaaatagtttaattttaatggtccttacgctttacagtacctaaggatcacttgtagtatctgacaaaaatgcagaattaaagagtcatggcagggtgtggtggctcgagcctgtagtcccagcactttgggaggccaggcaggaggattgcttgaggccgggagtttgagaccagcctgggcaacatggtaagacctcatctctacaaaaaataaaaaattatccaggtgtgggccgacagtcccagctactagggaggctagggcagggtgatttgaattgagcccagtagtttgaggcttgccagtgagttatgattgcgccactacac

SEQ ID NO: 14740 - DNA, 308 bp, Homo sapiens
taagaagatgtttggctgggcgtggtggctcacgcctgtaatcccagcactttgggaggccaaggcagctggatcgcttgagctcaggagttcaagaccagcctaggcaacatggcaaaaccccatctctacaaaaaaatacaaaaaattagccagatgtggtggtgcacacctgcagtcctaggtacttgaggggctgaggcaggaggatggctagaaccttggagattgaggctgcagtgagctgagatggtgtcactgccctccagcctgggtctgggtgacagagtgtgactgtgccaaaaaaa

SEQ ID NO: 14741 - DNA, 85 bp, Homo sapiens
ttctggaaaaagtaataataaatatagctacttaaaaaaaaaaaaaaaaaaaaaaaaaaaaaaaaaaaaaaaaaaaaaaaaaaaa

SEQ ID NO: 14742 - DNA, 60 bp, Homo sapiens; identical to SEQ ID NO: 12480

SEQ ID NO: 14743 - DNA, 65 bp, Homo sapiens
aaaaaaaaaaaaaaaaaaaaaaaaaaaaaaaaaaaaaaaaaaaaaaaaaaaaaaaaaaaaaaaaa

SEQ ID NO: 14744 - DNA, 404 bp, Homo sapiens
cctgtagggcttcgctcccagtccagtactccctagcatcaccaccaatcactgcacatagggcacacagcccctgtgtttctggtgagctcttcatctaccttttttttttttgagasagtctctctgttgcccaggctcaagtgcagtggcgcgatctcagctcactgcaacctccacctcmagggttcaagggattcttgtgcctcagcctcccgagtggctgggattacagtcgtgagcsagcatgtctagcctttttgggwatttttttgcggagatggggttttgctatgccacccaggctggtctcaaattcctggactcaagcaatccacctgccttggcstcccaaagtgctgggattacaggcgcgagtggctgtctctctctctctctctctc

SEQ ID NO: 14745 - DNA, 498 bp, Homo sapiens
attatctgggcgtggtggcacatgcctgtaatctcaactattcgggatactggggcaggagaatcacctgaacctgagaggtggaggttgcagtgagccgagattgcgccactgcactccagcctgggcaacaagagcaagacttcatctcaaaaaaaaagagaaaatgctcacattttctacttgtagagttcattggctgtattttctgctttccacttggttgtttgctgtgtatatagctaacacttgagaaatattttctgctttctgttgaattggaaccacagatatttgtgctagataggacattgaagatcatttaatccagtgatgccctgttggagtgtgaaggtgttttagaatgtcaaaatggttgtaattttacatttttgtatgtgctcattaacgaaatacatagtagccaaaagatgttataaactctacagtgcttttaaatgatactggttttcttagacacagtaatctacatgcatg

SEQ ID NO: 14746 - DNA, 463 bp, Homo sapiens
  misc_feature 405: n=a, g, c or t
attctgggaaatgtagtctccttggcctgcgctctgtaggagtggcagaacagtaagagaaatgacaaagcaagaggaacctaatactcttcctcattggccttcctgtctccatctttattccttccagctcattctctacatracactgtgaatgcmaaactgtctggaggstgccatgagcggccaatttgtgatctctgctttacctgaattatktccgtgaattgtgacatcaacctcgccagataagaaagaagactgaagttcagagaggtgaagggactggctcaggggctacccctatggttgcgggastaagattccagcccagcagcgtgatccagagcccatctgagctacccagatcttcctgctgttaaacccgtcctggggcagctcttngcctgatgggctacctgaggaacccacaggaaatcaagggaggtgcctgcaaagttgc

SEQ ID NO: 14747 - DNA, 413 bp, Homo sapiens
  misc_feature 40: n=a, g, c or t
acactttcactctattgtaaccacacagggsaggcgcawnagcatgtcagtgtcctgccccgggcactctccctcccgggcacgctccctctggcctggtggatcaccaagagggsggttctcattttgttattagtggaagagccttgagcttaaaagctcttcattttctttgccggaaagtatatggtttgtgtttttgcagttttatttttttaaggatggacactaaatctctggtgtccatgttccgagccccgtggctgggatggtggctcgatgtgtctcctctttatcccgccctctgcctgttttggtgccctcccttcttttcccccaggcagtgggtatcgggttctttcccaaagtgcttacttggaaagagtgtggctgctggactcttttcgaaatgc

SEQ ID NO: 14748 - DNA, 195 bp, Homo sapiens
gacttttctttagttaatgagtattaaatagtgcatattctgtagactatagggtttacattgtgttgcatcttataacttgtatagattgagctgattgaaataagattttgttccaagtattatctgatagaatacaagatgattcaaaattatatagatatttaaagcttttctgctgtttttttttttttt

SEQ ID NO: 14749 - DNA, 89 bp, Homo sapiens
aaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 14750 - DNA, 70 bp, Homo sapiens
aaaaaaaaaaaaaaaaaaaaaaaaaaaaaaaaaaaaaaaaaaaaaaaaaaaaaaaaaraaamaaaraama

SEQ ID NO: 14751 - DNA, 83 bp, Homo sapiens
aaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 14752 - DNA, 284 bp, Homo sapiens
cacaaaaagatgccaggcactgtgggaggctgaggtaggcagatcacctgaggtcaggagtttgagaccagcctggccaacatggtgaaaccggtctctgctaaaaatacaaaaattagccgggggtggtggcgcatacctgtaatcccagctactcaggaggttgcggtagggaaattgcttgaacccgggagacagaggttgcagtgagctgtgactgcaacactgcattccagcctgggcaacagagtgagactcctcctcaaaaaaaaaaaaaaaaaggs

SEQ ID NO: 14753 - DNA, 67 bp, Homo sapiens; identical to SEQ ID NO: 11909

SEQ ID NO: 14754 - DNA, 61 bp, Homo sapiens
aaaaaaaaaaaaaaaaaaaaaaaaaaaaaaaaaaaaaaaaaaaaaaaaaaarrrraaaaaa

SEQ ID NO: 14755 - DNA, 195 bp, Homo sapiens; identical to SEQ ID NO: 14704

SEQ ID NO: 14756 - DNA, 63 bp, Homo sapiens; identical to SEQ ID NO: 13842

SEQ ID NO: 14757 - DNA, 90 bp, Homo sapiens
  misc_feature 18: n=a, g, c or t
gttccagcagtccgcrancwgcmgtmggctccrcagrgrgggcgggccgggcaccccggggcgcggaggagcgctcctcgcttctctccw

SEQ ID NO: 14758 - DNA, 209 bp, Homo sapiens
  misc_feature 16..18: n=a, g, c or t
aattttgcaacgacgnnngcggaggaggaggttcccggaagccacgcgcastggagcagcggcgaccgcagctggargcccggagcgcctgcagggctggcagadgcgadggaggttgcrggtaggaagggcggactgcrcgcdccccctgcgtcccgcgcacctcggggccggtccattctcccgamggctgcgggcttcagcatctw

SEQ ID NO: 14759 - DNA, 527 bp, Homo sapiens
cagttattttatggtttaaaagtttcaattagacataaaaagaccttgaaaagaaaataccacacaagatagggtcattcataggtgaaagaacagtgctgatcaataattttgataaatgagaaactaattgataaatctgttagcatttgtttgaaagctgtagctaaatgttgcagagtrgccgggtgtgatggctcatgcctgtaatcccagcactttgggaggccaagaggggcagatcaggaggtcaggagatcgagacaatcctggctaacacggtgaaaccccgtctctactaaaaatacaaaaaaatttggccgggcatggtggcgggcgcctgtagtcccacctactcgggaggctgaggctaggagaatggcgtgaacccaggagaggaggttgcagtgagccgagatcgcaccactgcgctccagcctggggtgacagagtgagactctatctcacaaaaaaaaaaaaaaaaaaaagtaactttcctggtgctgttgttaactcgttcctttttt

SEQ ID NO: 14760 - DNA, 62 bp, Homo sapiens
gccgcctarractagagarggtgggggacggacaagccccgatgccgggggagacggaagaa

SEQ ID NO: 14761 - DNA, 189 bp, Homo sapiens
agatggatggacagatatcagagtagatatgtatacacactgccatatgtacatatacatatgtgtgtgtaatgttatttattttaaaaaaaataaacactctgcttactacttgaaaaaaaaaaaaaaaaaaaaaaaaaaaaaaaaaaaaaaaaaaaaaaaaaaaaaaaaaaaaaaaaaaaaaaaaar

SEQ ID NO: 14762 - DNA, 365 bp, Homo sapiens
ctctctctggctgcvggcggctgggcgggccggagctcggcaacgtgtctggcccatgctgcttgccgccgctccccacgcgctccccggcgcggccccgactggggctagggccgcagacgcgcggggccccttcgggcgcggggcttgggtgcctacacctctgcrgcgggagtcgcggtggagcctgaatggagarccggcctgggggcggcgttgctgtgactgacacctccggggtctgtcccgagagggggtgattccgccggctcccggttctctcccgagctcggagttggtaggggaggaggctttctccaactaccgccgctacttccgaggtacgagactccagttgtttggcc

SEQ ID NO: 14763 - DNA, 317 bp, Homo sapiens
agaagtgcgactgccagctgccgaggcgttcggtcctgctgttgcggccgctgccccagggctgcggggacgctcccggagccctgcctgttccctgtccatccaggccagcagctgaaggagcctcacctgcctcccttctctgagtagcacggatttgaggagaagcagcgaagatgtccagcgagcctccccctccttatcctgggggccccacagccccacttctggaagagaaaagtggarcmccgcccaccccaggccgttcctccccagctgtgatgcadcmccctccaggcatgccactgccccctgcg

SEQ ID NO: 14764 - DNA, 63 bp, Homo sapiens
  misc_feature 32,34: n=a, g, c or t
ctctccctgctttcctctgccgcatggwcctnrnccgttggcgtcggaagcctgaagcatggr

SEQ ID NO: 14765 - DNA, 495 bp, Homo sapiens
gttattcaggctgggcgtggtggctcatgcctgtaatcccagcactttgagaggctgaggcaggcggatcatttgaggtcaggagtttgagaccagcctggccaacatgattaaaccctgtctccactaaaaatagaaatattagctgggcatggtggcatgtgccgtgatcccagctcctccagaggctgaggcaggaaaattgcttgaacccaggaagcggaagttgcagtgagctgagatctcgccactgtgctccagcctgggcgacagggagactccctctcaaaaaaaaaaaaaaaaaaaccagaaaacaaaactgggcgcagtggctcacgcatgtaatcccagcactttgggagtctgaggcaggtggatcccctgaggtcgggagttcaagaccagcgtgaccaacatggagaaaccccgtctctactaaaaatacaaaattaaccaagcatggtggcgcatgctataatcgcagctacttgggag

SEQ ID NO: 14766 - DNA, 508 bp, Homo sapiens
aatgagaaggaaggaagggagtgcgtaggtccagtgaggacgagggtgaaatttatatctctgcccaggtctcggtgcctgcaccgccatagacaccaccaggtacagcaactggggcgggagctacgaggaggtccccggaggtatgagcaaggagactgccccatccctgccccggtgtctggggtttgatgggggaggggagggaagagccaagacgggccagagtcgtgggtgcaaaaaaaacaacacagagccagttggaccaggggccaattccaactctgccacttagaagctgtgtgaccataggcaagttacttaacctctctgaaactcagtttcctgagaggaacccaggcctctagggctcagtcctgggggacccagcatgccgtccttgttctgccagggcactggggacgctgggtgcactggagcccgagacccctcttcctggccatggctgtcctggtcgccagtactgtgggctgtgattctgagtatc

SEQ ID NO: 14767 - DNA, 379 bp, Homo sapiens
caaataatttgtactgagggaaacagttatactacaaatcatgttgcagatctgatgccgagattgctctattttaaaaggaaacctgcaaatgtctacatatatgaagcttttaaaaagcacaagttatcaggcaacatcattaaacatacattaaatgtctgttagcatataggattttgtgcgtatgtgagtgtgctataacatgtaacttgcggatgttcagcgtgcatgtggaatccatccataatggtacatagcgaaataatataatcttagttcagtaactattatgtgtatgaagatgttgcacattaagtctcagtagtgactctggttgttaatatttgtattgtaagtgtaatattccttttaaatt

SEQ ID NO: 14768 - DNA, 393 bp, Homo sapiens
  misc_feature 181: n=a, g, c or t
aatccctctcacgcgcggtgccgggtgtccgccccctctrggtccgagaagcttccgcccaaccctttccaggtgccgctcccctgcgcattccagagcagtactctccaaggtgggaaacctaggagtttggagtctcctccgggatggagaagctgccgctagcttagttcgctttgrnraccggaggggctagaaaggaaactagaggcrgrggtrgrgggtggacactgggcaggactgagcatcagcaaggcgtgattctsaaaggragggggcktcggccccctaccccggakcgtccgaagcgctggtcttcatacctgtgtcggctctttcgaaggabagakgaggagtcggggtcttcactttcttctcagccgcattaaaagc

SEQ ID NO: 14769 - DNA, 474 bp, Homo sapiens
  misc_feature 334: n=a, g, c or t
attcagcttccgggctaattagcagtcgcggtgtgccgctacgtgcgggctctcaaggagctcagcctcccggacggagccggcggctgcrgggcgaggacggcggcggaccggggcagccccgcgccctggccagctctactgagatgaagaaagaaaaagaatacctgctcagctccagagacacgtaaagggacagagattgggggacagaaggaagtgcattaattccttccacgacccctgaagagcagcggtgggtctgagcatcctatctccaggaagcaggccagcaggcaagccagctgccacctcgtcctgtgcaaagcacagncaccgtccccaaaagatttccaaagatgatgttaaacccagccacggttctgatctccaggaaagcaattgctgtggtacaaaaggacaagggttaaaagagaacagtgggagctctctttcccaactaactcacgcatt

SEQ ID NO: 14770 - DNA, 263 bp, Homo sapiens
atcacgaggtcaggagatcgagactatcctggccaacatggcgaaatcccatctctgctaaaaatttgaaaattagctaggtgtggtggtgcgtgcctgtaatcccagctacttgggaggccgaggcacgagaatcacttgagctcaggaggtggaggttgcattgagctgagatcgtgccactgcactccagcctggcaacagagcgagactctgtctcaaaaaaaaaaaaaaaagaaaagaaaacaaaaaaaaaaaaaaaa

SEQ ID NO: 14771 - DNA, 528 bp, Homo sapiens
  misc_feature 155,165: n=a, g, c or t
aaatcgagatccagaagcagagagaggaagaaatcgagatccagaagcagggaaagaaaacggcggatcaggtctcgttcccgctcaagatcaagacacaggcataggactagaagcaggagtaggacaaggagtaggagtcgagatagawagangagaattganaagccgagaagatttagcagaagtttaavccggactccaagtccacctcccttcagaggcagaaacacagcaatggatgcacaggaagctttagctagaaggttggaaagggcaaagacttggagctggaggtgagaaaagcatgctgacccttacgcctttgctttcctccttctcgtcctcaacttctaaacccttgttggctcttccatttgttacccccattcccatatgtgcttctttccatctaccacttgactctggtcctccctatgccagatcaactgcctgtgacccttgactgctccgcttggacaagtggtctctaaacttacttcctgctttatcttatgctcgttttta

SEQ ID NO: 14772 - DNA, 510 bp, Homo sapiens
  misc_feature 463: n=a, g, c or t
ctttattgataaagttagggagaagattgatgcaataggacaatttccaatttaatttagatcctctaatctttctacatggacaagctgttttcttttctaggttactgataacccctacaatttcgacttaacttcaaaacacagtattgtgttatctatcacataacaggaccatgtttttaacctaccatcaagagcctgtattttgagttattccaacagagatgatggattcctgtagaactagaggtgggtgacctatggttatgtggcacggcaaagcaagtacctcttaagggactctaatatatgctaacgctggtcctcttagctctgtgctctcaccagacaatgaatgaactatgaaagatttagtcaacagaaactattttagggtatgtttagttggtaaatgcttcatgttcatggatgacacaatgtttttgcaaaaaaaccctgnwactattctttggcattggtgtccatggcctataccgccatcttaca

SEQ ID NO: 14773 - DNA, 514 bp, Homo sapiens
atttttcagctgaaatcagcctcatcaaagcagcaactgtgtaccaaggggttgacaaatagaggaaatttgtgaagctgggcttcttggcaagtgttttgtccttggaaattctgttcctctcagccttctgggggctcgctctgtcacccaggtcggagtgtaatggtgtgatcacaactcgctgcagcctcaaccttctgggctcaagtgatccttatgcctcagcctcctgagcagctgggactacaggcatgtgccaccatgcccaggctggagcgcaatggcacaatctcggctcactgaaacctccacctcctgggttcaagcgattctcctgcctcggcctcccaagtagctgagactacaggcacatgccatcatgcccagctaatttttgtatttttagtagagacagggtttcgccacattggccaggctggtcttgaacttctgacctcaggtgatctgcctgcctcggcctctcaaagtgcggggattacaggcatgagca

SEQ ID NO: 14774 - DNA, 298 bp, Homo sapiens
taagaagatgtttggctgggcgtggtggctcacgctgtaatcccagcactttgggaggccaaggcagctggatcgcttgagctcaggagttcaagaccagcctaggcaacatggcaaaaccccatctctacaaaaaaatacaaaaaattagccagatgtggtggtgcacacctgcagtcctaggtacttgaggggctgaggcaggaggatggctagaaccttggagattgaggctgcagtgagctgagatggtgtcactgccctccagcctgggtctgggtgacagagtgtgactgtg

SEQ ID NO: 14775 - DNA, 281 bp, Homo sapiens
cacaaaaagatgccaggcactgtgggaggctgaggtaggcagatcacctgaggtcaggagtttgagaccagcctggccaacatggtgaaaccggtctctgctaaaaatacaaaaattagccgggggtggtggcgcatacctgtaatcccagctactcaggaggttgcggtagggaaattgcttgaacccgggagacagaggttgcagtgagctgtgactgcaacactgcattccagcctgggcaacagagtgagactcctcctcaaaaaaaaaaaaaaaaa

SEQ ID NO: 14776 - DNA, 457 bp, Homo sapiens
gaaagcggcggaagggacgctggaatgtggagcggttgtggggcggcastgcggaactgcgcgattgtggttcccgccgtatttcccgttccccatctagtaactcccatctcagcccacgtatctccctgagtggaaatctcgggccccagaccagtcgattgggaggtccgccctccccttcagcgacttggtctgtgttttggcagttgccgcgacgacagtcacttccgggaaggggctctgcgaatctccttccgtcggtccgctcagaatcagctgtcctctcagactgtgtgggtggtttccccggccgcagctccgtacgggcttggattgctgggcctcggtgcaccccagcctcccccactcgggttctgagcttgagctggcggctctttaactctgcttcactgttgctcttggcaacatccacttccgggagcgagtgccgttt

SEQ ID NO: 14777 - DNA, 162 bp, Homo sapiens
catttcagtagtgttaagtacattcggctgggtgcggtggttcacgcctgtaatcccagcactttgggaggccgaggtgggcagatcacaaggtcaggagatctagaccctcctggccaacacagtgacaccccgtctctactacaaaaaaaaaaaaaaaaa

SEQ ID NO: 14778 - DNA, 445 bp, Homo sapiens
aaaaggagcmgcgctgggaacactgcggtcggggcgaggaagctgccggggaagtgagatgacggtcgcgggggtgcccaggagccctgaaaaacttgtgcsctgggsaggcaaaatctgcaggttgcagaaagtctcaactgatcctggcataccccgaggtgccgacttttagagctaaagatgcaagaaagattgggatcctgcgatgcaccgaacctgtctctcgaagtgtgtgcgccctgcttcctgtgttaaacaatttgctacaaggtcacacaattttaactagaagactgagatgtgaacctgggtggtctgatgtgaacaccactgtctggtaatcccaacgctctgctgctttgcgacagagaatgttttagggarcacacagactatgtacttaaccaaatctggaatttgccgtaagatattaattagagaa

SEQ ID NO: 14779 - DNA, 268 bp, Homo sapiens
  misc_feature 108,120: n=a, g, c or t
tsgcggaccgcaaaggccgcccgtcccgtcaaacaagtttcttcttaggctaagaaacgcagtatatacgagtatctctatatatagtactaatggatttggtgtgcntcccccttagcntccccctccctctgctcctcctccttcagcctggtctccccctcttctctgccctccacccccgtctctgcactgagatacataagaaacaagggtagtttactgtctgttttgttttctgggttttmagtgcagagacgggggtaga

SEQ ID NO: 14780 - DNA, 481 bp, Homo sapiens
tacaaaattagctgggcatgatggtgcactcctgtaatcccagctacttggtaggctgaagcatgagaattgcttaaacctgggaggcagaggttgcagtaagccaagatcatgccactgcactccagcctgggcaacagagtaagactctgtcttaataaataaataagaaaataaaacggaactgcagtgctaacagtaatttatacatttttaaatgttctgagtatgttttgactgggctagtgtaacaatatactaccctgaaagtgcagttttgattgttgttggtgtctttgggtcaggaaagtgaactgtgccaagaagtatttttcagtgacatgaatggattcctgttaatgcaattgactgagagattgtgcttacgctttcttaactgacaaaaagaggctttgtccaacatcagaattgttgaaactggtgctgttttctgttgcactgggattctgatgatctggga

SEQ ID NO: 14781 - DNA, 269 bp, Homo sapiens
agctgagaaggggcggtcctgcggaatgcgtcgaagagggctccgcgctccaagagagaagcctgaggacaaagttctgggagatcggcattgactatgtaagtaacaacaacggcctaaagaagcaacaagaaaggaaccgagtgcctggagaacttcatggagcagagccacttgcctactttggatcatctgtctctaagagagggaaataaacatttcttttgtgtgaaaaaaaaaaaaaaaaaaaaaaaaaaaaaaaaaaaaaa

SEQ ID NO: 14782 - DNA, 162 bp, Homo sapiens; identical to SEQ ID NO: 14777

SEQ ID NO: 14783 - DNA, 83 bp, Homo sapiens
cttccctgttatctttgtgacccactgatagcagctggtggtcctggtgcggtgagattttgactcttttttttttttttttt

SEQ ID NO: 14784 - DNA, 417 bp, Homo sapiens
ttaaaaatgtcctgtgcaggtgttggtgagggtaaattgaaaacattttttattttttgttgtttttttttattgagacggagtctcactctcgcccaggctggagtgcagtggcacgatctcggcccactgcaagttccgcctcccgggttcacgccattctcctgcctcagcctcccgagtagctgggactacaggcggccaccacggcgcccggctaattttttgtatttttggtagagacggagtttcaccgtgttagccaggatggtctcgatctcctgtcctcgtgatccgcccgcctcggcctcccaaagtgctgggattacaggcgttaaaggcaattcacatgtcttccttggatttgtcagggatggcaggtgtatacattgggttagtagatgaggatattataca

SEQ ID NO: 14785 - DNA, 240 bp, Homo sapiens
catacagatttaatcctgcgactccccagattaaaaacctttgatgctcctttttgttttttgatacagagtctcactctgtcacccaggtgggagagcagtggcgcaatctcggctcactgcaacctccgcctcctaggttcaagcaattctcctgcctcagcctcctaagtagmtgggactacaggcawgcaccaccatgcccagctaatttttatatttttagtatggagtttcacc

SEQ ID NO: 14786 - DNA, 83 bp, Homo sapiens; identical to SEQ ID NO: 14783

SEQ ID NO: 14787 - DNA, 75 bp, Homo sapiens; identical to SEQ ID NO: 14694

SEQ ID NO: 14788 - DNA, 442 bp, Homo sapiens
ctcaatatgcaaaaattaattatattccccaagtttcatagaaacatttattgcctacaaaataagatatgaacataaataaatatataaacataaatacaagtttaagaattaaaaaaagaaaatagccaggtgtgttggcatgtgccttaagtcctagtatttgagaggatgwggtaggaggatcgcttgaacccaggagctggaggctacagatgtactccagcctgagtgacaaagtgagaccctgtctcaaaacgaaagggaaaaagagtacatagagattactttttctggacccaactatcaccagaatatattaagactttctgaggccgggtgtggtggctcatgcctgtagtcccagcactttgggaggctgaggagggtggatcaccagaggttgggagttcgagaccagcctgaccaacatgccgaaatc

SEQ ID NO: 14789 - DNA, 347 bp, Homo sapiens
aacaactcagatgtctcctaccttccctcttaggaaggcattaaaggggaagagaggatggctttggcccgcaataaactgggttcaaatcccagctctaccacataaatataaaagttatctgatgttcagcatggtatctctctgaccctcagtctcttcatctcctgaggacaaagttctgggagatcggcattgactatgtaagtaacaacaacggcctaaagaagcaacaagaaaggaaccgagtgcctggagaacttcatggagcagagccacttgcctactttggatcatctgtctctaagagagggaaataaacatttcttttgtgtgaaaaaaaaaaa

SEQ ID NO: 14790 - DNA, 264 bp, Homo sapiens
  misc_feature 237: n=a, g, c or t
atcacgaggtcaggagatcgagactatcctggccaacatggcgaaatcccatctctgctaaaaatttgaaaattagctaggtgtggtggtgcgtgcctgtaatcccagctacttgggaggccgaggcacgagaatcacttgagctcaggaggtggaggttgcattgagctgagatcgtgccactgcactccagcctggcaacagagcgagactctgtctcaaaaaaaaaaaaaaarnaaaggaaamcaaaaaaaaaaaaaaaaa

SEQ ID NO: 14791 - DNA, 301 bp, Homo sapiens
gttattcaggctgggcgtggtggctcatgcctgtaatcccagcactttgagaggctgaggcaggcggatcatttgaggtcaggagtttgagaccagcctggccaacatgattaaaccctgtctccactaaaaatagaaatattagctgggcatggtggcatgtgccgtgatcccagctcctccagaggctgaggcaggaaaattgcttgaacccaggaagcggaagttgcagtgagctgagatctcgccactgtgctccagcctgggcgacagggagactccctctcaaaaaaaaaaaaaa

SEQ ID NO: 14792 - DNA, 72 bp, Homo sapiens
  misc_feature 25: n=a, g, c or t
agtaacccctccccccaggttccanaggaagaagcctccacatctgtctgccggcccaagagttccgtaacc

SEQ ID NO: 14793 - DNA, 461 bp, Homo sapiens
  misc_feature 130: n=a, g, c or t
taatttcttagcgatgttaacggtgagtgcatacttttattttgctgactttatgttttacatttttttgttgtggtaaaatatacatgacataaaatttatcattgtaaccattgttagttaagtgkdnagttagtggcatcaagtatattcgcattgttgtgcaactgtcaccactattcatttctagaaatttttcatcatcccaaacagaaatgctgtgcccatttaagtagtaacttcctattcttttctcccccagtctctggtaaccactattctactttcggtctctatgaatttgactattctaggtacctcatataagtaaaatcatggagtatctacttgtgactggcttatttcacttaacagaacgttgaaggttcatccatattgtagcaagtgcctgaattttattcctttttaaaaaattgtggttaaacttgcataacataaag

SEQ ID NO: 14794 - DNA, 162 bp, Homo sapiens
ttttggccgggctggtttcaaactcctgacctcagttgatccacccgcctcagcctcccaaagtgctaggattacaggcatgaaccaccgtgcccggccaggaataagcttttgacttacccaattcagataggttgatctttggggttttttttttttttt

SEQ ID NO: 14795 - DNA, 356 bp, Homo sapiens
  misc_feature 279: n=a, g, c or t
attacaatttaactttggggtttgggtaagacaaacatttaatgtataggattttggccaggtgtggtggctcacgcctgtaatcccagcactttgggaggccaaggtgggcggatcacgaggtcaggagatcgaaaccatcctggctaacatggtgaaaccccatctctactaaaaatacaaaaaaaaaattagctgagcatggtggcgggcgcctgtagtcccagctacttgggaggctgaggcaggagaatgacgtgaacctgggaggcggacttncagtgagccgagatctctccactgcactccagcctgggcgacagagcgagactccatctcaaaaaaaaaaaaaaaaa

SEQ ID NO: 14796 - DNA, 278 bp, Homo sapiens
agaggggcagcttccctgagagcagctaagccccaggcacaccgggcatccggacacacaggtcggggaaggataggtstgagccggggctcccagcagagacgcctgggtggggcaggaggccgctccaggtgtgagccacagaggaggggagagggacccccacgggagtgaagtggcagagcagctgcagaagtgcagggagcggaaaggtaccagggcagctgctttccgctgsctccggtccgggcagctgcagaaacagcagggggaggagc

SEQ ID NO: 14797 - DNA, 328 bp, Homo sapiens
cattcgggaggctgaggcaggagaatcgcttcaacccaggggttggaggttgcagtgagctgagattgcgccactgcactccagcctggtgacaaagcaagactctgtcttaaaaaaaaaaaaaattaggccaggcacggtggctcatgcctgtaatcccagcactttgggaggccaaggtgggcagatcacgaggtcaggagwtcaagaccatcctggctaasacggtgaaaccccatctctactaaaaataaaaaaggaattagctgggcgtggtggtgggcacttgtagtcccagstactagggaggstraggcaggaraatggt

SEQ ID NO: 14798 - DNA, 259 bp, Homo sapiens
  misc_feature 197: n=a, g, c or t
agctgagaaggggcggtcctgcggaatgcgtcgaagagggctccgcgctccaagagagaagcctgaggacaaagttctgggagatcggcattgactatgtaagtaacaacaacggcctaaagaagcaacaagaaaggaaccgagtgcctggagaacttcatggagcagagccacttgcctactttkgatcatctgtntctaagagagggaaataaacatttcttttgtgtgaaaaacaaaaaaaaaaaaaaaaaaaaaa

SEQ ID NO: 14799 - DNA, 61 bp, Homo sapiens; identical to SEQ ID NO: 14680

SEQ ID NO: 14800 - DNA, 55 bp, Homo sapiens; identical to SEQ ID NO: 14535

SEQ ID NO: 14801 - DNA, 474 bp, Homo sapiens
acatatccttcatcaggtgttttaagatgtctctgagaagccatcaaggcaaaagagaactttaagttccttgttccagcccggagttttgggaaagaaagaaaggaaaggtcacagtgacctaggattggaaccttcctgcccttttggcttgcagactgccttctatcccagaacagctgagaaatctatgaagctgagattctgaaggacccagcttaggttcttccacttaggcctcaattcccttccttttccaggggcagccttagttcccatggccctgaaacacacacatttcccccttcctttcccagaagccactggccccccatagcacccagtgcatcctttttacaagtggaagaactaggatggctttccaaagtcttctagaaatgaagttctttctctgtgcagctttcccccttggagcaggagtgaagatgtttcattatcttgggcctggggaaa

SEQ ID NO: 14802 - DNA, 427 bp, Homo sapiens
caaggttaacaaggttgatggggaatggtccttgctctcaagaagctcgtaggcggccaggcactgtggcttatgcctgtaatcccagcattttgggaagctgaggcaggtggatcacctgaggtcaagagttcaagaccagcctggccaacatggtgaaacccgtctctactgcaaatacaaaaaattagtagccgggcgtggtggctcacgctgtaatcccaacactttggtaggccgaggcgagtggatcacctgaggtcgggagttcgggaccagcctgaccaacacggagaaaccctgtctctactaaaagtacaaaattagccagggatggtggcatgtgcctgtaatcccagctatttgggaggctaaggcacaagaatcgctttgaacctgggagacagaggttgcagtgagctgagat

SEQ ID NO: 14803 - DNA, 54 bp, Homo sapiens
attacaatttaactttggrgtttgggtaagacaaacatttaatgtataggattt

SEQ ID NO: 14804 - DNA, 102 bp, Homo sapiens
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 14805 - DNA, 81 bp, Homo sapiens
tcatgagccttttcaactttccagttgatatcttttgtttgcttttttcttttcttatttatttatttatttatttattta

SEQ ID NO: 14806 - DNA, 110 bp, Homo sapiens
ataggtgtttcagataggaaactgggttgtagaccttgtcccagtaatatctccagcagctccaacacattttgtcaacttcgtattcgttttttaagtttttttccttg

SEQ ID NO: 14807 - DNA, 430 bp, Homo sapiens
aagaacccttcatgatttgacaaaggtcactttctgtttgcctggaccaagctactccagatcatctgaccaactcttaaaaatcacggccaggcacagtggctcatgcctgtaatcccagcactttgggaagcagaggtggcaggatcattccagcccaggagttcaagaccagcctgggcaacacaggcctcctcccaaggagaacatgagaccacttcatatctggaactctagaaacactggctgcagcaatcaacctcctgtgccaaggctggccccactcttgtagcatggacactgctagctgggttcaaatcccagctccagcagttgccagcgctgggtgactcgagcaagtgactactcctcactggattgtaggactaaatgtgatagtcattatttacagttcaccacacgctcttca

SEQ ID NO: 14808 - DNA, 430 bp, Homo sapiens
  misc_feature 84: n=a, g, c or t
acctggtccatttccttctctaattaccatggcagttattttacacctctactgctgtccttaatcccataccccaccctcatnaggtgaccctgtttcsttttttagagaaattgaagctcttagacattggtttccacagtaataattttaaaacttcttacaactacctacaaagcagatgttctatcctatctacagagcagaaaattgaaattctcaagtagcagacccggtattaaagtgcagatctgactttaaagtccatgttcattttacacagcaggctgcctcttaagatagtatttattgagcacacactttgtgtaggttctgattttggtagatgtcatgctttatattaatactttacaacaactataagtaagaggtattaacctcacttaacagatgaggagcaagaatccag

SEQ ID NO: 14809 - DNA, 292 bp, Homo sapiens
gttattcaggctgggcgtggtggctcatgcctgtaatcccagcactttgagaggctgaggcaggcggatcatttgaggtcaggagtttgagaccagcctggcsaacatgattaaaccctgtctccactaaaaatagaaatattagctgggcatggtggcatgtgcsgtgatcccagmtcctccagaggctgaggcaggaaaattgcttgaacccaggaagcggaagttgcagtgagctgagatctcgccactgtgctccagcctgggcgacagggagactccctctcaaaaa

SEQ ID NO: 14810 - DNA, 477 bp, Homo sapiens
aaagaagaccactaagtgactaatggtcagagaagctggatgaggggctgattcatgtcctgggcatgacagagcgggaggcacaaggtttcatcacactattcacaatggcgagcaagttaaaacggatttcccatttaatttaattttcagacttcagttgaccatgagtaaccgaaaccacagaaagtgaagctggggatatttcagaaattcttttctaatcagaaattctaatcaaacataagtttccaactatgtgttctcttggtcctcagaagtgtttgaatagaaaagtaacaactaacttcccatctttctggtggaagagttaattctgcctggagggttctgcctgggagacatgacagcatgtgtgtgactcctgtgtctgtttctgtggggtcatccctttcgtttcattttgccagggcctggctcaggattttttatggcagtgctgtgaagacaagcctg

SEQ ID NO: 14811 - DNA, 441 bp, Homo sapiens
attttttttttggattgcgtagggtcttgcgcmgcgcgaaaagtagcgtgggccaggacagcgggagagattgggtttcatcatgttggccaggctggtcttgaactcctgacgctgtgatccacctgcctgggtctcccaaagtgctaggattacaggtgtgagctaccgtgcccagccggcaactggtgttctcatgggagaagaagactttttggaagaccctgtcattgcgtttgtgagactggctcctgctgtcctcctctcaaagctatctgaggtttctgttgctatgacataaataattagttccaattattctctcagtaggttcaaaaccaaaaatttttatctactgaatgaacaagaatactgctttatgtaataaaactcatttaaatttttaatattcagtcattataccaaatactttgagtatta

SEQ ID NO: 14812 - DNA, 77 bp, Homo sapiens
aaaccctcagggacctggtatagacgcagaatctgtttcacacaacaactgctatttgaaggaaaaaaaaaaaaaga

SEQ ID NO: 14813 - DNA, 69 bp, Homo sapiens
  misc_feature 52..53: n=a, g, c or t
gaactcttctctgccagccgggctgccccgaggccacctgacagctcatggnnccccgaccccgacgac

SEQ ID NO: 14814 - DNA, 456 bp, Homo sapiens
caggcaggaaatatggtgacttggtctaggatgatgtagttgagacagaagtctatagacagacaaggacgagtcattttgtccacatccttcttctctgttatccattccaaatgtaaagccactttacatttgtacttttagaactcttaaagatctcttttgtggtaatgacaacgcattattccttagttaaacatttacactctttttgctaactcatttttctctcatccttgataatatagacttataccaattctcctaattgatttgccacattggtccatagtaaaattgtgcaagtattttgaaagagaatatgttcctattcagatttctgaggtcttactaaagacttccaatattatgctcattcaatcatctttaaaagtatacgacttggccagaattatttgctcagccatattactcaattccatttctcagttccat

SEQ ID NO: 14815 - DNA, 72 bp, Homo sapiens; identical to SEQ ID NO: 10145

SEQ ID NO: 14816 - DNA, 340 bp, Homo sapiens
gaaaaaaaattggctgggcgtggtggtgggcactataacctcagctacttgggaggctgaggcaggaggatcgcttgaacccgggaggcagagattgcagtgagccgaaatcatgccattgcactccagcctggacaacaagagcaagactccatcttaaaaacaaacaaaaaaacaacaaaaaaaattagctggccatggtggtgcacacctgtagtcccagctactcgggaggctgaggcacaagaatcatttgaacactggaggcagaggttggagtgagctgagagggtgccactgcactccagcctgggtgacaaagtgaaactccatctcaaaa

SEQ ID NO: 14817 - DNA, 566 bp, Homo sapiens
tactaacacacgacatgcggcttttctgydtcaactgctatgacggttaagaatgtcagtatacaagaaggaatagaaaactgatactgttttaaataatctgtaatttcaattttttttttttttgctgaaatacattatattgtacgtttgagataattctagtacaaagtataataaaactagatgtataataaaccctttaaatcattggtaagtgtacaagtggtggaactgaagcatttactggacaaagtaatgttactctaatggttacttctcgtgcgttgccacactgtgttataatttgcttcatttccttgctatttgatacatagtgtgcatttctctgtcactgtaactattgtaatgacaaattttcatcttactgcacaatcaaaatgacattgataggaatgaactccagaggctgggcctgaacagggaggtggtcgctcaggcctggtgctcagtcgtacgacctgtacctctcaacttttgccctatctgttaaatatatgctatgtcattaaatgcttttaaatctaaaaaaaaaaaaaaaaagg

SEQ ID NO: 14818 - DNA, 195 bp, Homo sapiens; identical to SEQ ID NO: 14704

SEQ ID NO: 14819 - DNA, 66 bp, Homo sapiens; identical to SEQ ID NO: 12404

SEQ ID NO: 14820 - DNA, 54 bp, Homo sapiens
tttcagtttgacagcccgtttcctagacaagtgcacctggggtttcaggaactt

SEQ ID NO: 14821 - DNA, 436 bp, Homo sapiens
ataataataaaataaaaaaagaaaagcaaattcttacattttaatgcaaattacacattgtaatatgattgacagtgttatatatttatatagattataggcttaagttctaaggtctactaatgacagtggatttaataaatttaacaatatttagagattttctatattgaaatacattaggcagttattgtttgtacactaataccaaaggtgccattctgcaaggtataattctcttgatagccagttgggttgattttataacgcattctctccctgaacatagaaactgaagtcagagatcaaaaaggaaaataaatttttaaccttggtattagtgactggcaataaaaaaactgcaaagtttgaaccactagcaataattactcctttaatctgaatccattacggtggtcatcactgttaaattgtt

SEQ ID NO: 14822 - DNA, 343 bp, Homo sapiens
attacaatttaactttggggtttgggtaagacaaacatttaatgtataggattttggcmaggtgtggtggctcacgcstgtaatcccagcactttgggaggcsaaggtgggcggatcacgaggtcaggagatcgaaaccatcctggctaacatggtgaaacccatctctactaaaaatacaaaaaaaaaattagctgagcatggtggcgggcgcctgtagtccsagctacttgggaggctgaggcaggagaatgacgtgaacctgggaggcggasttgcaagtgagccgagatctctccactgcactccagcctgggcgacagagcgagactccatctcaaaa

SEQ ID NO: 14823 - DNA, 317 bp, Homo sapiens
taagaagatgtttggctgggcgtggtggctcacgctgtaatcccagcactttgggaggccaaggcagctggatcgcttgagctcaggagttcaagaccagcctaggcaacatggcaaaaccccatctctacaaaaaaatacaaaaaattagccagatgtggtggtgcacacctgcagtcctaggtacttgaggggctgaggcaggaggatggctagaaccttggagattgaggctgcagtgagctgagatggtgtcactgccctccagcctgggtctgggtgacagagtgtgactgtgccaaaaaaaaaaaaaaaaa

SEQ ID NO: 14824 - DNA, 78 bp, Homo sapiens
aaaaaaaaaaaaaaaaaaaaaaaaaaaaaaaaaaaaaaaaaaaaaaaaaaaaaaaaaaaaaaaaaaaaaaaaaaaaaa

SEQ ID NO: 14825 - DNA, 62 bp, Homo sapiens
aaaaaaaaaaaaaaaaaaaaaaaaaaaaaaaaaaaaaaaaaaaaaaaaaaaaraarraaaaa

SEQ ID NO: 14826 - DNA, 386 bp, Homo sapiens
taattagtttaattagataagggaaaggagaaatcctaaatttgatggattcttttatactgtgaatatatttccatcagtgttggtaagatatcaaatgactatcagttgatcccagtcatcagtgacttatttgcatatttaagccctattcacaagagaccataatcattttaatcttatattttccctcaggaaatttagggactctgaagcccctattttattctcttggagtaaactgttgagtgtagttacaaaaacttttatttatgacttaaaaaaagtttagctgctatttcagtgaaagtgkaaaataaaacggtcatgatttttttcaattacagaatagttacaaattttaccatgttcatctattccacaga

SEQ ID NO: 14827 - DNA, 58 bp, Homo sapiens
aaaaaaaaaaaaaaaaaaaaaaaaaaaaaaaaaaaaaaaaaaaaaaaaaaaaaaaaaa

SEQ ID NO: 14828 - DNA, 54 bp, Homo sapiens
taagcataggattttatattttggggtgaaagaattatctggcacattaggtat

SEQ ID NO: 14829 - DNA, 478 bp, Homo sapiens
attttgttattatgttcctaagtctccttttttgttgttggtttttttctttcatacttacaagattttggttgaggaagttgaattgttgataggtgggtcacctcatgagttaattatttgagattgtttaaatacatttttatatctgtctctgaaataacaaaagtgaagctttgtggtaagaaactattcagtttttttatttgatatgcactttcatgtgtcttggtgcatagtgctgatgggaaaagaatgaaatatatgatgaaatactgtgcttgaagagcagcaagcattgaacccagtcatagctcgtgaacttgtgaatggacctgtttctttttaagtatgtgaaaatttctgggaaatattctgatgaattttacataggtcatctcttactattgaacttaaaatatttccctttttctcccaaggagaacattttcagttttacttcttttgtcctgtgctg

SEQ ID NO: 14830 - DNA, 103 bp, Homo sapiens
ggccgggagcggtggctcacgcccttaatcccagctctcagggaggctaagaggcgggaggatagcttgagcccaggagttcgagacctgcctgggcaatata

SEQ ID NO: 14831 - DNA, 76 bp, Homo sapiens
aaaaaaaaaaaaaaaaaaaaaaaaaaaaaaaaaaaaaaaaaaaaaaaaaaaaaaaaaaaaaaaaaaaaaaaaaaaa

SEQ ID NO: 14832 - DNA, 464 bp, Homo sapiens
caaggttaacaaggttgatggggaatggtccttgctctcaagaagctcgtaggcggccaggcactgtggcttatgcctgtaatcccagcattttgggaagctgaggcaggtggatcacctgaggtcaagagttcaagacmagcctggccaacatggtgaaacccgtctctactgcaaatacaaaaaattagtagccgggcgtggtggctcacgcctgtaatcccaacactttggtaggccgaggcgagtggatcacctgaggtcgggagttcgggaccagcctgaccaacacggagaaaccctgtctctactaaaagtacaaaattagccagggatggtggcatgtgcctgtaatcccagctatttgggaggctaaggcacaagaatcgctttgaacctgggagacagaggttgcagtgagctgagatcgcaccattgcactcccgcctgggcaacaagagcga

SEQ ID NO: 14833 - DNA, 405 bp, Homo sapiens
tatgtcacgatttgataggaatgtcaaatgtgataatgctgtgctttcataaattcacctaaatctcaaatatactgcttttttctgtttttaatatgttaaacaaaaagttccaataagcctgggcaacatacagagacctcatctctactaaaaaaataaaaaaaatggccgggcacagtggctcacacctgtaatcccagcagtttgggaggctgaggtgggtggatcacctgagttcaggagtttgagaccagcctggccaacatggtgaaacctgtctctactaaaaatacaaaaattagccaggtgtggtggcaggcacctgtagtcccagctactcgggaggctgaggcagggagaattgcttgaacccgggaggcagaggtggcagtgagctgagat

SEQ ID NO: 14834 - DNA, 61 bp, Homo sapiens; identical to SEQ ID NO: 14680

SEQ ID NO: 14835 - DNA, 86 bp, Homo sapiens
ggttgcagtgagctgagctcacaccttggattctagcctgggtgacagagcgaaactccatctcaaaaaaaaaaaaaaaaaaaaaa

SEQ ID NO: 14836 - DNA, 494 bp, Homo sapiens
gtttttttctttaaggaaattgattcatgaataattggaaaggtattgctagttaagacacacagaaacacaaacttagcggastgcacttcagagagtcccactgtaatctgttaatagaatctgctttaaatgagtcactccttagactggcaatgacacccagcttagtctgtaaaatcaggaatctttgtgttggctgaaggaacttagtaatcttagttgaattcctcttccccatgtctttcaaaaccagagcactgggtcgaacctaacccacaaaataattcgtccaaattaaattgacttttttacataacatcagcaccaccccttacacttttaaagttaaagaccctgttgatcaggttacctggaaatttcaagtgcatctgaccagggattatcaagctccttgtgacatctgtttctgatgctgtgaatgtgatgtcaccacaaatagagattctgaattttgctggtactaatgctga

SEQ ID NO: 14837 - DNA, 458 bp, Homo sapiens
tacaatatggagagaagtggtgtattttgaaaacatttggggccgggcgcggtagctcacgcctgtaatcccagcactttaggagactgaggggggcgaatcacgaggtcaggagtttgagaccagcctgaccaacatggtgaaacctgtctctactaaaaaaaatacaaaaattaaccaggcgtggcacctgtagtcccagcactttggcaggttgaggcaggtggatcatttgaggtcaggagtttgagaccagcctggcccacatggtaaaaccccgtctctactttaaaaaatacaaaaattagctgggcggtagtggtgcatgcctggaatcccagttactccagaggctgaggcaggagaatcacttgagcctgggaggcagaggttgcagtgagcagagatcgtgccactgcactccagtctaaatgacagagtgagaccctatctcaaaa

SEQ ID NO: 14838 - DNA, 69 bp, Homo sapiens
aaaaaaaaaaaaaaaaaaaaaaaaaaaaaaaaaaaaaaraaaaaaaaaaaaaaaaaaaaaaaaaaaaaa

SEQ ID NO: 14839 - DNA, 344 bp, Homo sapiens
attacaatttaactttggggtttgggtaagacaaacatttaatgtataggattttggccaggtgtggtggctcacgcctgtaatcccagcactttgggaggccaaggtgggcggatcacgaggtcaggagatcgaaaccatcctggctaacatggtgaaacccatctctactaaaaatacaaaaaaaaaattagctgagcatggtggcgggcgcctgtagtcccagctacttgggaggctgaggcaggagaatgacgtgaacctgggaggcggasttgcagtgagccgagatctctccactgcactccagcctgggcgacagagcgagactccatctcaaaaaa

SEQ ID NO: 14840 - DNA, 217 bp, Homo sapiens; identical to SEQ ID NO: 14714

SEQ ID NO: 14841 - DNA, 328 bp, Homo sapiens
tagattaaggcactagttcttaggatggcttttggtgcagtgactcacgcttgtaatcccggcactttgggaggccgaggcaggcagatcacttgaggtcaggagttcgagaccagccctggccaacatggttaaaccccatctctactggaaatacaaaaaattggctgggcgtggtggctcacacctgtagtcccagctgctccagaggctgaggcaggagaatcgcttgaacgcgggaggcggaggttgcagggagccaagatcatgccactgcactccagcctgggtgacagagcaagactccatctaaaaaaaaaaaaaaaaa

SEQ ID NO: 14842 - DNA, 72 bp, Homo sapiens; identical to SEQ ID NO: 10145

SEQ ID NO: 14843 - DNA, 474 bp, Homo sapiens
attattaggaaaacagtgtttctcaggaacgttgtaaattttaaatgatatatgtacttcccgtcctcccacctccactctgtgctctaatgtgagactgcttcagcagtgttgctaagttaatggaaaactttttctaatcaagtcaggtgaatgtgtattctgctaaataatgttagccatttacatgaattgtatggtcattaaatggaatcagtgattcctctttaatttccagaggggaaatgaattatggaaatcagtcagcattctgatcattaaattttatactttaattttgccgttcagcattctaaatatccaatgtgaaagtcacatgataatttgttttgcattgcgtgcactgtacaacacttacaacttgtcatttaaaatgttttctcgggaaatgaatgctagtcagaaagtaatagattgtattattcatagttttaaaattatgacaatgtcata

SEQ ID NO: 14844 - DNA, 270 bp, Homo sapiens
tttgattctctaaggagcacgaaagggggaatgcccctcccaggagtttatgggagaagggactggccggctgcctcccagcgatgcacttgacctgacactccccatgtcctggtgcgcacagcccttgtcggtgccccggcccctcccgcagcgttactgcctgtgtatagtataaatatatatattttctatatataagatgtataatataaggctccacaaatatatctgtgtgtgtgtgtgcgtgtgtgtgcggtraagggcggt

SEQ ID NO: 14845 - DNA, 253 bp, Homo sapiens
cacaaaaagatgccaggcactgtgggaggctgaggtaggcagatcacctgaggtcaggagtttgagaccagcctggccaacatggtgaaaccggtctctgctaaaaatacaaaaattagccgggggtggtggcgcatacctgtaatcccagctactcaggaggttgcggtagggaaattgcttgaacccgggagacagaggttgcagtgagctgtgactgcaacactgcattccagcctgggcaacagagtga

SEQ ID NO: 14846 - DNA, 66 bp, Homo sapiens
asagctcagccggtcgcacggacggacagttggaaagccggaccccagagcctgaggtgggcagtg

SEQ ID NO: 14847 - DNA, 109 bp, Homo sapiens
  misc_feature 106: n=a, g, c or t
ttttggccgggctggtttcaaactcctgacctcagttgatccacccgcctcagcctcccaaagtgctaggattacaggcatgaaccaccgtgcccggccaggaatnaag

SEQ ID NO: 14848 - DNA, 387 bp, Homo sapiens
  misc_feature 340: n=a, g, c or t
acttcctgttgccttaggggaacgtggctttccctgcagagccggtgtctccgcctgcgtccctgctgcagcaaccggagctggagtcggatcccgaacgsaccctcgccatggactcggccctcagcgatccgcataacggcagtgccgaggcaggcggccccaccaacagcactacgsrgccgccttccacgcccgagggcatcgcgctggcctacggcagcctcctgctcatggcgctgctgcccatcttcttcggcgccctgcgtccgtacgctgcgcccgcggcaagaatgcttcagacatgcctgaaacaatsaccagccgggatgccgcccgnttccccatcatcgccagctgsacactcttggggctstasstcttttt

SEQ ID NO: 14849 - DNA, 87 bp, Homo sapiens
tgcttagccctaaacctcaacagttaaatcaacaaaaaaaaaaaaaaaaaaaaaaaaaaaaaaaaaaaaaaaaaaaaaaaaaaaaaa

SEQ ID NO: 14850 - DNA, 480 bp, Homo sapiens
cttgttttttaattacttcctttcactgccaacctcgaattactgtacagtatatgtctttctgcttgtgatcagctttgacaacagtgacagccccacaactagtagccacctgtacatttgtaaactgacctgactccattttgtttttaaatgtgtgggttatgttgcagctgttgcagtcccccagatacctattattttacacaatttgacctataggaggacactgagtaatttacaaacacaactgcattcataaatgggaatagaacgtgaaagccagctctttcagaatatcctctattaatactgaatttagatatctttattccatttattatggtacaaataactgatgttttaaccagagtaatgacctcagtggatttgcttaaccctcacatttttttttaatgtttcacatgttacattattagctgaatacattagaaaatgacagatggtagagacttccat

SEQ ID NO: 14851 - DNA, 196 bp, Homo sapiens
cataaaattccctttaaaaatgtacaattagtggctgggtgtggtggctcatgcctgtagtcccggcgctttgggaggctgaggtaggagaatggcgtgaacctgggaggcggasttgcagtgagccaggatcgcgccactgcactccagcctgggcgacagagcgagactccgtctcaaaaaaaaaaaaaaaaaa

SEQ ID NO: 14852 - DNA, 423 bp, Homo sapiens
tttaaatagagcttaaaaattgacatttaaaaaattcagaccccagaaaattagtatgataaacactgttgaagaagaagggaaggggtttgaagttggttatgctaagcctgaatcctagtgctgccactttacaatgcaaaagagcctctttccacatctgtgaaaatgaaactaattggatatgtactttactttttattttttcaagacagagtctcactctgtttcccaggttgagtgtagtggtgggatcatagctccctgcaaactcgaactaccaggctcaagcagtcctcagctactcgggaggctgaggcaggagaatggcgtgaacccgggaggcggasttgcagtgagctgagatcgcgccactgcactccagcctggacgacagaggaagactccgtctcaaaaaaaaaa

SEQ ID NO: 14853 - DNA, 65 bp, Homo sapiens; identical to SEQ ID NO: 14743

SEQ ID NO: 14854 - DNA, 480 bp, Homo sapiens
aagattactcaaaaaccacataacacagcaaatgcaagadgcttgagacactgcatgagcagccgggctggagacagacaggagggatgatgactgccaggcaatctgctctgaagagagaaggccatatttacacatctgatgaaaaaggacctcggagctgtgctgctttctatgtttcttccagcaatgacccaagtctacgtctgacagcctcagtccagtaaggagctgtttttctccagagtgaaaagatgattttcatcttgactctgggaaacctcaaaggtagatctcctcaccattacaagaacaattatatttataattcaagctgagttgtgactccactttgccctacatggggtttaaagatggtaaaactgaactccattctcatttgaaagtacctgtgagtaaacattttttcccacagcacagcactggccattgctaactgactccctgccagcttctata

SEQ ID NO: 14855 - DNA, 138 bp, Homo sapiens
gacaaaggatccagtgtatgtgtcataatgccagttttcttggaagtagagctgcttatcatccagactttccaacagttctgacagctttagaaatagataatgcggctgtgcagacattcaattcgttattattat

SEQ ID NO: 14856 - DNA, 309 bp, Homo sapiens
tattttctatagaggtgaggtcttgctatgttgcccaagctagtcttgtactcctggcctcaagtgatcctcccatcttggcctcccaaagtgctcagaatacaggcatgagacaccatgcccagccttgatggtattttaaaaataatttgaatagatatttctaacctaactttaaaagttatgatttatttgaggaaaaaaaatatatgtatatatatattttttagatggagtctcactctgtcacccaggctggaatgcagtagcatgatctcagctcactgcaacctctgtcccttgggttca

SEQ ID NO: 14857 - DNA, 323 bp, Homo sapiens
ccactttaagtttttcttttagttcaacaaatatttattgaatatttgaagtatatccattaaggggttaggaattaagtatacaaaggtgaatatagtatgcgcttcagtaaatacaacagaggaaatacttgtaacaatagaaaaggtaaataaggggcagaagttgctatttagatttagtaagtgatccaactcggtagttttgaatctgggtgattatcaaaattactgggacaacatttaaaaaaatggagtcccagattccacctcagatcaactcaatcagagttatcacttgtagtacctttgattcttgtttg

SEQ ID NO: 14858 - DNA, 64 bp, Homo sapiens
aaaaaaaaaaaaaaaaaaaaaaaaaaaaaaaaaaaaaaaaaaaaaaaaaaaaaaaaaaaaaaaa

SEQ ID NO: 14859 - DNA, 85 bp, Homo sapiens
ctgattactaatgatgtagcgcatctttccatatgcttattggccatttctgtatcttctttggataaaagtctattctgatcct

SEQ ID NO: 14860 - DNA, 71 bp, Homo sapiens
ataggtgttcttcaagatgactaatgtcaaaaattgagacatctgttgcggttcatttttttttttttttt

SEQ ID NO: 14861 - DNA, 470 bp, Homo sapiens
agttctgtaaatccctgctgggagcagagactgcgaaaagctgagtccgccgatcgtgcccgggacaaggctgccttccactcgccgcatctacctggtaggcggcatgcgcacgggcttagaggcttgagagcctctggaagagaaagggtcccaggaaggaaacctgcccccggcctaagtgtcggcgcccagatcaccacgaaccccgcacctaggcgccgccaccaagttccaaagaagtccgaggcgacctgggagtcggtcggatcccagccgagaaaagaaacaagcaggatagcaattcttaggggagccaccctgggagttttaggcagcgtttgcctttccctggttttcttcaccadgcsccatcctccccccgcataccacccccagtcaaaagagtggtagawaatgcacagttcgaagtcggtgagagcaaaaatgggtctagtaaatcaacccgt

SEQ ID NO: 14862 - DNA, 103 bp, Homo sapiens
ctgattctaggctggtcactactccgagcctgtgacgtttgcggcagscaggccgtcgacgatgcccagtgaaactctctgggaaattgcaaaagctagaagt

SEQ ID NO: 14863 - DNA, 166 bp, Homo sapiens
tacataaaaaagacatttcagattaacactaatgttacacctcaaggaactggaaaaacaagaacaaacaaaacccaaagctagcagaaaagagatcagaactgaatgaaattgagaccaaacatgcacgcgtgtgcgcgcgcacacacacacacacacacacaca

SEQ ID NO: 14864 - DNA, 470 bp, Homo sapiens
caaggttaacaaggttgatggggaatggtccttgctctcaagaagctcgtaggcggccaggcactgtggcttatgcctgtaatcccagcattttgggaagctgaggcaggtggatcacctgaggtcaagagttcaagaccagcctggccaacatggtgaaacccgtctctactgcaaatacaaaaaattagtagccgggcgtggtggctcacgcctgtaatcccaacactttggtaggccgaggcgagtggatcacctgaggtcgggagttcgggaccagcctgaccaacacggagaaaccctgtctctactaaaagtacaaaattagccagggatggtggcatgtgcctgtaatcccagctatttgggaggctaaggcacaagaatcgctttgaacctgggagacagaggttgcagtgagctgagatcgcaccattgcactcccgcctgggcaacaagagcgaaactcc

SEQ ID NO: 14865 - DNA, 495 bp, Homo sapiens
  misc_feature 367,435,472: n=a, g, c or t
aaacaaaaacaaaaaaaaaaawtcacaccattgctcacagawttggcatctsatttttgggacctcccatctttctgttttgaaaagtgtasagtagtgsagtgttcctgatgtaactttatggcttacaatgttgacatgtctcaggttcatgtgttgcgattggtgttttccgtctcaggwagattgcaaagtgtaggccccacacattggaaaaaataataataaaacaaagcaaaaacaggaaattatggattttatttgtatattggtttatgtatttttyctwaagtatacagtgcactgtttgaaatgtattgttgagtattactttgtacaggttgatcactttttttagagtgaaganagaacaaccttgttttttgtgttttttaaaggaatataaaataatgagggatgtataattgatgccanatargcttgtyctttagtcacaccgasgtcttttttnccctttaggccagttctgttttt

SEQ ID NO: 14866 - DNA, 217 bp, Homo sapiens
agttctagaccagcctggctaacatggcgaaacaccgtctctactaaaaatacgaaaattaggcgtggtggcaaatgcctgtaatcccagctccttgggaggctgaggcacgagaattgcttgaacccgggagccggaggttgccgtgagccgagatcgcgccgtcgcattccaatatgcgcgacagagcgagactccatcgcaaaaaaaaaaaaaa

SEQ ID NO: 14867 - DNA, 444 bp, Homo sapiens
catacagatttaatcctgcgactccccagattaaaaacctttgatgctcctttttgttttttgatacagagtctcactctgtcacccaggtgggagagcagtggcgcaatctcggctcactgcaacctccgcctcctaggttcaagcaattctcctgcctcagcctcctaagtagctgggactacaggcatgcaccaccatgcccagctaatttttatatttttagtatggagtttcaccatgttggccaggctggctttgaattcctgacctcaagtgatctgactgccttggcctcccaaaatgctgggattacggacacgagccaccatgcccagctgatgctcctttttgtagaaggaagtatttgcaccatacaacattctcaccccctctggctgtagcttcccctttcctttccactctgtggtccagcggtgccag

SEQ ID NO: 14868 - DNA, 473 bp, Homo sapiens
ccacattttcgggtattcgttatagtaccactcaattcctctggtaccagttttctatcttagtttgttttgggctactatgacaaaacaccccagactgggtaatttacaataaacaagaatttattttctcacaattctggaggctgggcactctaaaatcaaggggccggcatccatcaaagtccttcttgttgtgttataatatggcagaaggcatcaccaggtagaagggcacagagagtgcaagagaggaagtgaaaaaaaggccagtctcacccttttataacaaacccacttgcatgataatgaagccccacacactccagtcatagcagcattagtccattggtgagcctggagtcctcatgacctaatcatgtctcattaggcttcacttcccaacactattgctttgggggatgtttcctacacacaattttgggggatacattcaaactacagcaaaatct

SEQ ID NO: 14869 - DNA, 69 bp, Homo sapiens; identical to SEQ ID NO: 14105

SEQ ID NO: 14870 - DNA, 276 bp, Homo sapiens
atatgaagagacagatgtgcatgcaaagaaaatgccatgtgacaacgaaggcagagaatggggtgacactgcaaaaggaacatcaaagattgccagcaaaccaccagaagctgggtgaaccatggaacagattcttcctcacagcccctcagaagatatcaatcctgctgatatccttttyctcgamcttctagccttcagaattgctaaagaacctgtactgttatgtagtccgtgcagctattgctccaactgtagccctttttcatgggtgat

SEQ ID NO: 14871 - DNA, 93 bp, Homo sapiens
tdgaactcctgagctcaagtggtctgcctgcctctgtctcccaaaatgctggtattacaggcgtgasaccgtgccaggccgtttttttttttt

SEQ ID NO: 14872 - DNA, 330 bp, Homo sapiens
  misc_feature 325: n=a, g, c or t
aacgtagggctgttcaggtgcattctgccctggctgcgctggggagcttctccctggagaagagcacctggggctgcggccaaggggcatcagcctgggcccgcggagggctggcctgcctctcctgtgctgtgggagctcgctgcctggtgcttgtctgggcgagatggacaggtgaggtcgaggacgcagagggcagaggcccagtggagcctcagacggcacagtcagagtcgggggcctgccctggccggggtcgcagtcggcagcagcgtgcagtccggcatctccctcggatgcttttccatcccaagtgcctgcggangccga

SEQ ID NO: 14873 - DNA, 417 bp, Homo sapiens
tacaatatggagagaagtggtgtattttgaaaacatttggggccgggcgcggtastcacgcctgtaatcccagcactttaggagactgaggggggcgaatcacgaggtcaggagtttgagaccagcctgaccaacatggtgaaacctgtctctactaaaaaaaatacaaaaattaaccaggcgtggcacctgtagtcccagcactttggcaggttgaggcaggtggatcatttgaggtcaggagtttgagaccagcctggcccacatggtaaaaccccgtctctactttaaaaaatacaaaaattagctgggcggtagtggtgcatgcctggaatcccagttactccagaggctgaggcaggagaatcacttgagcctgggaggcagaggttgcagtgagcagagatcgtgccactg

SEQ ID NO: 14874 - DNA, 197 bp, Homo sapiens
ctttgggagggcgaggcaggtggatcacgaggtcgggagttcgagaccggcctggccagcatggtgaatgccctgtctctactaaaaacacaaaaaaattagccgggcgtggtggtgggcacctgtgaatctataattacttcaaaataaaaagttgaaaacaaaaaaaaaaaaaaaaaaaaaaaaaaaaaaaaaaa

SEQ ID NO: 14875 - DNA, 112 bp, Homo sapiens
aacttctccagtatcccctcgctgccccgaggaaacccgagcmgcgcgccgsggccacccccagaacctcaaagactctatcgggggccccttccccgtcacttctcaccgt

SEQ ID NO: 14876 - DNA, 154 bp, Homo sapiens
atttacacagggcggtggcgacggcggtggtggtgatggtgacggtgctgtgctacaggtcaagcgattctccwrccatcggcctcccaaggaactggaaccacaggcgcgcgccactgcsccaaggattttcacttttaactgtacagtgaag

SEQ ID NO: 14877 - DNA, 435 bp, Homo sapiens
cacaggcatatcttttaaaatacattttgctcctcaggagtgtattacctagttaagaataactggccgggcgcggtgactcacacctgtaatcccagcactttgggaggccgaggcgggcggatcacgaggtcaggagatcgagaccatcctggccaagttattatttttgaaacagggtcttgctctgtcacccaggctggagtgcagtcatgtgatcatggctcactgcagcctcaacctccgggctcaggcactcagcctctcaagtagctgggactacaggtgtgcaccccaatggctcgctaatttttgtatttcttgtagagacagggttttgccatgttgcccaggctggtcttgaactcctgggctcaagcgatctgcctgccttggcctcccaaagtgtttagctaagattagctactgcgcctg

SEQ ID NO: 14878 - DNA, 463 bp, Homo sapiens
caaggttaacaaggttgatggggaatggtccttgctctcaagaagctcgtaggcggccaggcactgtggcttatgcctgtaatcccagcattttgggaagctgaggcaggtggatcacctgaggtcaagagttcaagaccagcctggccaacatggtgaaaccccgtctctactgcaaatacaaaaaattagtagccgggcgtggtggctcacgcctgtaatcccaacactttggtaggccgaggcgagtggatcacctgaggtcgggagttcgggaccagcctgaccaacacggagaaaccctgtctctactaaaagtacaaaattagccagggatggtggcatgtgcctgtaatcccagctatttgggaggctaaggcacaagaatcgctttgaacctgggagacagaggttgcagtgagctgagatcgcaccattgcactcccgcctgggcaacaagagc

SEQ ID NO: 14879 - DNA, 323 bp, Homo sapiens
  misc_feature 234: n=a, g, c or t
atattagctgtattgtattgtgttttatttatttacttttttgttttttgagacagagtttcgctcttgttgcccaggccggagtgcagtggtgcgatcttgactcactgcaacctccgcctcccaggttcaagtaattcctctgcctcagcctctcgagcagctgggattacaggcatgcgccaccatgccccactaattttgtagttttgttagagacagggtttcttcatnttggtcaggccggtcttgaactcccgacctcaggtggtccatccactttggcctcccaaaatgttgggattacaggcattagcaccacg

SEQ ID NO: 14880 - DNA, 302 bp, Homo sapiens
gtatatcctaacaatagtaaaattcaggtgatgctttcttatttttttgtttctggtgatctaaaggatatggacactaatgcattatggatagctcaggtgattttactctcaagcatttttttaagtcaaaattctacacatcagtaatagttatactgccatttgaggtcataacctgacccactgacaaagaagcccagtgatataatattattttcatatgcttcttttacacctctccctgctaattaccatcatgttaccatattcttgccaaaaaaaaaaaaaaaaaaaacccc

SEQ ID NO: 14881 - DNA, 221 bp, Homo sapiens
atcacgaggtcaggagatcgagactatcctggccaacatggcgaaatcccatctctgctaaaaatttgaaaattagctaggtgtggtggtgcgtgcctgtaatcccagctacttgggaggccgaggcacgagaatcacttgagctcaggaggtggaggttgcattgagctgagatcgtgccactgcactccagcctggcaacagagcgagactctgtctca

SEQ ID NO: 14882 - DNA, 269 bp, Homo sapiens
  misc_feature 260: n=a, g, c or t
aaaaatatttataaaatagttccaaaaatctgatatctgaaaagcaatccaagcctgtgtaaatgggaatcactgataagtatcatcatctgtatcagcttggcttggacatgaaaaattgattctctttatgtcactccttgcacctggacaaattcaatcccsggtacttaagtcacactgccaagcsstcggssctgactattgtsttgattgctgttcstttctggttcaaaataaaatcatttttgtggcaccangaaaaaaaa

SEQ ID NO: 14883 - DNA, 432 bp, Homo sapiens
gcagattttttattggccatgatcggtgtcagaattggtaccatgggtgctgcattggcatcttgcagagtgaggcagagctcattgatgagtatgtctgtccacagtgccagtcaacagaggatgccattgcagtgctcacaccactaacagagaaggatgatgaggagttgaagagggtgctctgttccttacagatgagagcccctctgtgtgcagcatttgaaaatgaaatcagctggcataattttggaagcatttctaggatttcaagtttccagtgttaggatttcaagtttccaatcttagagtgattatttactgagtctcagctagtctagtgaagggcttgacaaacttcagtccttcacataccagtgtcatgagctttaccatatccccacaccacctcagcttatctaacactcagat

SEQ ID NO: 14884 - DNA, 60 bp, Homo sapiens; identical to SEQ ID NO: 12480

SEQ ID NO: 14885 - DNA, 462 bp, Homo sapiens
aattaaagagacaaccaagggaacacattgagactacaaaaatatgaataatctcaattatattcatcacacttttttcataccatttcaagaaacgactagacagtagtaaccacatgaatattttactttctccagtataccttgagaagcaaactttgtaggaagccactcttctcccctaaacaacttctgccaaacaataataaagccaactggaaacgaatcggagccattttcattttcctaaccggggcctgacatgctttaaattatctggctgtattctaaatcaacacctaacccctcaaggaaactgaagaatcaatatacagggtaatagctttggctcagagctccaataatgtgcttcagatctgtccatgtggaaatgctttcatccaaatttttaaattggtggttaccaaagagttcacaaaacaggtttgtatgtagcacctt

SEQ ID NO: 14886 - DNA, 114 bp, Homo sapiens
tctaaaaccctcttaactggaggtttcctgttttcttcttgttttaactggtggtttccagtaggcaaaataaaatgacaggcatgctagttttttttttttttttttttttaa

SEQ ID NO: 14887 - DNA, 481 bp, Homo sapiens
tttacaaaatgtatttaaaatagctgtcatctcatttgtaaattttgtcgtgtattgtgatatagtgaaccttattgtccttatgaaatggtagctttgtgaaatacattcaccaaaaatcaaaatttgaacatctttatgattccttaccagctgaagccagatagacaggtattaattgagctgatgccccacttgagtttatagactgtttgataactgcctgtcctccaaattgtgtatgtatatgttacgatggtttaattcttgagtcagggccagcacgcatttatattttctaccaattaccttgatagaaatatcttagaaattgctgacctggaacggttgtgagaagactcctggcttctttcttgcctcacttaacaaatattttaaggtcaaagcaatatctgtgcacggctttccttttgctcctccagacaagtgaggctgttggtatagtcctcttcaccctctg

SEQ ID NO: 14888 - DNA, 389 bp, Homo sapiens
  misc_feature 34: n=a, g, c or t
acggggccggctggcgcggctggagctggagcgngcacagctggagatgcagagccagcagctgcgcgagtccaaccagcagctggacctgagcgcctgccggctgaccacgcagttgtaggtgtggctggagggccggtgggggtatgggcgtgtggtggggcagaaagcctagacccaggtggtcctgagctgggtcccaccctccgagccatggtgcccccctgccagctattgacacagctgcgaagtgcccaggaagaggagaaccggcagctgctggctgaagttcaggccctgagccgggagaacagggagctcctggagcgcacgctggagagtcgggaccacctgcaccgcgaacagcgtgagtacctggaccagcttaa

SEQ ID NO: 14889 - DNA, 194 bp, Homo sapiens
aattttccccccttttcagccaaatacagcttttaaaagatcacgtagatcagggttgtccaatcctttggcttccctgaaccacattggaagaggaataattgtcttgggccacagacaaaatacactaacagtagctgataagctttcgaaaaaaaaaaaaaaaaaaaaaaaaaaaaaaaaaaaaaaaaaaa

SEQ ID NO: 14890 - DNA, 240 bp, Homo sapiens
atgagggatcccctttcttaaacctgcaaaaaagtagaacattttggttgggcgtggtggctcacacctgtaatcccagcactttgggaagccgaggcaggcggatcacctggggtcaggagtttgagaccagcctggccaacatggtgaaacccgtctctactaaaaatacaaaaatagccaggcatgttggtgcacacctgtattcccagctacttaggaggctgaagcaggagaatc

SEQ ID NO: 14891 - DNA, 301 bp, Homo sapiens
gaaatacaggtttgctgggtgtggtggctcacgcctgtaatcccagcactttgggaggcctaggtgggcgggtcaccagcccggccgacatagtgaaaccccgtctctactaaaaatacaaaaatcagccagatgtggtggctcatgcctgtagtcccagctacttgggaggctgaggcgggaggatcgcgtgagcctgggaggcagaggttgcagtgagctgagaccacaccactgtactccagcctgggcaacagagtcagactcagtttcaaaaaataaataaacaaacaaaaataaa

SEQ ID NO: 14892 - DNA, 75 bp, Homo sapiens
aaaaaaaaaaaaaaaaaaaaaaaaaaaaaaaaaaaaaaaaaaaaaaaaaaaaaaaaaaaaaaaaaaaaaaaaaaa

SEQ ID NO: 14893 - DNA, 357 bp, Homo sapiens
attacaatttaactttggggtttgggtaagacaaacatttaatgtataggattttggccaggtgtggtggctcacgcctgtaatcccagcactttgggaggccaaggtgggcggatcacgaggtcaggagatcgaaaccatcctggctaacatggtgaaaccccatctctactaaaaatacaaaaaaaaaattagctgagcatggtggcgggcgcctgtagtcccagctacttgggaggctgaggcaggagaatgacgtgaacctgggaggcggasttgcagtgagccgagatctctccactgcactccagcctgggcgacagagcgagactccatctcaaaaaaaaaaaaaaaaag

SEQ ID NO: 14894 - DNA, 386 bp, Homo sapiens
cacaggcatatcttttaaratacattttgctcctcaggagtgtattacctagttaagaataactggccgggcgcggtgactcacacctgtaatcccagcactttgggaggccgaggcgggcggatcacgaggtcaggagatcgagaccatcctggccaagttattatttttgaaacagggtcttgctctgtcacccaggctggagtgcagtcatgtgatcatggctcactgcagcctcaacctccgggctcaggcactcagcctctcaagtagctgggactacaggtgtgcaccccaatggctcgctaatttttgtatttcttgtagagacagggttttgccatgttgcccaggctggtcttgaactcctgggctcaagcgatctg

SEQ ID NO: 14895 - DNA, 481 bp, Homo sapiens
  misc_feature 98,229: n=a, g, c or t
cgcggccaatgatgaactcacctggaagaagacaggtccctgctggctggggagcacgtgcctgtcccctcttcggaccctcccaagccctgtccacntagcactccgcctgytctctgcctggcccatgggctccctcgtgggatggtgatgcctgtagggggcctgacgtctgccgctcagagaggcaaggtggggagttaggaaagagctgggccagttctgtgknybccctcggccccctgccccccgccactgctgcccacttcccaggcagcccaggatgtgtactgtcaccggccttaccgcagatccacagcacggagcaaacagcatttggaagtcgtgttcgcagtacttccggccttcaaactgcaaaggggtcgcagagagaggacaagcaaaccacctatcatccccatgagcagccaggccttgttgggtcaggacctgacagcaggggatgaggcacctkagggca

SEQ ID NO: 14896 - DNA, 181 bp, Homo sapiens
catgagattatgtaatcaaaaggtgctgccatttttaatttttaattttttagagacagagtcttgctttgtcacccaggctggtgtgcaatggtacgatcatagcttgttgcaattttcagccctgggttcaaagtgatcctcctgctacagcctcccagtagctaggacaataggtgtg

SEQ ID NO: 14897 - DNA, 485 bp, Homo sapiens
agagcccgacacttgaggagactgttgctcaatttaagaaagcacagctattggaaagccaggaaacagacccagagaggcggatgcatgtgggagcaaagagctttgggcagcctttaaggtaggcattggcgtctgaaatcatgttattgccttttgtttatttgttagatggattttgtattggttttatgctttgttcggtttagagaattttcctttgatggagctgccaatatcaatagatttggttttgaaatcctcgggccgggttcataggataggctggagcccacggtgttagtgtagatgcctcaaagtcagaagagatggatacaaaactggtgatgattttcaaaggagattcacttgcaaatctcactgcaatggagacttgctgggagtcctggtgcctgctgaggcaggcagctcttaggaacctcaggaagtttctgacttaaagagacaggaaaggaaaattgaat

SEQ ID NO: 14898 - DNA, 330 bp, Homo sapiens
attacaatttaactttggggtttgggtaagacaaacatttaatgtataggattttggccaggtgtggtggctcacgcctgtaatcccagcactttgggaggccaaggtgggcggatcacgaggtcaggagatcgaaaccatcctggctaacatggtgaaacccatctctactaaaaatacaaaaaaaaaattagctgagcatggtggcgggcgcctgtagtcccagctacttgggaggctgaggcaggagaatgacgtgaacctgggaggcggasttgcagtgagccgagatctctccactgcactccagcctgggcgacagagcgagac

SEQ ID NO: 14899 - DNA, 485 bp, Homo sapiens
aatactccttttcctaaaaaactcaagggtttaaaaattgctattttatattttaaatgatattgagcagctacctacaatttctatgtacattttgttccccccccaccaccacccccaaattacgttccttttgacattttcctcatctgctgtttgtgacaagtcatcagccagatttcctgactgacacataggtatgatcagtgcaggagagacctgcgcaccacaggctgcaaactggaggttctgttctcatggcagtttgggcagtaacttttgagagaggccaaaaaaaggaggatgacatgctgtctcctctcttcagtatagacattaggctcttattcagaaaggatttttctttaaaaatgtacttactttactgaactacttacaggcacatttcttcataaggccacacctaatccaaacaagacagtctcccaacactgaagttccaaaataatccttaccactttgta

SEQ ID NO: 14900 - DNA, 285 bp, Homo sapiens
gttattcaggctgggcgtggtggctcatgcctgtaatcccagcactttgagaggctgaggcaggcggatcatttgaggtcaggagtttgagaccagcctggccaacatgattaaaccctgtctccactaaaaatagaaatattagctgggcatggtggcatgtgccgtgatcccagctcctccagaggctgaggcaggaaaattgcttgaacccaggaagcggaagttgcagtgagctgagatctcgccactgtgctccagcctgggcgacagggagactccctc

SEQ ID NO: 14901 - DNA, 78 bp, Homo sapiens
tcatgagccttttcaactttccagttgatatcttttgtttgcttttttcttttcttatttatttatttatttatktat

SEQ ID NO: 14902 - DNA, 162 bp, Homo sapiens; identical to SEQ ID NO: 14794

SEQ ID NO: 14903 - DNA, 435 bp, Homo sapiens
cagttgtccatactttgctttctcctttctttcccagcccttattagaattttaatttcatatttggccatacatttgtttctttaatagttttctctcccattagtctatgagcccattagggatcacggctattttgtctgctgtatgtaatatccacttcctagcaagcaggacacactcaaggaagagttattgaataataatttaaaaatatttttkattaaatgaaaaatataaatatccaattctaagaatgtgcaattctgtcaggagtgttaagtactgaaaaaacgacagcagattagttaattggttgatttcacaaacatctgtagattgttgacagtgcactatgatgtgctgttctaggtgctgagtacatgtggacgggttgttgcctggctttgcagaggtctcaccttggggagatag

SEQ ID NO: 14904 - DNA, 279 bp, Homo sapiens
ttatatggaaagctcgactctccctttggtaagtccgaagcatgttgtttgttcgaccgtgactgtcttcctcagtctgtgcctgtgattccagtcaccctgtagttactgacagaaattgactggactgtcattgtgtgaagtctaggaggaaatgtccattttaattgtatgatttggtcataagtaaggactatatttatgtcaccattattagatatatgtacttttgtaatgactgtgaaatacacttttccctcactaaaaaaaaaaaaaaaa

SEQ ID NO: 14905 - DNA, 71 bp, Homo sapiens
aaaaaaaaaaaaaaaaaaaaaaaaaaaaaaaaaaaaaaaaaaaaaaaaaaaaaaaaaaaaaaaaaaaaaaa

SEQ ID NO: 14906 - DNA, 297 bp, Homo sapiens
gtacgcgctgaaacgccagggtcgcaccctttatggtttcggcggttgagctgtccccacagcttctctacagactccaaaaggcccttttcagggccccaaactgtcacagaaagagctgttaacacttcctagataacggaccaagtctagctctgccaccgaggctggagtgcagtggcacgatctcgcctcctcctcccgggttcaagcgattcacctgcctcagcttccggagtagctgggattacaggcctgcccaccacgcctggctaatttttgtatttttttkttttt

SEQ ID NO: 14907 - DNA, 370 bp, Homo sapiens
atattagctgtattgtattgtgttttatttatttacttttttgttttttgagacagagtttcgctcttgttgcccaggccggagtgcagtggtgcgatcttgactcactgcaacctccgcctcccaggttcaagtaattcctctgcctcagcctctcgagcagctgggattacaggcatgcgccaccatgccccactaattttgtagttttgttagagacagggtttcttcatgttggtcaggccggtcttgaactcccgacctcaggtggtccatccactttggcctcccaaaatgttgggattacaggcattagccaccacgcctggcctatttatttacttattaatggtgtttttttttggttttt

SEQ ID NO: 14908 - DNA, 413 bp, Homo sapiens
taatctggccggccacagtggttcatgcctgtggttaacagctactcgggaggctgatgcagagggactccttggggcccaggagttggagactgtagtgcacagtgatcacacctgtgaatagccactgtacttaagccggggcagcatagcaagaccctgtctctacaaaaaattaaagaattaggtgggtttggtgacatgcacttgcggtcctagctgctcacgaggastaaggtgggagtattactgtaacctcaaactccttgagcctaggagttcgaggttgcagtgagctatgattgtgccactgcactccagcctgggtgataaagcgggaccagaccctgtttttttttttttaaaaaaagtcatatttgttatttgtctaatcttgtgtggagaaggacagc

SEQ ID NO: 14909 - DNA, 386 bp, Homo sapiens
  misc_feature 368: n=a, g, c or t
gaaatacaggtttgctgggtgtggtggctcacgcctgtaatcccagcactttgggaggcctaggtgggcgggtcaccagcccggccgacatagtgaaaccccgtctctactaaaaatacaaaaatcagccagatgtggtggctcatgcctgtagtcccagctacttgggaggctgaggcgggaggatcgcgtgagcctgggaggcagaggttgcagtgagctgagaccacaccactgtactccagcctgggcaacagagtcagactcagtttcaaaaaataaataaacaaacaaaaataaaaaatacaggtttgcagggaggccctgtgggtggggaagcatggdcaaagccattctctcctaatgtngcatgtdaggtagawtgc

SEQ ID NO: 14910 - DNA, 119 bp, Homo sapiens
ctgattactaatgatgtagcgcatctttccatatgcttattggccatttctgtatcttctttggataaaagtctattctgatcctctacccttttctttttttttttttttttgggtga

SEQ ID NO: 14911 - DNA, 302 bp, Homo sapiens
gaaatacaggtttgctgggtgtggtggctcacgcctgtaatcccagcactttgggaggcctaggtgggcgggtcamcagcccggccgacatagtgaaaccccgtctctactaaaaatacaaaaatcagccagatgtggtggctcatgcctgtagtcccagctacttgggaggctgaggcgggaggatcgcgtgagcctgggaggcagaggttgcagtgagctgagaccacaccactgtactccagcctgggcaacagagtcagactcagtttcaaaaaataaataaacaaacaaaaataaaa

SEQ ID NO: 14912 - DNA, 152 bp, Homo sapiens
catgagattatgtaatcaaaaggtgctgccatttttaatttttaattttttagagacagagtcttgctttgtcacccaggctggtgtgcaatggtacgatcatagcttgttgcaattttcagccctgggttcaaagtgatcctcctgctaca

SEQ ID NO: 14913 - DNA, 52 bp, Homo sapiens
asatcggatcgsagggstcccaaaatggcgagtgaygctgcggggactcgct

SEQ ID NO: 14914 - DNA, 50 bp, Homo sapiens
agatcgcgccgctgcgtccagcctgggcgagagagtgagactctgtctca

SEQ ID NO: 14915 - DNA, 76 bp, Homo sapiens; identical to SEQ ID NO: 14831

SEQ ID NO: 14916 - DNA, 78 bp, Homo sapiens
ataggtgttcttcaagatgactaatgtcaaaaattgagacatctgttgcggttctttttttttttttttttscccmcg

SEQ ID NO: 14917 - DNA, 482 bp, Homo sapiens
ctattgtctcaattttaactttccgttctttatttagtttactaaggtagaagtttaggctactgattctggaatttcttcttttctaacacacattggatgctataaatttccttttatgcactacattagctaaataacacaaagttttctaatttttattttcatttagttcaaaatattttctaatttctcttgagacttcttttttgaaccatggtttatttaaaggtgtactgtttaatttcctactatagtcagctttctgtttttgatttctagtttaattcctttgtgatctaagaacgtaatttgtatgatttctattctttttaatttgtgaaggtgtgtttgatggtcctgaatgtggtctgtcttggtgaacattccatgagtgtttgagaagaatgtgcattccgctgttattggatgaaatactctataaatgttaattagatcaagttaattaatagtgctgtgca

SEQ ID NO: 14918 - DNA, 293 bp, Homo sapiens
gttattcaggctgggcgtggtggctcatgcctgtaatcccagcactttgagaggctgaggcaggcggatcatttgaggtcaggagtttgagaccagcctggccaacatgattaaaccctgtctccactaaaaatagaaatattagctgggcatggtggcatgtgccgtgatcccagctcctccagaggctgaggcaggaaaattgcttgaacccaggaagcggaagttgcagtgagctgagatctcgccactgtgctccagcctgggcgacagggagactcctctcaaaaaaa

SEQ ID NO: 14919 - DNA, 496 bp, Homo sapiens
gaaagaaaatgatgtctgttgttatagttcattgttttgcctactcagcagaagtgatgactcttaaaaattggctttgaccaaagttctcttgttttcagggaaagaacataaaagctttttgaactacagcctttttaaaagagggatgggaggatattacagtaagaaattaggctttctaaaagtatgaaacatccttcaactgggctctcttgttaataggacatcatatggtaatagactggtttgactatattgttagctgccacagtaagcaggtcattgtataggtaaatgcctgcacccataattttctagtaatagccacgaccaatttattaacagtcagggcctatccttgcctgtagttctcagtcactggatgcacaaaatcactgtgtaacattggctcacttggtgagcatagggttgactgataaaatgtttaattcccttgctagcttgtgagaagaatgagttgatgacatgctcc

SEQ ID NO: 14920 - DNA, 59 bp, Homo sapiens
cgggatgaaatgacttgagcgggacagcttgcttccaggcttccggcagcagggsgtgg

SEQ ID NO: 14921 - DNA, 474 bp, Homo sapiens
aaacaacaagttaactgctgttcccagttatatctggtctttcccacccccaaacatacacaaaagatttttgtcattcttggcactggacaacagaagtgataagacatgccagcagaactctaaaggcagaatgtccttccacctgttttatgctgtaagacaaacttccaagtgcgaggcagtgtggagggctgttgccttgaatggcagctgaatgcaccagcgggatccttggcagcaatgccaggcactgaagtcgggcattcaggagagctaaatggagaaaagaaacttgagcaaactgcttcctggaacactgagaacctgaatgggaaattaagaagaaccagattctttctattcttccaccagccaaggtgatgagcacaaaaggatccatcttatacagtgcttgccagcttccataatactactcaccacgatgttgaaatcacctgttccagaaccagt

SEQ ID NO: 14922 - DNA, 195 bp, Homo sapiens; identical to SEQ ID NO: 14704

SEQ ID NO: 14923 - DNA, 113 bp, Homo sapiens
cataaaattccctttaaaaatgtacaattagtggctgggtgtggtggctcatgcctgtagtcccggcgctttgggaggctgaggtaggagaatggcgtgaacctgggaggcgg

SEQ ID NO: 14924 - DNA, 328 bp, Homo sapiens; identical to SEQ ID NO: 14841

SEQ ID NO: 14925 - DNA, 91 bp, Homo sapiens
gcagtcctacttctcctatctctcccagtaaaaaaaaaaaaaaaaaaaaaaaaaaaaaaaaaaaaaaaaaaaaaaaaaaaaaaaaaaaaaa

SEQ ID NO: 14926 - DNA, 84 bp, Homo sapiens
ggttgcagtgagctgagctcaaccttggattctagcctgggtgacagagcgaaactccatctcaaaaaaaaaaaaaaaaaaaaa

SEQ ID NO: 14927 - DNA, 112 bp, Homo sapiens
ctgattactaatgatgtagcgcatctttccatatgcttattggccatttctgtatcttctttggataaaagtctattctgatcctctacccttttctttttttttttttttt

SEQ ID NO: 14928 - DNA, 122 bp, Homo sapiens
tdgaactcctgagctcaagtggtctgcctgcctctgtctcccaaaatgctggtattacaggcgtgasaccgtgccaggccgtttttttttttttggttttttggttstgttggttttaacat

SEQ ID NO: 14929 - DNA, 216 bp, Homo sapiens; identical to SEQ ID NO: 14713

SEQ ID NO: 14930 - DNA, 477 bp, Homo sapiens
atatttggcagattaaacttgacattatcgtaatctttgttttggcaatccatcctttggcttccgtgctcgagccgtttttacccagctgggtacggtgccacgttcaggcacgtgcacccggcaaggttcagggcacatacctacctggggcatgacatctgtcaggtggcaccgagcaggatgcgggatggaccctagataccacagcctgccccctcccctcctttagccaagtcaggatcttaggcctcagcaggcagggacccttccaggccacagtaggctgaagcagcaccaggatcctggcctggcctggcctgtaggtgtcccctggtggttataattctgtaactctaggggagaaggggaatagcactagcattggatgtcgccaaggcccacattttcctgagagaagccacaaaagatgtgcaaatgcccttcagcacaggacctggtgacatgacataaact

SEQ ID NO: 14931 - DNA, 91 bp, Homo sapiens
acatttgagtcagtggactgagtaaggaagatccccctcagtgtgagcaccatccaattggctgaggatagaacaaaaaaaaaaaaaaaaa

SEQ ID NO: 14932 - DNA, 234 bp, Homo sapiens
catgagattatgtaatcaaaaggtgctgccatttttaatttttaattttttagagacagagtcttgctttgtcacccaggctggtgtgcaatggtacgatcatagcttgttgcaattttcagccctgggttcaaagtgatcctcctgctacagcctcccagtagctaggacaataggtgtgagccatcatgcttggggtaaaaaaaaaaaacaaaaccatatatatatatatat

SEQ ID NO: 14933 - DNA, 434 bp, Homo sapiens
atgagcatttggacgttccatttgaagtacctaatgggcacatttggctatttttcaaagagagcatgtagttcaagaaatggcttattttgttttttattcttctttttgtggtctatttaggaaaacaaaatgaaggtggcctttgtctttcagttatggaacagctaccggacctgcatagccatttttctgatctgaacctggaagctcatatgtatgcatcccagtggtttctcactctttttactgccaagttcccactctgcatggtgttccacatcattgacttactgctttgtgagggtttgaacataatctttcatgtagctttggctctcctaaagacctcaaaggaagaccttctgcaggctgattttgaaggtgctttaaagttctttagagttcagcttccaaagagatacagggcagag

SEQ ID NO: 14934 - DNA, 313 bp, Homo sapiens
gttattcaggctgggcgtggtggctcatgcctgtaatcccagcactttgagaggctgaggcaggcggatcatttgaggtcaggagtttgagaccagcctggccaacatgattaaaccctgtctccactaaaaatagaaatattagctgggcatggtggcatgtgccgtgatcccagctcctccagaggctgaggcaggaaaattgcttgaacccaggaagcggaagttgcagtgagctgagatctcgccactgtgctccagcctgggcgacagggagactccctctcaaaaaaaaaaaaaaaaaacccggaaa

SEQ ID NO: 14935 - DNA, 449 bp, Homo sapiens
ttcaaatttccccagttttcccaatattatcctttatacaaatctttttttacaatctaaaatcacatatttcatgtagttgtcatgtctcttcagtctcttttaatctggaacagtttttggccttgctttgtctttcatgacagtgacatttttgaagaatacaggcccattgttttgtccccattgtttccctgtgattcaattaaagttatacatttttggcagagacactacataagcaatttatgttcatcacatcaggacacacctacagtcagtttgtattatttgggaggatgtttttgaccttgatcacttgattaaagtggtttccactagatttgtcctcattttttctccttgtatttaataaataatatgtaggaatatactttgggactgtgtaaatatccgcttctccaataaattttctaccaacttccagc

SEQ ID NO: 14936 - DNA, 62 bp, Homo sapiens; identical to SEQ ID NO: 11091

SEQ ID NO: 14937 - DNA, 144 bp, Homo sapiens
catgagattatgtaatcaaaaggtgctgccatttttaatttttaattttttagagacagagtcttgctttgtcacccaggctggtgtgcaatggtacgatcatagcttgttgcaattttcagccctgggttcaaagtgatcctc

SEQ ID NO: 14938 - DNA, 354 bp, Homo sapiens
cctttccaagcctgcctggacggctgttctgtgacttgacagtggctcccccagccccaaagccagcccccttcatctgtgamttaatctgttgtagtggtgagctgatacattcaggtgtgaccgttggtkaaaacktgtgccccttctgtggtatgcccttgccctgttctataaatatctataaatactacatatatatacacacctacacatggccaaccgcctcgcctctagcgctgggaatcagtcactgtgctatccttgtggagtcttgtggcccaactaccagagaacgctgtcccccgacatcccactccaaagtgtgccacctccagtgagcctccttgtcat

SEQ ID NO: 14939 - DNA, 67 bp, Homo sapiens
gttgcagatagtcttgccgcatcttggcaagttgcagagatggtggagctagaaaaaaaaaaaaaaa

SEQ ID NO: 14940 - DNA, 157 bp, Homo sapiens
tytcccttccccagtggacgtctagstggggacagggtatcttggctcccagctggaccagagtgccctgcttgcctctgctctccctttgtggggactcaggcagccagaggccatctsggcaagtctctgagtaggccagagtcctcctgggcag

SEQ ID NO: 14941 - DNA, 431 bp, Homo sapiens
cattcacttatttatttattgagttatttatttttgagacagagtctctatcacacagactggagtgcagtggtgcaatcacagctcatggcaacctaaacctcccaggctcaaaccatctttccacctcagtctcctgagcagctaggaccacaggtgtgtctggctaattaaaaaaaatttttttttaaatttttgtagttatagggccttcctatgttgccaatgctggtctcgaactcctgggctcaagcgatcctcctgctttgtcctcccaaagtactggaattataagtgtgagccaccacagcagtctttttattcattttttattcatttatttattcatktgttggcttactgtcatcagtagtctcatatataattatttttatttcaaattactatctcattcttttcaataaatgcat

SEQ ID NO: 14942 - DNA, 255 bp, Homo sapiens
tagttcttaggaacagactcgatgcaagtbtttctgttctgggaggtattggagggaaaaaacaagcaggatggctggaacactgtactgaggaatgaatagaaaggcttccagatgtctaaaagattctttaaactactgaactgttacctaggttaacaaccctgttgagtatttgctgtttgtccagttcaggaatttttgttttgttttgtctatatgtgsggsttttcagaagaaatttaatsagtgtga

SEQ ID NO: 14943 - DNA, 328 bp, Homo sapiens
gaaatacaggtttgctgggtgtggtggctcacgcctgtaatcccagcactttgggaggcctaggtgggcgggtcaccagccggccgacatagtgaaaccccgtctctactaaaaatacaaaaatcagccagatgtggtggctcatgcctgtagtcccagctacttgggaggctgaggcgggaggatcgcgtgagcctgggaggcagaggttgcagtgagctgagaccacaccactgtactccagcctgggcaacagagtcagactcagtttcaaaaaataaataaacaaacaaaaataaaaaatacaggtttgcagggaggcsctgtg

SEQ ID NO: 14944 - DNA, 91 bp, Homo sapiens; identical to SEQ ID NO: 14931

SEQ ID NO: 14945 - DNA, 62 bp, Homo sapiens
  misc_feature 13..14: n=a, g, c or t
cttcccagcatgnntytcctatctaaacccrgacttagtttaatttccttatctttcacttc

SEQ ID NO: 14946 - DNA, 95 bp, Homo sapiens
ttttggccgggctggtttcaaactcctgacctcagttgatccacccgcctcagcctcccaaagtgctaggattacaggcatgaaccaccgtgccc

SEQ ID NO: 14947 - DNA, 94 bp, Homo sapiens
  misc_feature 67: n=a, g, c or t
ttgaactcctgagctcaagtggtctgcctgcctctgtctcccaaaatgctggtattacaggcgtganaccgtgccaggccgttttttttttttt

SEQ ID NO: 14948 - DNA, 61 bp, Homo sapiens; identical to SEQ ID NO: 14680

SEQ ID NO: 14949 - DNA, 85 bp, Homo sapiens; identical to SEQ ID NO: 13395

SEQ ID NO: 14950 - DNA, 195 bp, Homo sapiens; identical to SEQ ID NO: 14704

SEQ ID NO: 14951 - DNA, 224 bp, Homo sapiens
atcacgaggtcaggagatcgagactatcctggccaacatggcgaaatcccatctctgctaaaaatttgaaaattagctaggtgtggtggtgcgtgcctgtaatcccagctacttgggaggccgaggcacgagaatcacttgagctcaggaggtggaggttgcattgagctgagatcgtgccactgcactccagcctggcaacagagcgagactctgtctcaaaa

SEQ ID NO: 14952 - DNA, 486 bp, Homo sapiens
  misc_feature 119: n=a, g, c or t
atcagcgctctgtgtctagctaaaggattgtcaatgcaccaatcagcactctgtaaaaacgcaccaatcagtgctctgtgtctagctaaaggattgtaaacacaccaaccagcactckntgaaagggaccaatcagctctctgtaaaatggaccaatcagcaggatgtgggcggggccaaataagggaatataagctggccaactgagccagcagcggcaaccctgttgggtccccttcaatgccgtggacggtttgttcttttgctcttcacaataaatcttactgctgctcactctttgggtcctcactacctttatgaggtgtaacactcaccacaagggtctatagcttcattcctgaagtcagcaagaccacgaacccatcagaaggaagaaactctggacacgtatgaacatctgaaggaacaaactccagacataccatctttaagaactgtaacaccatgagggtctgcggcttcatt

SEQ ID NO: 14953 - DNA, 94 bp, Homo sapiens
ttgaactcctgagctcaagtggtctgcctgcctctgtctcccaaaatgctggtattacaggcgtgasaccgtgccaggccgttttttttttttt

SEQ ID NO: 14954 - DNA, 249 bp, Homo sapiens
ttttttgtttgtctgttttgagacagggccttactgtgtcgcttaggctggatggggtgcagtggtgcagtcacagctcacacagctctgtctcctggacttaagcagtcctcctgccttagcctcccaagtagctgggactacaggtgcatgccaccacacccagtgagtttttctttttaaaaaaaaattttatttgtttattttttgagacggagtctcgctctgtctcaaaaaaaaaaaaaaaaa

SEQ ID NO: 14955 - DNA, 491 bp, Homo sapiens
aagaattaagaagtgaaagatctctacaattaaaactaaaacattgaagaaagaaatcaaagagaacacagaaaaacagaaagatattcaatgtttacagattggaagactcaattattgttaaaacatccatgctacccaaagcaatctgcagattcaatgcaatccctatcaaagtaacaataacattcttcatagaaatagaaaaataatcctaaaatttatatagaatcacaaagtcccagaatagccaaagaggatagcccacaaaagacctacaggctgggcgtggtggctcgtgcctgtaatcccagcacttttggaggctgaggtaggcagatcacttgaggtcaggagttcaagaccagcctggccgacatagtgaaaccccgtctctactaaaaatacaaaaattagctgggcatgggggcacacacctgtaatcccagttactcgggaggctgaggcacaagaatagcttgaacctggga

SEQ ID NO: 14956 - DNA, 501 bp, Homo sapiens
tccactgtttcttttacaggttaactaccctgtaaaattacttaaaaaaaaagtgttaaggcaatgtcatcaacataggctggcattttatgtgcatcctaaaatggaggattcctttccatgtaaacaaggtaaaagaataattattctgtaaaagtcagtttaatctgtttgtatatttgcctcatctatagaaggagctaaagcatacagatgacttaacacttcaaaatacattgatacagtttaattaattttgaagccaaaactagccaaactgtgtgcattaactaccatatttatgatgtagcactgggtatgttctctgcataaatctctgtggttttagtcttgtcccaactttcagccaactgcattcactacttggttggtgcctgtggccttagggctactacatagtcttcagtgcccattcttgatgaaaagtagagaataacctgtataataaacaaacattgtttaactcaaaaaaaaaaaaaa

SEQ ID NO: 14957 - DNA, 216 bp, Homo sapiens
taaccttgatcacttggttaaggcgttgtctaccagagttacccaccgtaagctgctaatttccctttccatactctgttccaggggtgtccaatcttttggctgccctgggacacattggaagaagaattgtcttgggcaacacataaaatacatcattaacactatgacagctgttgagctaaaaaaaaaaaaaaaaaaaaaaaaaaaaaaaaa

SEQ ID NO: 14958 - DNA, 83 bp, Homo sapiens; identical to SEQ ID NO: 14783

SEQ ID NO: 14959 - DNA, 83 bp, Homo sapiens; identical to SEQ ID NO: 14751

SEQ ID NO: 14960 - DNA, 88 bp, Homo sapiens
cttccctgttatctttgtgacccactgatagcagctggtggtcctggtgcggtgagattttgactcttttttttttttttttttgaga

SEQ ID NO: 14961 - DNA, 427 bp, Homo sapiens
  misc_feature 29..30: n=a, g, c or t
aaggacttaagcgccccggagccgggagnnacttgggacccgctggcctcgctcggtgcgcgcctccctccccgcatgcagcccgccgagcgctcgcgagtccccaggatcgacccgtacggattcgagcggcctgaggacttcgacgacgccgcctacgagaagttttwctccagctacctggtcacgctcacccgcagcgattcaaatggtcccggctgctgcagggcgggggcgtccccaggagccggacagtgaagcgctatggtccggaaaggggtcccgctggagcaccgtgcccgcgtctggatggtgctgagtggggcccaggcgcagatggaccagaatcccggctactaccaccagcttctccagggagagagaaaccccaggctggaggacgccatcaggacaggacctgaaccgg

SEQ ID NO: 14962 - DNA, 89 bp, Homo sapiens
agttggttagcgaagggattcggtgcagatggatggaccgtctgggctgcggagtccacgggcctgaaacgcggtcgctcctgasscgt

SEQ ID NO: 14963 - DNA, 73 bp, Homo sapiens
aaaaaaaaaaaaaaaaaaaaaaaaaaaaaaaaaaaaaaaaaaaaaaaaaaaaaaaaaaaaaaaaaaaaaaaaa

SEQ ID NO: 14964 - DNA, 187 bp, Homo sapiens
ctttttacagctagacctgtgtgctgcaaggagctaaggccttcagtgtccccttccttacccaggtttctcacagaatggattcccagcggaacttgcagaggaactgcggctttaccaatccacccttcttcaggatggtctaaaagatctcctggatgagaaaaaattcatcgattgcacccta

SEQ ID NO: 14965 - DNA, 458 bp, Homo sapiens
ttttctttcttattttacttctcctgatatttcyttctttctttctttcttttttgagacagagtctcgctctgtcgcccaggctggagtgcagtggcactatctcggctcactgcaagctctgcctcccgggttcacgccattctcctgcctcagcctcccgagtagctgggactacaggcgcccgccaccacacccggctaattttttgtattttttagtagagatggggtttcaccgtgttaggcaggatggtctccatctcctgacctcgtgatccgcgcgcctcagcctcccaaagtgctgggattacaggcgtgagcaccgtgcccggcccttttcctgatagttctttaacaacgttaacttatgtaatcagagatcaagctctgattaaagtgaaaatgcatttttaaagggctttttaggattcctttacgatgcaaactccatattaa

SEQ ID NO: 14966 - DNA, 63 bp, Homo sapiens
tcttgtttttagtctcgcttttcggttgccgttgtcttttttccttgactcggaaatgtccgg

SEQ ID NO: 14967 - DNA, 118 bp, Homo sapiens
gcaaaaattagccgggcatggtgacgtgcacctgtagtcccagctactagataggctgaggcaggagaattgcttgaatccgggaggcggaggttgcagtgagccgagatcgtgccac

SEQ ID NO: 14968 - DNA, 58 bp, Homo sapiens
aaccctagtgacaggagccgaagcagcagcgcaggttgtccccgtttcscctsctcct

SEQ ID NO: 14969 - DNA, 328 bp, Homo sapiens
acccaggatgaaaggagtggggtagtggtggatgtggggttgagagggatgtggacaggagagagaaaccttagcatttgaggccttagagagtttgacagcctgagcttcaaatggtcatccccccagctagctaaggttgcgagattgaatcactagtcgacccacccctttcctcctgtacataatgtcactggcttgttgggatttttaatttattctttcactcagcaccaagggcccccgacactccactcctgctgcccctgagctgagcagagtcatttattggagagttttgtatttattaaaacatttctttttcagt

SEQ ID NO: 14970 - DNA, 105 bp, Homo sapiens
attggcgtgctgtagggcgcggtgcactgsgssgtttatcgtcaataggtggaccccttcccggagataaaaccgccggcgccggcgcsgccagtccctctggct

SEQ ID NO: 14971 - DNA, 235 bp, Homo sapiens
atcacgaggtcaggagatcgagactatcctggccaacatggcgaaatcccatctctgctaaaaatttgaaaattagctaggtgtggtggtgcgtgcctgtaatcccagctacttgggaggccgaggcacgagaatcacttgagctcaggaggtggaggttgcattgagctgagatcgtgccactgcactccagcctggcaacagagcgagactctgtctcaaaaaaaaaaaaaaa

SEQ ID NO: 14972 - DNA, 469 bp, Homo sapiens
  misc_feature 263: n=a, g, c or t
aagcatatttgatcactttgattctctgttcttttctctccgcggtgtgtgtgtgcctgcacacctgcaaaacgagggaacaactaaggtggctgaagacctttctggcagggcatttgcaaggacccaaatccattcaacaagggtgcagcctgccacaggstcctcatccggactgaggaagacgaggacagggaggaggaaaacgaggaagaggaggacaaaaaggggggacgagaaggttcttcgtccaaaggaggaangagaagaagtagaaagtgcgaagagctgagttccccacctttttttctattgatgcttcttttttaacaaactacagttttaccgtgtgtttgccatttgagctgtgtggtgggcagggggctggtttgggtttatagggagcttttgttgcacccatgcaggggcaatcagatcagcatcttcatgcaaaaaaaaaaaaaaaaaa

SEQ ID NO: 14973 - DNA, 180 bp, Homo sapiens
taaggaagaccagcctgcctctggtcggttcctggcgctctgstttcgtgaccttgtcagtagaaggctatttaattttcacaactgcttgaattttgacatacaagatgaagcaagatgcctcaagaaatgctgcctacactgtggattgtgaagattatgtgcatgtgggtagaattt

SEQ ID NO: 14974 - DNA, 89 bp, Homo sapiens; identical to SEQ ID NO: 14749

SEQ ID NO: 14975 - DNA, 146 bp, Homo sapiens
ctttctttgcaggtttctgtagccggaagatctccgttccgctcccagcgctccagtgtaaattccccttccccctgggaaatgcactaccttgttttggggggtttaggggtgtttttgtttttcagttgttttgtttttttgtt

SEQ ID NO: 14976 - DNA, 178 bp, Homo sapiens
cataaaattccctttaaaaatgtacaattagtggctgggtgtggtggctcatgcctgtagtcccggcgctttgggaggctgaggtaggagaatggcgtgaacctgggaggcggasttgcagtgagccaggatcgcgccactgcactccagcctgggcgacagagcgagactccgtctc

SEQ ID NO: 14977 - DNA, 403 bp, Homo sapiens
ttttctgaagctgttgttctaattttttccatgcggatgttaaataagaaagagactgatctattttgtggtcctgtcaaaacactatgtccttattagatactgggtgtggtgactcgcgcctgtaatccctgcactttgggaggctgaggccactagatcacttgaggtcgggaattcgagaccagcctggccaacatggtgaaatcctgtctctgccgaaaatgcaaagactggctgggtgtgctggtggacgtctgtggtcccggctactcgggaggctggggcggtagaatcgcttgagcccgggaggtaacggttgcggtgagctgagatcgcgccactgcactccagcctgggcgacagagtgagactccatctcaaaaaaaaaaaaaaaaaawtt

SEQ ID NO: 14978 - DNA, 185 bp, Homo sapiens
aattagaatctgtgtgtatactaatgagctgctttttttctgttgacactatcattatttgtcttattacccaagaggcaattacctgaatttggatgtctgaattataacttatgcaggaatagttctgtaaatacatttaaataaactgtaaagatatttaataaatatagtatttatacaaa

SEQ ID NO: 14979 - DNA, 214 bp, Homo sapiens
caagaaaccaaagtttgcaacttaaatctcagttttcaaacagtaaaagtttgtatagatggcactacagaaaataaaaatggttattcctaccagctccagaaatgtgttacacaatatacactagaagacttttttttttaataatagtattttgtccttaggwagtattgttcctttcaaccaaagactccagaattattgaaaaacaaaa

SEQ ID NO: 14980 - DNA, 413 bp, Homo sapiens
cattcgggaggctgaggcaggagaatcgcttcaacccaggggttggaggttgcagtgagctgagattgcgccactgcactccagcctggtgacaaagcaagactctgtcttaaaaaaaaaaaaaataggccaggcacggtggctcatgcctgtaatcccagcastttgggaggccaaggtgggcagatcacgaggtcaggagatcaagaccatcctggctaacacggtgaaaccccatststactaaaaataaaaaaggaattagctgggcgtggtggtgggmacttgtagtcccagctactagggaggstgaggcaggagaatggtgtgaacccgggaggcggasttgcaghgagcagagatcrcgccaytgmactccagcctgggcgacagagcgagactccatcccaaaa

SEQ ID NO: 14981 - DNA, 448 bp, Homo sapiens
catttatgttaagtattaataggtcaaaaccaaaatgacctaaccctcctggacctatttatcctgaaacaccttcttgtattcattaaccatagtactcctccccacctcaagtagacacctctctcaggagcttctgagtcagacgcctctggagcgagccctatgtcargcactccacctggggggcccttccccagcatacctgctggtgtgtaagtgtggactaacccgccgccaccaccctctgttccagcaggctctgcatgaatctttgtgcacttgcacctctttttcacatgggccacagtttcagtacttcagcctcagtggggttcctgatgtttatctagggtgttactcaagcccagtttgagattttggagtctcctgtgatcacatcttgtctcggctgtaggaatcaacagaggagacgtcctctacataa

SEQ ID NO: 14982 - DNA, 380 bp, Homo sapiens
ctagaaaaacaattacaatggctggctgcagtggctcacgcctgtaatcccagtactttgggaaactgaggcgggaggatagcttgagcccaggcattcaagaccagcctgggcaacatggcaagacctgtctctacaaaagtaaaaaatttagctgggtgtggtggcgcacactgtagtcctagcccactccggagctgaggtgggaagatcacttcagcccaggaggttgaagctgtgtgagccataattgagccatggcactccagtccgggtgacagagggagaccctgtctctacaattcaaatagaccaaagtgctgggactacaggcgtgasaccgcgcccggccgaaaaatcgaacttttaaaacacaaaaa

SEQ ID NO: 14983 - DNA, 217 bp, Homo sapiens
catgagattatgtaatcaaaaggtgctgccatttttaatttttaattttttagagacagagtcttgctttgtcacccaggctggtgtgcaatggtacgatcatagcttgttgcaattttcagccctgggttcaaagtgatcctcctgctacagcctcccagtagctaggacaataggtgtgagccatcatgcttggggtaaaaaaaaaaaacaaaac

SEQ ID NO: 14984 - DNA, 305 bp, Homo sapiens
taagaagatgtttggctgggcgtggtggctcacgcctgtaatcccagcactttgggaggccaaggcagctggatcgcttgagctcaggagttcaagaccagcctaggcaacatggcaaaaccccatctctacaaaaaaatacaaaaaattagccagatgtggtggtgcacacctgcagtcctaggtacttgaggggctgaggcaggaggatggctagaaccttggagattgaggctgcagtgagctgagatggtgtcactgccctccagcctgggtctgggtgacagagtgtgactgtgccaaaa

SEQ ID NO: 14985 - DNA, 507 bp, Homo sapiens
cataaaaatttgtgaggcaagagttcatatttccagtttaaagctgaagaaacaaaggcccagagggattaggtatctttcttacggttgcacagcagtgaatggctcagctggaattcagacccagcctttaactccctacttagagcgatttctatacatggagcttctagcctcactaagtagtttgctggccatttcttttaccatatgtgtactttctgctcatcattatttcatttgagtctttcttttctggtgcagtcaacatgaatttctagttagcaacttagatcatagaattgattttaagaaaagattcgtggccaggcacggtggctcacgcctgtaatcccagcactttgggaggccgaggcaggtggatcacttgaggccatgagtttgagaccagcctggccaacatggtgaaaacctatctctacaatacaacaattagccaggcgtagtgttgcatgcctgtaatcccagctactcgggaggcatgag

SEQ ID NO: 14986 - DNA, 470 bp, Homo sapiens
  misc_feature 368,370: n=a, g, c or t
twgtaattaaccttgaacataggtacgtatgtatagaaaaaaagcagtatatataggtcagtattagctgtgggttcaggcatcatccggggtcttggaacacatctcgggcaatgagaggggactacggtacagtgtgaggggatcagctcctcatcttcagcttcctctacttctcatggggatgctccctgtctctgaacattggtctggccacataattctggcagcagctgcccagagagttacctagccagacgtggacagacatggtacttcctggaagctgaggcagcatgaaggggtcaatctttctctgcaaccctcgattttgtgacatgaagctcattagcaactggaaggcgcanbnaccacaagaaataaagacccctagttggtaacgagagaagagaatgatgcaaacccatagacagatgccaaactgtggaaagaagttttaacatctctgg

SEQ ID NO: 14987 - DNA, 484 bp, Homo sapiens
tttttgtgtccaggcaccagagctgccttgaggctgagatgtgggcctaggactggcctggattctctagcaatgctggaatcagaggccagctagcaattctggttacctctatgctaggtgctcacctcccttgacacttccccaggtcctgacccctccttctcacagggtcccactgtgggcaccacactggaccaggaaagcattctggagccatcgtttgtaatcatcctgcttctcagccggttccactgatgtaaaacaagtttacctgtcaatattgctaacaattagtgagacgggggcaagctgacctcagggaagtaattttgtgtaaacactgcccactctgcttctactattattgattactctaaacttcccacagacataggtgggagtccagggtggctgtctacagtgggaggagggccagccagtgcatagtttaattctgcttgaggttttgcctttccatagg

SEQ ID NO: 14988 - DNA, 363 bp, Homo sapiens
atattagctgtattgtattgtgttttatttatttacttttttgttttttgagacagagtttcgctcttgttgcccaggccggagtgcagtggtgcgatcttgactcactgcaacctccgcctcccaggttcaagtaattcctctgcctcagcctctcgagcagctgggattacaggcatgcgccaccatgccccactaattttgtagttttgttagagacagggtttcttcatgttggtcaggccggtcttgaactcccgacctcaggtggtccatccactttggcctcccaaaatgttgggattacaggcattagccaccacgcctggcctatttatttacttattaatggtgttttttttt

SEQ ID NO: 14989 - DNA, 53 bp, Homo sapiens; identical to SEQ ID NO: 12332

SEQ ID NO: 14990 - DNA, 120 bp, Homo sapiens
tttcatatgatctgcagccttttgggtatcaaatgggtcaaaaccatgggacctgccacctcccatcagcaattctggaaatgcactatttctactggtattcttgcttttttttttttt

SEQ ID NO: 14991 - DNA, 433 bp, Homo sapiens
tcaaaatcttaatcgtttttctattttagaaatgcattcggccgtggctcacgcctgtaatcccaacactttgggaggcagaggctggtggatcacctgaggtcaggagttcgagatcaggccaacatggtgaaaccgatctttagtaaaaagtaaaaaaattatctgagcatgatggtgggcgcctgtgatctcagctattcgggaggctgaggcaggagaatcacttgaacctgagaggcggaggttgcagtgggccgagatcgcgccatttcactctagcttggacgacatgagcaacactccgtctcaaaaaaaaaaaccaargtattcggstgggcssagtggstcacacctgtaaycctrgcacattgggaggccaaggcgggtaaattgcctgagctcgggattttgagagcagcctggctaacat

SEQ ID NO: 14992 - DNA, 125 bp, Homo sapiens
catttcagtagtgttaagtacattcggctgggtgcggtggttcacgcctgtaatcccagcactttgggaggccgaggtgggcagatcacaaggtcaggagatctagaccctcctggccaacacag

SEQ ID NO: 14993 - DNA, 113 bp, Homo sapiens
catttcagtagtgttaagtacattcggctgggtgcggtggttcacgcctgtaatcccagcactttgggaggccgaggtgggcagatcacaaggtcaggagatctagaccctcc

SEQ ID NO: 14994 - DNA, 54 bp, Homo sapiens
aaaaaaaaaaaaaaaaaaaaaaaaaaaaaaaaaaaaaaaaaaaaaaaaaaaaaa

SEQ ID NO: 14995 - DNA, 487 bp, Homo sapiens
ttgtwattwamcttgaammwwaggtamskwatgwwwagaaaaaaagcagtatatataggtcagtattagctgtgggttcaggcatcatccggggtcttggaacacatctcgggcaatgagaggggactacggtacagtgtgaggggatcagctcctcatcttcagcttcctctacttctcatggggatgctccctgtctctgaacattggtctggccacataattctggcagcagctgcccagagagttacctagccagacgtggacagacatggtacttcctggaagctgaggcagcatgaaggggtcaatctttctctgcaaccctcgattttgtgacatgaagctcattagcaactggaaggcgcagggaccacaagaaataaagacccctagttggtaacgagagaagagaatgatgcaaacccatagacagatgccaaactgtggaaagaagttttaacatctctggctgcagctgtatctc

SEQ ID NO: 14996 - DNA, 92 bp, Homo sapiens
atcctagcactttgggaggccaaggcaggaggattgcctgagsgccaggagttggatacaagcctgagacattaagcgttaaggatgctttt

SEQ ID NO: 14997 - DNA, 447 bp, Homo sapiens
  misc_feature 420: n=a, g, c or t
tattttctatagaggtgaggtcttgctatgttgcccaagctagtcttgtactcctggcctcaagtgatcctcccatcttggcctcccaaagtgctcagaatacaggcatgagacaccatgcccagccttgatggtattttaaaaataatttgaatagatatttctaacctaactttaaaagttatgatttatttgaggaaaaaaaatatatgtatatatatatttttwagatggagtctcactctgtcacccaggctggaatgcagtagcatgatctcagctcactgcaacctctgtccmttgggttcaagtgattctcctgcctcagcctcccaagtagctgggattacaggtgcctgccaccatacctggctaatttttgtatttttagtagagacagggcttcaccatcttggccangctggtcttgaactcctgracattgtg

SEQ ID NO: 14998 - DNA, 387 bp, Homo sapiens
  misc_feature 167,169,173,226,233: n=a, g, c or t
attttatctctaatcgtcaacacagctgttcttccactgaatttgtgctattgcatacatgtagccatctttcttttcactgcagmagtgtttatsagtagttcaaaatgatttatttgctcctggggagtaaaaccttttttattaaaaaaagaaaaagaaaamananaganagaaagtgtgcccccctcctatgctgcgatastataaaatgattgggtcacanaggtcangtctgcacgtccctgtggtagaccctgctttcacattggagcsttcacactcagcacaaaatgattggaggccttgataaaatggagagcaaagtcttgggagaagtgaaatgggrgttggatcatagagacaggcgstggrgastcgggtact

SEQ ID NO: 14999 - DNA, 166 bp, Homo sapiens
  misc_feature 130,138: n=a, g, c or t
catttcagtagtgttaagtacattcggctgggtgcggtggttcacgcctgtaatcccagcactttgggaggccgaggtgggcagatcacaaggtcaggagatctagaccctcctggtccaacacagtgancaccccgntctctatctacaaaaaaaaaaaaaaaaa

SEQ ID NO: 15000 - DNA, 156 bp, Homo sapiens
gcaaaaattagccgggcatggtgacgtgcacctgtagtcccagctactagataggctgaggcaggagaattgcttgaatccgggaggcggaggttgcagtgagccgagatcgtgccactgaactccaacctgccaatagagcgagactccgtctca

SEQ ID NO: 15001 - DNA, 155 bp, Homo sapiens
gsaaaaattagccgggcatggtgacgtgcacctgtagtcccagctactagataggctgaggcaggagaattgcttgaatccgggagcggaggttgcagtgagccgagatcgtgccactgaactccaacctgcsaatagagcgagactccgtctca

SEQ ID NO: 15002 - DNA, 114 bp, Homo sapiens
cataaaattccctttaaaaatgtacaattagtggctgggtgtggtggctcatgcctgtagtcccggcgctttgggaggctgaggtaggagaatggcgtgaacctgggaggcgga

SEQ ID NO: 15003 - DNA, 169 bp, Homo sapiens
cataaaattccctttaaaaatgtacaattagtggctgggtgtggtggctcatgcctgtagtcccggcgctttgggaggctgaggtaggagaatggcgtgaacctgggaggcggasttgcagtgagccaggatcgcgccactgcactccagcctgggcgacagagcgaga

SEQ ID NO: 15004 - DNA, 67 bp, Homo sapiens
ggccgggagcggtggctcacgcccttaatcccagctctcagggaggctaagaggcgggaggatagct

SEQ ID NO: 15005 - DNA, 245 bp, Homo sapiens
catgtctgcttacaggtgttatttgtctgttaaaactagtctgcagatgtttcttgaatgctttgtcaaattaagaaagttaaagtgcaataatgtttgaagacaataagtggtggtgtatcttgtttctaataagataaacttttttgtctttgctttatcttattagggagttgtatgtcagtgtataaaacatactgtgtggtataacaggcttaataaattcttcaaaaaaaaaaaaaaaa

SEQ ID NO: 15006 - DNA, 217 bp, Homo sapiens; identical to SEQ ID NO: 14714

SEQ ID NO: 15007 - DNA, 67 bp, Homo sapiens; identical to SEQ ID NO: 14939

SEQ ID NO: 15008 - DNA, 419 bp, Homo sapiens
cattatagtcattgtagttctatttttataagactgggctctactttgcaattttaagctaaactgatgcacagttaagcattattagttgaaatatgctgtgatctcaattcctatttaaattgtaaggtcttctaatagatggtgttgttggagttcagatacacatgaatttcattttgctagaaatttgctccttttaatgttggggacttaaaagacacccaaggaaaagaagtcatccaaagatataataatgagaaccggaaaagtattttgttaaatttgtatgtgtcattaagataggacctttatgattttgatgttaaacaaatgtaagataaacagcttacaaaaactgtggccatcttggattgtgctgtgagacttccaagcagagacaaaaagactttcacctg

SEQ ID NO: 15009 - DNA, 192 bp, Homo sapiens
attacaatttaactttggggtttgggtaagacaaacatttaatgtataggattttggccaggtgtggtggctcacgcctgtaatcccagcactttgggaggccaaggtgggcggatcacgaggtcaggagatcgaaaccatcctggctaacatggtgaaaccccatctctactaaaaaatacaaaaaaaaaa

SEQ ID NO: 15010 - DNA, 446 bp, Homo sapiens
tacaatatggagagaagtggtgtattttgaaaacatttggggccgggcgcggtagctcacgcctgtaatcccagcactttaggagactgaggggggcgaatcacgaggtcaggagtttgagaccagcctgaccaacatggtgaaaccctgtctctactaaaaaaaatacaaaaattaaccaggcgtggcacctgtagtcccagcactttggcaggttgaggcaggtggatcatttgaggtcaggagtttgagaccagcctggcccacatggtaaaaccccgtctctactttaaaaaatacaaaaattagctgggcggtagtggtgcatgcctggaatcccagttactccagaggctgaggcaggagaatcacttgagcctgggaggcagaggttgcagtgagcagagatcgtgccactgcactccagtctaaatgacagagtgaga

SEQ ID NO: 15011 - DNA, 365 bp, Homo sapiens
catggctcactgcagcctggatttcccaggctaagtgatcctctaccccagctactcgggaggctgaggcaggagaatcgcttgaacccaggtggcggaggttgcagtgagccaagaacatgccactgcattccagcctggcaacacagtgagacttcatctcaaaaaaacaaaaacaaaaaaactataacaatatgaaatagtgtgacattgtgtcgataagtaatggtatagatggacttctggaaatgattaatgtggaatggagtaggaaatgacttgtgatggaaggaggtcctctcctctgctctagagaagtgagtaggaggcagaagcaggaaggcattcctttgccctgaccacca

SEQ ID NO: 15012 - DNA, 442 bp, Homo sapiens
  misc_feature 57: n=a, g, c or t
caaggttaacaaggttgatggggaatggtccttgctctcaagaagctcgtaggcggnccaggcactgtggcttatgctgtaatcccagcattttgggaagctgaggcaggtggatcacctgaggtcaagagttcaagaccagcctggccaacatggtgaaacccgtctctactgcaaatacaaaaaattagtagccgggcgtggtggctcacgctgtaatcccaacactttggtaggccgaggcgagtggatcacctgaggtcgggagttcgggaccagcctgaccaacacggagaaaccctgtctctactaaaagtacaaaattagccagggatggtggcatgtgcctgtaatcccagctatttgggaggctaaggcacaagaatcgctttgaacctgggagacagaggttgcagtgagctgagatcgcaccattgcactc

SEQ ID NO: 15013 - DNA, 580 bp, Homo sapiens
aaaaaagcattgtgggacggaagcctgtcctttcttccttttggtgcgagcttgctgtggtttttgctctgggtcctctgggatggcgcctggctgtggccgcgtggtctctcacgcaggggcgccgggcgggggaacgcggccaccctgagtctggtgagtcgactgcggcggcctgtgtccgaagtgtccggggccgtgaacaagggcagcggcctggcctcaggctgcgttcccacgtttggaaacggggagcttcgtcgatttgtgtttacatcatcgactatgccagggagttctccagataagcctggttttattttcgtcagtgaaaaggccttaccgtataactgactttatgcttgccctgcccccgtataaaataacttaaaagcagcgtgcctggttacagctgtttccacgtgcggtgctcgtcgggagtgatcacctaccctacaggtggaagatggatgcctgaagtgtagactgctgctagctgaataccatctgggagcataaaggtgaccttgaaggatgtccttggtgaggattttgaaaatttgatcttcacaagagttgc

SEQ ID NO: 15014 - DNA, 481 bp, Homo sapiens
aagaattaagaagtgaaagatctctacaattaaaactaaaacattgaagaaagaaatcaaagagaacacagaaaaacagaaagatattcaatgtttacagattggaagactcaattattgttaaaacatccatgctacccaaagcaatctgcagattcaatgcaatccctatcaaagtaacaataacattcttcatagaaatagaaaaataatcctaaaatttatatagaatcacaaagtcccagaatagccaaagaggatagcccacaaaagacctacaggctgggcgtggtggctcgtgcctgtaatcccagcacttttggaggctgaggtaggcagatcacttgaggtcaggagttcaagaccagcctggccgacatagtgaaaccccgtctctactaaaaatacaaaaattagctgggcatgggggcacacacctgtaatcccagttactcgggaggctgaggcacaagaatagctt

SEQ ID NO: 15015 - DNA, 408 bp, Homo sapiens
ataactatgtgasattasttagggcataattctaaaatttctgtcctaggagacactagataactctcaaaaacttctgattttcttgcatccctttttggcagagtggtcacagtataatgcgggaggccctcctcccccgaatcagcaacaatttttgctccaccgttttstttcgggaaccagatgcgttttcagaagacagtactccagtgataagcggcgactttgagggattccctctctggsggsctctgcagcagcacagccggcctsattcggggcactgcgagtatggatctccaaggaagaggggtccccagcatcgasagacttcgagttctcctgatgttgttcsatacaatggctcaaatcatggcagaacaagaagtggaaaatctctcaggc

SEQ ID NO: 15016 - DNA, 434 bp, Homo sapiens
tcgcagtggcaaagacttggagtcggcccaggtgtccatcaatgatagactggattaagaaagggtggcgcatatacaccatggagtactttgcagccataaaaaaggatgagttaatgtccattgcagggacatggatgaagctggaggccatcgttctcggcaaactatcacaggatcagagaaccatctgcatgttctcactcataggtgggaggtgaacaatgagagcacatggacacgggaagggaaacatcacacaccagaacgtgtcgcgggdgtaggggggtgggggaggaataacattaggagaaatacctaatgcaggtgatgggttgatgggttcagcaaaccaccagggcacgtgtacatctatgtaacaaaactgcacgttctgcacatgtaacccagaactgaaaagtataattaaacaa

SEQ ID NO: 15017 - DNA, 162 bp, Homo sapiens; identical to SEQ ID NO: 14777

SEQ ID NO: 15018 - DNA, 338 bp, Homo sapiens
aaatcagcggtgggggcggagagccgaggagaaggagaaggaggaggactaggaggaggaggacggcgacgaccagaaggggcccaagagagggggcgagcgaccgagcgccgcgacgcgaagtdaggtgcgtgcgggctgcagcgcagaccccggcccggcccctctttctctttcttcctttactttcccttgcttttccctcttttcttactcctcctctttctctccccaacccccattctcatctgcacccttcttttctcatgtgtttgcataaacattcttttaacttctttctatttgacttgtggttgaattaaaattgtcccatttgc

SEQ ID NO: 15019 - DNA, 167 bp, Homo sapiens
ctgttttaattaggttctccctatctctactccctccatattgtttgaaagatggaagtaatttgctaaaggcttttttttttttttwaacagtcttgctttgttgggccaggctgaagtgcagtggcacgatctcgactcactgcaacctccgtctcckgggttca

SEQ ID NO: 15020 - DNA, 500 bp, Homo sapiens
atacaatacctaggaatccaacttacaagggatatgaaggacgttttcaaggagaactacaaaccactgtgcagtgaaatgaaagaggacacaaacaaattgaagaacgttccatgctcttggatacgaagaaccaatattgtgaaaatggccatatggccaaggtaatttctagattcaattccatccccatcatgctaccaatgactttcttcacagaataggataaaactactttaaagttcatatggaaccaaaaaagagcccgcattgccaagataatcctaagccaaaagaacaaagctggaggcatcaagctacctgacttcaaactatactacaaggctacagtaaccaaaacagcgtggtactggtaccaaaacagagatatagaccaatggaacagaatagagccctcagaaataataccacacatctacaaccatctggtctttgacaaacctgacaaaadcaagaaatggggaaaggattccctattt

SEQ ID NO: 15021 - DNA, 195 bp, Homo sapiens
catgagattatgtaatcaaaaggtgctgccatttttaatttttaattttttagagacagagtcttgctttgtcacccaggctggtgtgcaatggtacgatcatagcttgttgcaatkttcagccctgggttcaaagtgatcctcctgctacagcctcccagtagctaggacaataggtgtgagccatcatgcttg

SEQ ID NO: 15022 - DNA, 419 bp, Homo sapiens
  misc_feature 171: n=a, g, c or t
tacataaaaaagacatttcagattaacactaatgttacacctcaaggaactggaaaaacaagaacaaacaaaacccaaagctagcagaaaagagatcagaactgaatgaaattgagaccaaacatgcacgcgtgtgcgcgcgcacacacacacacacacacacacacgatnaatgaaatgaaaagttgattcttggcaaagacaaacaaaattggtaggcaaacaaaagaagagagaggattcaaataagaacaatcagaaactataaagatctgattttatctttaaaatcaggtaaatttaaacttaggggtgcagtggctcaagcatgtaatcccagcactttgggaggctgaggcaggcggatcgcttgaacccaggagtttgagaccagcctgggcaacatagcaaaacaccat

SEQ ID NO: 15023 - DNA, 444 bp, Homo sapiens
ctttcttccttttggtgcgagcttgctgtggtttttgctctgggtcctctgggatggcgcctggctgtggccgcgtggtctctcacgcaggggcgccgggcgggggaacgcggccaccctgagtctggtgagtcgactgcggcggcctgtgtccgaagtgtccggggccgtgaacaagggcagcggcctggcctcaggctgcgttcccacgtttggaaacggggagcttcgtcgatttgtgtttacatcatcgactatgccagggagttctccagataagcctggttttattttcgtcagtgaaaaggccttaccgtataactgactttatgcttgccctgcccccgtataaaataacttaaaagcagcgtgcctggttacagctgtttccacgdcggtgctcgtcgggagtgatcacctaccctacaggtggaagattggatg

SEQ ID NO: 15024 - DNA, 81 bp, Homo sapiens
gccggccgcagawattgcagccgctcagcttctaccccctcctgcctttmcttcctctttccttacttccttcccttccct

SEQ ID NO: 15025 - DNA, 66 bp, Homo sapiens
aagaatttgcggtgcaggggccgcggccaccgccttctgtccgcagtgctgcgagccgtaaccacc

SEQ ID NO: 15026 - DNA, 422 bp, Homo sapiens
cgaaattataaatctgctaaatatgtattaagggtattaattattgaaagtccctttccccaaaactcaactcctatggcaattatgaactccattttaccaagaacatttaagtgcctcagcatctgtatgatatagtggagcaggtgctgacataggtaccagctgacatgatgtgtcactagctctgtgggatgattgccacatacatggaacacctgggagtgctggaaatgtactgggatcgaagtgacaaagtgtgttttcattcacagtggaggctacatcaagcaaggggaggtccagccctcttgcaagtgtggtgagaggctctactagcaaagacatgggcaccggagtaggtcccgtgtagcatgcgggtgctgtagagaaaattcagtgacgtacatggctctggttct

SEQ ID NO: 15027 - DNA, 93 bp, Homo sapiens
ggccgggagcggtggctcacgcccttaatcccagctctcagggaggctaagaggcgggaggatagcttgagcccaggagttcgagacctgcct

SEQ ID NO: 15028 - DNA, 91 bp, Homo sapiens; identical to SEQ ID NO: 14931

SEQ ID NO: 15029 - DNA, 216 bp, Homo sapiens; identical to SEQ ID NO: 14713

SEQ ID NO: 15030 - DNA, 381 bp, Homo sapiens
aacatctataaaatttcctcatacagtcattaaaagcttaaatgaaacaatgtatataaaatgttamacatgtatatatacatatagatacacacctgctaagtatccctcacagatttgtgagaaagaataattaactgtcattaaataacccctgctacaaatctggattataaattgacttctgtagacaccctgaaggatgatgtccatttcttggtagtctctcttgtgccttcacttggagaccctcctgaaggacttagtgcacattttctttttagtctaaattttaagtcagaccaccccaaatatgtcccaaaagttctaagaaactttttaagctatggtaatacaatggtaggcttgattttatttatt

SEQ ID NO: 15031 - DNA, 82 bp, Homo sapiens
cttccctgttatctttgtgacccactgatagcagctggtggtcctggtgcggtgagattttgactctttttttttttttttt

SEQ ID NO: 15032 - DNA, 432 bp, Homo sapiens
gtcacaagggagatgtccgcccccagtcgtagcctcggacggtttctgagcgttggtgtttggcacgcgccaccctctcttgctttggttccgccatgccgatgtaccaggtaaaaccttatcacgggcgcggcgccttctccgtgtggagcttcccacctgcatgtaccggctctctaacgtgcaaggcaggagcggcggcccagcgcccggcgttggccacctacagtctttggtagatgagtggctggatagctacaagcaagaccaggatgcaggatttctggagcttgttaactttttcatctgatcttgtggatgtaaaggactcgggggactatcctctgacagctccaggtctatcctggaagaagtyccagggcagcttctgtgagtttgtggggacattggtctgtcggwgccagtacatcc

SEQ ID NO: 15033 - DNA, 302 bp, Homo sapiens
gggcaaatcacaaggtcaagagttttttagatggggtgagcacagaccaattcctgttttatttactgatttaaaattttgagacagtctcactgtcacccaggttggggtgcagtggtaggatcatagcttgctgcagccttgatctcccaggatcttgcctcagcctcccgagtagctgggactgcatgcttgtgccaccacactcggttaatattttgtagagatggggtcttgctatgttgcccaggctggcttcaaactcctgaacttwaaagcctcctgtttagttttggtttttt

SEQ ID NO: 15034 - DNA, 422 bp, Homo sapiens
tcgcagtggcaaagacttggagtcggcccaggtgtccatcaatgatagactggattaagaaagggtggcgcatatacaccatggagtactttgcagccataaaaaaggatgagttaatgtccattgcagggacatggatgaagctggaggccatcgttctcggcaaactatcacaggatcagagaaccatctgcatgttctcactcataggtgggaggtgaacaatgagagcacatggacacgggaagggaaacatcacacaccagaacgtgtcgcgggggtaggggggtgggggaggaataacattaggagaaatacctaatgcaggtgatgggttgatgggttcagcaaaccaccagggcacgtgtacatctatgtaacaaaactgcacgttctgcacatgtaacccagaactgaaagta

SEQ ID NO: 15035 - DNA, 492 bp, Homo sapiens
aaacaagggaaggaagccttcagctgaggcaggtaagcgccgatcggagggtttgaccgagtggcttagttaaatctctgttttcaccgttttgtaattgagaaaggcatccgcagcagaagccgatttttcagtcggcttccttttgtttaacatagaaagtacctgtattaattttgatgaattagagcatgcagcaaattcaattgaaaatagatttgtatagtaaatgcatttatactgaatgatttctcctccgttttatttaaggagagagatgagaaagatgattttgatcagaatagcactttgcattacgttaaattctaaacggctaacggaaagaaaaataatccaattgatactgcttttgaactccgggacttaaaccctaggagacagctgccatttgaaatkktttcttctaactgaacttctgatgtgttataataatttttcactggaggttttagcaaggggtagagtttattt

SEQ ID NO: 15036 - DNA, 284 bp, Homo sapiens
  misc_feature 282..283: n=a, g, c or t
cacaaaaagatgccaggcactgtgggaggctgaggtaggcagatcacctgaggtcaggagtttgagaccagcctggccaacatggtgaaaccggtctctgctaaaaatacaaaaattagccgggggtggtggcgcatacctgtaatcccagctactcaggaggttgcggtagggaaattgcttgaacccgggagacagaggttgcagtgagctgtgactgcaacactgcattccagcctgggcaacagagtgagactcctcctcaaaaaaaaaaaaaaaaannc

SEQ ID NO: 15037 - DNA, 154 bp, Homo sapiens
gcaaaaattagccgggcatggtgacgtgcacctgtagtcccagctactagataggctgaggcaggagaattgcttgaatccgggaggcggaggttgcagtgagccgagatcgtgccactgaactccaacctgccaatagagcgagactccgtct

SEQ ID NO: 15038 - DNA, 454 bp, Homo sapiens
ctgaaatgatacctaatttaatccagttttatgtagagacacttgatatatgtagtgttctcttttgttttgaacattataaaaaagaaacaccctagtcttgtcttttctgattagtgtcaaggaatgaagtattttttccattgctaactgttctggcagttattgsacaataagtcatgtgcctatatgtgtaatgtatattgagtaatctttatttttaactggggcttttagatatgttatagttattaaaaaatatctaataggatttgccaaaataatataggataaatcttatggacattatgtattttttaaatggaagtataaaaatttgtctacacttttgcacattgttgatacctgaaagttaatccaagggaaagtttattactgctgagaattaggaaaagaagatatttgggaagactgtagaaatatgaacctagaa

SEQ ID NO: 15039 - DNA, 338 bp, Homo sapiens
ctcggaaaccatgggttattgcagtggcaggtgcacgcttatctttatctgtggcatgcaactgagatggtgaatacttttttaaaaagaaagaggataagcagaaaaggaagaaaatgacctacatattaatgaagtctgtacattcatcaggaagaattttcatgtcccaaataaagtctgtgattgattggtcatctttaaatcctaaaacatccgaagaactggaagatcctgaagagttatttagttctaaatataaagtgctttaaagacaaattgagaaagacataggcttttaacaaaagggaaaataaacacttttgaaaatgaaaaaa

SEQ ID NO: 15040 - DNA, 431 bp, Homo sapiens
tatgtcacgatttgataggaatgtcaaatgtgataatgctgtgctttcataaattcacctaaatctcaaaymtactgcttttttctgtttttaatatgttaaacaaaaagttccaataagcctgggcaacatacagagacctcatctctactaaaaaaataaaaaaaatggccgggmacagtggctcacacctgtaatcccagcagtttgggaggctgaggtgggtggatcacctgagttcaggagtttgagaccagcctggccaacatggtgaaaccctgtctctactaaaaatacaaaaattagccaggtgtggtggcaggcacctgtagtcccagctactcgggaggctgaggcagggagaattgcttgaacccgggaggcagaggtggcagtgagctgagatgtgccattgcactccagcctgggca

SEQ ID NO: 15041 - DNA, 90 bp, Homo sapiens
catttcagtagtgttaagtacattcggctgggtgcggtggttcacgcctgtaatcccagcactttgggaggccgaggtgggcagatcaca

SEQ ID NO: 15042 - DNA, 503 bp, Homo sapiens
ttttatttttttgatgatagcagctatggataatcattgcctagacccattaattccttggaagttacaaatggtgatattgtaattgtgccatttcttttaaaacaaaacctttttattttattttattttatttttttttagagacagggtcttgctgtcacccatgctagagcacagtggtgcaatcatagcttactgtagcctcaatattttgggctcaagagatctttccacctcagccttctgagtagctgaaactacaggatcttggagtcccacagacctggatttgatttcttgctctgctacttaacagtttcgtatccctggtgagttgtggaatcccctggcccttggattcctcctctgtataatggggcaacacgtgcttgtctatctccagatgtgttgcaaggataataaatgaaatatgagagtgctttgaaaactataaactgcaaggtaaatagtgcagcaagttgttatggattggactggat

SEQ ID NO: 15043 - DNA, 301 bp, Homo sapiens
taagaagatgtttggctgggcgtggtggctcacgctgtaatcccagcactttgggaggccaaggcagctggatcgcttgagctcaggagttcaagaccagcctaggcaacatggcaaaaccccatctctacaaaaaaatacaaaaaattagccagatgtggtggtgcacacctgcagtmstaggtacttgaggggctgaggcaggaggatggctagaaccttggagattgaggctgcagtgagctgagatggtgtcactgccctccagcctgggtctgggtgacagagtgtgactgtgcca

SEQ ID NO: 15044 - DNA, 248 bp, Homo sapiens
ttttttgtttgtctgttttgagacagggccttactgtgtcgcttaggctggatggggtgcagtggtgcagtcacagctcacacagctctgtctcctggacttaagcagtcctcctgccttagcctcccaagtagctgggactacaggtgcatgccaccacacccagtgagtttttctttttaaaaaaaaattttatttgtttattttttgagacggagtctcgctctgtctcaaaaaaaaaaaaaaaa

SEQ ID NO: 15045 - DNA, 329 bp, Homo sapiens
  misc_feature 298: n=a, g, c or t
atacaatacctaggaatccaacttacaagggatatgaaggacgttttcaaggagaactacaaassactgtgcagtgaaatgaaagaggacacaaacaaattgaagaacgttccatgctcttggatacgaagaaccaatattgtgaaaatggccatatggccaaggtaatttctagattcaattccatccccatcatgctaccaatgactttsttcacagaataggataaaactactttaaagttcatatggaaccaaaaaagagcccgcattrccaagataatcctaagccaaaagancaaagctggaggcatcaagctacctgacttc

SEQ ID NO: 15046 - DNA, 174 bp, Homo sapiens
cgcctctagaaaaacaggcggcgtmrggtgggcagcacgttgccatgatgtgccgtggsccggccgtggctggcgtgatcccaccagagtgagctggagcagatctgcaccatgggccaagtttctcagaaaatacatggsttcmtgagggctgcagctaatgcccacgttcct

SEQ ID NO: 15047 - DNA, 164 bp, Homo sapiens
ctttgggagggcgaggcaggtggatcacgaggtcgggagttcgagaccggcctggccagcatggtgaatgccctgtctctactaaaaacacaaaaaaattagccgggcgtggtggtgggcacctgtgaatctataattacttcaaaataaaaagttgaaaacaa

SEQ ID NO: 15048 - DNA, 431 bp, Homo sapiens
ggcgatggcggcasggcaggtggaggggctggcgcggccgctccctctcgccttccgaggctgcctggctggcgcgctgctcggggactgcgtgggctccttctacgaggcccacgacaccgtcgacctgwsgtsagtcctgcgtcatgtccagagtctggagccggaccccggcamrcccgggagtgagcggacagaagccttgtactacacagatgacacagccatggccagggccctggtgsagtccctgctagccaaggaggcctttgacgaggtggacatggctcacagatttgctcaggagtacaagaaagaccctgacaggggctatggtgctggagtagtcactgtcttcaagaagctcctggaccccaaatgtcgcgatgtctttgagcctgcccgggcccagtttaacgggaaaggctcct

SEQ ID NO: 15049 - DNA, 84 bp, Homo sapiens; identical to SEQ ID NO: 14926

SEQ ID NO: 15050 - DNA, 465 bp, Homo sapiens
  misc_feature 153: n=a, g, c or t
atagaaacgagcagaaggaggtgggtggctggagaaggaggcgggtcgggatcggggagtggggaggaggcagcggtggagggagctggctcctgcagttctggcgctgctgccttcctgagtgagcggtggagggaaccctagaggacagancccccagcccggcagcaggccccctctccgcccgccaccacggaggagaaggaggacagccagcccctccagccctggcctggcccagcgggggcagtaagctcctacttgcccccagcttggtgcccacacgggcccagtgcatgagcagccgagcctgctaaccgcagctccgcacttgtccatccccctgcggctacaccatgtccagctcctacgatgaggcctcactggcgccagaggagaccaccgacagcttctgggaggcaggtacagcacagcctttctcagctgttcctatttccctcgctc

SEQ ID NO: 15051 - DNA, 284 bp, Homo sapiens
gttattcaggctgggcgtggtggctcatgcctgtaatcccagcactttgagaggctgaggcaggcggatcatttgaggtcaggagtttgagaccagcctggccaacatgattaaaccctgtctccactaaaaatagaaatattagctgggcatggtggcatgtgccgtgatcccagctcctccagaggctgaggcaggaaaattgcttgaacccaggaagcggaagttgcagtgagctgagatctcgccactgtgctccagcctgggcgacagggagactccct

SEQ ID NO: 15052 - DNA, 474 bp, Homo sapiens
  misc_feature 403..404,465: n=a, g, c or t
aagaattaagaagtgaaagatctctacaattaaaactaaaacattgaagaaagaaatcaaagagaacacagaaaaacagaaagatattcaatgtttacagattggaagactcaattattgttaaaacatccatgctacccaaagcaatctgcagattcaatgcaatccctatcaaagtaacaataacattcttcatagaaatagaaaaataatcctaaaatttatatagaatcacaaagtcccagaatagccaaagaggatagcccacaaaagacctacaggctgggcgtggtggctcgtgcctgtaatcccagcacttttggaggctgaggtaggcagatcacttgaggtcaggagttcaagaccagcctggccgacatagtgaaaccccgtctctactaannatdcaaaaattagctgggcatgggggcacacacctgtaatcccagttactcgggaggctgnggcacaaga

SEQ ID NO: 15053 - DNA, 548 bp, Homo sapiens
tttattttaatatgttccatagagtggataggcagacaggtactattgtaatgtattctgtatttaataatttaatatactctagaaagtagacctcatgcattcttttagcatgattttcttttaaactgcttttcattttaagggcacccgtggcggaagctggttttgcaaggactgtgtaagctgtatgcgttctagctgtatgcgttctgtagtcttttcttaggtgggtaacattttcaataacgcgcgcacagcacacaggggtgccctgagccgaagagcaaaaaaagccaccgctcgtttctataatccagctttgcttttcacaggcgtgggatccaggatggtgtcctctgtgaggacttgaactctggggctttaattccactgtttaattttcaggtaccacagcagcaaagcacagagtgtgacctttttcatgtctgagctgattctgtttgctccacgtgcctgcttcttgctactgttcatttagtatgggatcacctcaccatgccatgctctgggctctccctctctgt

SEQ ID NO: 15054 - DNA, 349 bp, Homo sapiens
attgaataatgttgtttccctgsttcactatctcttcccatatctgtgatagctcttccacttcaagaatgaaatcaaggccaggtgcagtagctcatgcctgtaatcccagyactttkggakgstgaggtggatggatcamstgaggtcaggagttcaagascagctaggcsaacatggcaaaaccccatctctastaaaaatgcaaaaattatctgggsgttgtggtgggtgcmtgtaatcmsagctastcgggaggstgaggcaggagaatcacttgastcagggaggcagaggttgcagtgagccgagatcatgccattgcactccagcctgggcgacaagagtg

SEQ ID NO: 15055 - DNA, 310 bp, Homo sapiens
taagaagatgtttggstgggcgtggtggctcacgctgttaatcccagcactttgggaggccaaggcagctggatcgcttgagctcaggagttcaagaccagcctaggcaacatggcaaaaccccatctctacaaaaaaatacaaaaaattagccagatgtggtggtgcacacctgcagtcctaggtacttgaggggctgaggcaggaggatggctagaaccttggagattgaggctgcagtgagctgagatggtgtcactgccctccagcctgggtctgggtgacagagtgtgactgtgccaaaaaaaaa

SEQ ID NO: 15056 - DNA, 113 bp, Homo sapiens
gcaaaaattagccgggcatggtgacgtgcacctgtagtcccagctactagataggctgaggcaggagaattgcttgaatccgggaggcggaggttgcagtgagccgagatcgt

SEQ ID NO: 15057 - DNA, 74 bp, Homo sapiens; identical to SEQ ID NO: 14705

SEQ ID NO: 15058 - DNA, 464 bp, Homo sapiens
caaggttaacaaggttgatggggaatggtscttgctctsaagaagctcgtaggcggccaggsactgtggcttatgmmtgtaatsccagcattttgggaagctgaggcaggtggatcacctgaggtsaagagttcaagaccagcctggcsaacatggtgaaacccgtctctactgcaaatacaaaaaattagtagccgggcgtggtggctcacgctgtaatcccaacactttggtaggccgaggcgagtggatcacctgaggtcgggagttcgggaccagcctgaccaacacggagaaaccctgtctctactaaaagtacaaaatymgccagggatggtggcatgtgcctgtaatcccagctatttgggaggctacggcacaagartcgctttgaacctgggagacagaggttgcagtgagctgagatcgcaccattgcactcccgcctgggcaacaagagcgaa

SEQ ID NO: 15059 - DNA, 468 bp, Homo sapiens
atcagcgctctgtgtctagctaaaggattgtcaatgcaccaatcagcactctgtaaaaacgcaccaatcagtgctctgtgtctagctaaaggattgtaaacacaccaaccagcactctgtgaaagggaccaatcagctctctgtaaaatggaccaatcagcaggatgtgggcggggccaaataagggaatataagctggccaactgagccagcagcggcaaccctgttgggtccccttcaatgccgtggacggtttgttcttttgctcttcacaataaatcttactgctgctcactctttgggtcctcactacctttatgaggtgtaacactcaccacaagggtctatagcttcattcctgaagtcagcaagaccacgaacccatcagaaggaagaaactctggacacgtatgaacatctgaaggaacaaactccagacataccatctttaagaactgtacaccatga

SEQ ID NO: 15060 - DNA, 91 bp, Homo sapiens; identical to SEQ ID NO: 14931

SEQ ID NO: 15061 - DNA, 162 bp, Homo sapiens
  misc_feature 135: n=a, g, c or t
catttcagtagtgttaagtacattcggctgggtgcggtggttcacgcctgtaatcccagcactttgggaggccgaggtgggcagatcacaaggtcaggagatctagaccctcctggccaacacagtgacaccccngtctctactacaaaaaaaaaaaaaaaa

SEQ ID NO: 15062 - DNA, 399 bp, Homo sapiens
agttcctagcgaggwggcgccgcsgccattgccctctctcggtgagcgcascccgctctccgggccgggccttcgcgggccaccggcgccatgggccagtgcggmatcacctcctccaagaccgtgctggtctttctcaacctcatcttmtggggggcagctggcattttatgctatrrwgggagcctatgtsttsatcacttatgatgactatgaccacttctttgaagatgtgtacacgctcatccctgctgtagtgatcatagctgtaggagcsctgcttttcatcattgggctaattggctgctgtgccacaatccgggaaagtcgctgtggacttgccacgtttgtcatcawmmtgstcttggtttttgtcacagaagtttgttgtagtggttt

SEQ ID NO: 15063 - DNA, 126 bp, Homo sapiens
aagataaaatttgaaatctgttaggctggtgttagggttctttgtttttgaggtttggcagagatgtgtttaagtgctgtgscagaagcggggggaggggggggtttggtggaaattttttgttac

SEQ ID NO: 15064 - DNA, 72 bp, Homo sapiens
aaaaaaaaaaaaaaaaaaaaaaaaaaaaaaaaaaaaaaaaaaaaaaaaaaaaaaaaaaraaaaaaaaaaaaa

SEQ ID NO: 15065 - DNA, 477 bp, Homo sapiens
ctacttgatatagcaaagtcctttggcttcgtaaataaccctgaggttttgtacttactttccccataggaagacagaccataggcaaactctgttttgggatctcaactccatcacctttgtttcaatattttttttctctcttgaacaaaactgagataatttagaaaacaggtgcttaattgcaataaaattactatgaagtatattaaaaatcacgacattgtaaaatctcactttagatcatcaaagaaaaccattgttactatctcctttgagcttaggaaaatgtacaagagaacaaattaaaattgaaaaattgatttcacttagaaaaacttctaggaacagggtgaaccactgattttaatttgcctaattatcttatgacaagtatcaaattaagatgacacttaaagatccttagcattaacttagtgatggagaagagtgctcacagacagttcccagtaaggt

SEQ ID NO: 15066 - DNA, 70 bp, Homo sapiens
ataggtgttcttcaagatgactaatgtcaaaaattgagacatctgttgcggttctttttttttttttttt

SEQ ID NO: 15067 - DNA, 445 bp, Homo sapiens
ttattgggtttttggaaatttaaggctaggcttgttgcttttccagccacagagcatggtaaagtaaatgaaacccgacagatttcattgttcggatgctgatcacagcttggcacacatggaattcaatgtgtctcttacatgcatattgagcccgtgtttaaaatagtataagtgagtaagaaaaatttaagtacaggcaactaaagaatgatttgcaactacaaatgaaagtagcttggatctttgaaggctaagtccatggttggttaggcagggtgagattgcataaatgaatcagcaggcagactttgccctaaagctgagtagaaaatgaagtatggaaatgatgcataggctttggggaagcctgggaagtgtaggattgattttgatttgtgtctttgtccagctctagagttgattggattcttgctgggggagg

SEQ ID NO: 15068 - DNA, 281 bp, Homo sapiens; identical to SEQ ID NO: 14775

SEQ ID NO: 15069 - DNA, 436 bp, Homo sapiens
  misc_feature 102: n=a, g, c or t
actatgtgcttccggtctccaataccgcagagggcggtcttccccggctcgccaactcggctgctctgggggattcgtgcgcggtaagaagctgcgcggtangtgagaaatcatttctcaagaagttcagttgctgcaggtgggcaaaagggaaaatcctactatacaattacatttactgtcaattttccacataaagatgatgtttgctactttgcttatcactatccatatacgtattcaactttacagatgcatcttcaaaaattggaatcagcacacaatcctcagcaaatctattttcggaaagatgtgttatgtgaaaccctgtctggaaacagctgccccttggtgactataacagcaatgccagagtctaattattatgaacatatcttccatttcagaaatcgcccttacgttttcttgtctgctc

SEQ ID NO: 15070 - DNA, 491 bp, Homo sapiens
ccttaatgtattgctctttaacatttaataaaactattttaaatttttagaatataatccttaacataattatcatgtagaaatcacttagttcaattgtgagttttttaatgtgggaattggtttagtctcattttctattttacagtttctagtgttgaccggtagaggcttagtcacagaatatctattaaattttgctagttgtatggtgtaaaagtgctgaaggatacttgcatgtttggcctgtatgtcaatattgtatttctccctgaggatctcttacttcagttcccacgccaatctttaaatgtaaatgtcattgcctatggttgctgtggactcagtgctaccagaaatatttttaagagtattatttaatagattttatatttcctttcatatggctagtctttcacacagctgtcagcactgttaaggcatttgtatgtcaaaatatatgctaaatatcacgtatatctttttaggaa

SEQ ID NO: 15071 - DNA, 478 bp, Homo sapiens
  misc_feature 250: n=a, g, c or t
caggaaaccagaaattgtcaggatcgaggattatgggaaaagagtaaaagcctagctgtcagatctgaggttccaccaaggagcactgatgggtgcttctcattaggaaggcggtgcggtggctcacacctgtaatcccagtactttgggacgccgaggtgagtggatcacctgaggccaggagttcgagaccagcctggccaacatggtgaaacgtcatctctattagaaatacaaacattagctgggngtggtgatgggtgcttgtaattccagctattcaggaaaccaaggcaggagaataacttgaatccacgaggcagagtttgcagtgagccgagattgctccactgcactccagcctgggcaacagagcaaaaactgcatctcaaaaaaataaaaacaaaaaaacagaggggataccagttcccagcactccaggcctaacttcatagcactcacatcatgtcaagtgagt

SEQ ID NO: 15072 - DNA, 425 bp, Homo sapiens
tcatgtaatctgagactcttgaactttatgacggakyttcaatattttgatgtatatgaaacttttgttaaatatgttgtatacttcgctggctgtgtgaagtaaactaaaactctgatgaacactttggagtctgctttaaggaaggagaccaaagtgggaagggctttagggcactgatagaggccctgggtgtacttttcaatcctgtgtaatgtttaattcttgcaactgaatcaaaacagtgttaaattatggcaatatttgcactttgggaatgagtacataactgtatgatcacactctgcaaatgccacttttaaagctgttaatagactttgcaccttttctttgacaaggatgtgtcatatttaaatttttacattcatcatggctacaggtagaactggggaggggggaatgta

SEQ ID NO: 15073 - DNA, 75 bp, Homo sapiens
  misc_feature 70: n=a, g, c or t
aaaaaaaaaaaaaaaaaaaaaaaaaaaaaaaaaaaaaaaaaaaaaaaaaaamaaaaaaaaaaaaaaaaanttttt

SEQ ID NO: 15074 - DNA, 406 bp, Homo sapiens
tacaatatggagagaagtggtgtattttgaaaacatttggggccgggcgcggtastcacgcctgtaatcccagcactttaggagactgaggggggcgaatcacgaggtcaggagtttgagaccagcctgaccaacatggtgaaacctgtctctactaaaaaaaatacaaaaattaaccaggcgtggcacctgtagtcccagcactttggcaggttgaggcaggtggatcatttgaggtcaggagtttgagaccagcctggcccacatggtaaaaccccgtctctactttaaaaaatacaaaaattagctgggcggtagtggtgcatgcctggaatcccagttactccagaggctgaggcaggagaatcacttgagcctgggaggcagaggttgacagtgagcagag

SEQ ID NO: 15075 - DNA, 177 bp, Homo sapiens
cataaaattccctttaaaaatgtacaattagtggctgggtgtggtggctcatgcctgtagtcccggcgctttgggaggctgaggtaggagaatggcgtgaacctgggaggcggasttgcagtgagccaggatcgcgccactgcactccagcctgggcgacagagcgagactccgtct

SEQ ID NO: 15076 - DNA, 418 bp, Homo sapiens
atcagcgctctgtgtctagctaaaggattgtcaatgcaccaatcagcactctgtaaaaacgcaccaatcagtgctctgtgtctagctaaaggattgtaaacacaccaaccagcactctgtgaaagggaccaatcagctctctgtaaaatggaccaatcagcaggatgtgggcggggccaaataagggaatataagctggccaactgagccagcagcggcaaccctgttgggtccccttcaatgccgtggacggtttgttcttttgctcttcacaataaatcttactgctgctcactctttgggtcctcactacctttatgaggtgtaacactcaccacaagggtctatagcttcattcctgaagtcagcaagaccacgaacccatcagaaggaagaaactctggacacgtatgaacat

SEQ ID NO: 15077 - DNA, 349 bp, Homo sapiens
cttttgggttgggggcgactttgtggggagcctagctgctgctgggcgtttaccgcgggagcccttagcggtctggagctttcagcttatgtggagaagtcgctgtgaagccacctataaatccatttactgaatttatggagaaggctgtaaatgatggaagtcattcagaagaactcttttgccatcttaaaactatatcagagaaagaagatttaccacggtgcaccagtgaaagtcatctcagctggtattctcatcagtatcaggggaaatctaaatttccgattctaggatttcctgttttgtctataatataaattatttgaatcaaaaaaaaaaaaaaaaa

SEQ ID NO: 15078 - DNA, 75 bp, Homo sapiens
tgcttagccctaaacctcaacagttaaatcaacaaaaaaaaaaaaaaaaaaaaaaaaaaaaaaaaaaaaaaaaaa

SEQ ID NO: 15079 - DNA, 177 bp, Homo sapiens
tgcctgccctcccttggttccagtctctcttctctctctctgccttggaacctgaccatactttagttgtgcccttcccaggcatcatcctcctaccaccaacctggggcctcatcttggaagtgggggctccttggggccagcccatgtgtggctcaccacactcttctttttttt

SEQ ID NO: 15080 - DNA, 484 bp, Homo sapiens
cacaatttacgtacttacataattccaagatcagtattatttttctcaggtgatgcactggaatctcagcaggagggggtagttagagaagttaatgatgcaatttatgacaaaattatttatgataattggatggctgcaattgaggaagttaaagcttgttgcaaaaaccttgaggcattagtagaagacattgatcgttagagcagagtatacatggccctgaaattaactgccctagatatagttactcaaggtataagaagccttgtgttctgtatttttcttgtagtgttagttaaaacatatgtttcaaaaatataagaaaagttcaaaaactaattaatttgaccttgagttttagtagtagaatgttttcaagaaatgtacactgtggtaaatgatttaaaacactagtatagtgttgtgtagcttaatccttctgaagtctttttgtcatgtagctattaatctgtggctatga

SEQ ID NO: 15081 - DNA, 409 bp, Homo sapiens
  misc_feature 241,256: n=a, g, c or t
attctcccgcctcagcctccctcagcgtccggagtagctaggactacaggcgcccgctaccacgcccggctaatttttttgtagttttagtagagacggggtttcaccgtgttggccaggatggtctccatctcctgacctcgtgatccgcccgcctcggcctcccaaagcgttgggattamaggagtgagccaccgcgcccggycggtcacagtgtccatgtaactaactcctggttaanaggatatggatakwnggcacatgttcaacttctggcttctgtccttgawaagtgtgatgattccatcctttgctgtcttccttcccgctgactggaatgtggacttggtagtgagctaccttggactatgtggatgaagacaaagataaaaggaaccaaggagttagt

SEQ ID NO: 15082 - DNA, 189 bp, Homo sapiens
cataaaattccctttaaaaatgtacaattagtggctgggtgtggtggctcatgcctgtagtcccggcgctttgggaggctgaggtaggagaatggcgtgaacctgggaggcggasttgacagtgagccaggatcgcgccactgcactccagcctgggcgacagagcgagactccgtctcaaaaaaaaaa

SEQ ID NO: 15083 - DNA, 321 bp, Homo sapiens
taaaagagctctggamatcsgagaaaaggttttggggaaggatcaccccgatgttgccaagcagttaaataacttggccttactgtgccagaaccagggcaagtatgaagaagtagaatattattatmaaagagccctcgagatctaccagacaaaactgggacctgatgaccccaacrtggctaagacgaaaaataacctggcatcctgctatttgaacaaggaaagttcaggcaagcagmamcactgtacaaagagmttctcactcgtgcacatgaaagggagtttggttctgtagatgatgaaaatamscccatctgg

SEQ ID NO: 15084 - DNA, 77 bp, Homo sapiens
ctttgatacgggagttcctccttgctctcgcssctactctttctggtgttagatcgagctaccctctaaaagcagtt

SEQ ID NO: 15085 - DNA, 436 bp, Homo sapiens
taaaatcatctagggggcttgattaaattacacgtcatacctctaccctsagtaattttggttcagctggttcgagatggggatgctgtctgcagtcttcaacaagcatcttgaagtttctgttttgaatgaccagtccacactggtcattttgagaagtgtacctttaaggatattcacaagaaatggtggtatatattaaggtagttccaaaagagaaattccaaaaatgttctggtcaacagggatataagtggcatgtattgtgcctccttggggtgactattctcttgtagatgatgcttatttagaataaaatgttcagttttatttttaaaaagaatcagccggccaggcacggtggctcatgcctgtaatcctagcactttgggaggctgagttgggcagattgcctgagctcaggagttcgagacca

SEQ ID NO: 15086 - DNA, 255 bp, Homo sapiens
atgtttgtttgtttttgagacagagtctctctctgtcaccaggctggagtgcagtggcacaatctcggctcactgcaacctctgcctcccaggttsgggsgattctcctgcctcagcttccctaatagctgggactgcgggtgcccatcaccacgcccagctaatttttgtatttttartgaagacgggggtttcgmcatgttsgccaggatggtctcgatctcttsgccttgtgatccacccgcctcgacctcc

SEQ ID NO: 15087 - DNA, 132 bp, Homo sapiens
atttccagcggttgctgttctgacgggttgtagtctgccaggacaatgagttatgactaccatcagaactrgggccgtrawgggggtccccgmarctcmgrtgggggcwatgraggggggcmagcagggggt

SEQ ID NO: 15088 - DNA, 373 bp, Homo sapiens
cttttgggttgggggcgactttgtggggagcctagctgctgctgggcgtttaccgcgggagcccttagcggtctggagctttcagcttatgtggagaagtcgctgtgaagccacctataaatccatttactgaatttatggagaaggctgtaaatgatggaagtcattcagaagaactcttttgccatcttaaaactatatcagagaaagaagatttaccacggtgcaccagtgaaagtcatctcagctggtattctcatcagtatcaggggaaatctaaatttccgattctaggatttcctgttttgtctataatataaattatttgaatcaaatacagcattcttttaagaggaaaaaaaaaaaaaaaaag

SEQ ID NO: 15089 - DNA, 162 bp, Homo sapiens; identical to SEQ ID NO: 14777

SEQ ID NO: 15090 - DNA, 79 bp, Homo sapiens
aaaaaaaaaaaaaaaaaaaaaaaaaaaaaaaaaaaaaaaaaaaaaaaaaaaaaaaaaaaaaaaaaaaaaaaaaaaaara

SEQ ID NO: 15091 - DNA, 98 bp, Homo sapiens; identical to SEQ ID NO: 12160

SEQ ID NO: 15092 - DNA, 78 bp, Homo sapiens; identical to SEQ ID NO: 14824

SEQ ID NO: 15093 - DNA, 342 bp, Homo sapiens
attacaatttaactttggggtttgggtaagacaaacatttaatgtataggattttggccaggtgtggtggctcacgcctgtaatcccagcactttgggaggccaaggtgggcggatcacgaggtcaggagatcgaaaccatcctggctaacatggtgaaacccatctctactaaaaatacaaaaaaaaaattagctgagcatggtggcgggcgchtgtagtcccagctacttgggaggctgaggcaggagaatgacgtgaacctgggaggcggacttgcagtgagccgagatctctccactgcactccagcctgggcgacagagcgagactccatctcaaaa

SEQ ID NO: 15094 - DNA, 445 bp, Homo sapiens
agtacggtgtgtggagctggagcaccgtgagaagaagcgaggttctttaagagttcagctgcgagatatcaaacaaagaattactctgtacaaagccagaacacatatatcaaagtaatcctgaagtatcagaacaaaataataggctgtaacagaggaggaaatgattttgaatagcctctctctgtgttaccataataagctaatcctggccccaatggttcgggtagggactcttccaatgaggctgctggccctggattatggagcggacattgtttactgtgaggagctgatcgacctcaagatgattcagtgcaagagagttgttaatgaggtgctcagcacggtggactttgtcgcccctgatgatcgagttgtcttccgcacctgtgaaagagagcagaacagggtggtcttccagatggggacttcagacgcagag

SEQ ID NO: 15095 - DNA, 351 bp, Homo sapiens
ttttttttttccgaacgcccgcagcagggtcagaagggaggtggtcgccctccgtcgtggtctggcgtgtattccgagccttggtgtctggcggtttccgagcgttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagagggtccaagcgg

SEQ ID NO: 15096 - DNA, 371 bp, Homo sapiens
  misc_feature 281: n=a, g, c or t
agagaaagatgttccaggcagagggaagaggcctctttcctccaggcctggagctttcatgacgctggtcattatcttgctgcatgtattctggggcattgtattttttgatggctgtgagaagaaaaagtggggcatcctccttatcgttctcctgacccacctgctggtgtcagcccagaccttcataagttcttattatggaataaacctggcgtcasatttataatcctggtgctcatgggcactgggcattcttagctgcgggaggcactgccganagcctgaaactctgcctgctctgccaagacaagaactttcttctttacraccagcgctccagataacctcagggaaccagcacttcccaa

SEQ ID NO: 15097 - DNA, 506 bp, Homo sapiens
aacgttaacatatgaacctgcagaaatctggtaagacttaaattcagtgtgaggaataactctagttctctcctatgagcatttcctaaaagccatctgatttggcattcttactggagctgcagacagaaatctacaaagacaaaagtaaacaaaattaagttattattccactgttaggaatggaaataaacttgtgaagtctgtttattttgaagtattggtgaactaggcttgctaattgataactgcagcagtttgtgtttactccagttcatcagcttaggtcatttgaaagatataagagcttaaggcaagaaagaaataacatggaattctatttgaaggacaacagaacattcttggaaaagcagctccagttggtttttcarctgtcaaacttgaatgtgtaagtccccacagagcatggacagtcggtgcagagttccaaggaaacaattattgcctgatgaccacttccattttgtatacactctttggttcgt

SEQ ID NO: 15098 - DNA, 520 bp, Homo sapiens
cgaaaaatatattaaggaaagtatagctttgtaatttaaattggagcttttagcttgtttcatggaactatacaacttgtgggtaactcacatgaccaaacaaaccaaagtgcctgtgacggggcgggtggcgtctacccaccctcccttctagcagattcttattttgtttgaatttataaacaaggctggtggctgtctacccaccctcccttctagcagattttgattttgtttcaatttataacttacactttgaaccatgggtttacttataatggagtctgtagcttcacagcatatttcatgtaatcataaagaccagtatattctctcctgctgaatgacatgcgactgtaaagcctctttataaaccatttccaatgttagtatataggattatttgggaagcatatcaatacctttatagacacatatgaacatgtatgcacacaaaacatttaactatggtatttatggaagacaggtaacaaacattaaaatctagtttgcatttccc

SEQ ID NO: 15099 - DNA, 450 bp, Homo sapiens
actacaaccaaattaatccagcaagctaaggctcagatcactgtggatatgtccaaatcctccatgagtgtttaaaacaactaatttaagagagaaaaagaaaatctatgcctgtatccccattgccttatctacattgggttttatgagcacattattattaatttgaggaatagtttgtttcttaactttattctagcatttattccatggagataaaatgtattatgaaaacatgaatggagtgcttttaaaagacatttttcatggcaagtgaggaattgatttgagccaatttttctcgtattcaactgtgaaatagaatccaatataacagcaaagtcattagatctctcatctgagtgtgagtgtcctaattgtttggagggtcctccgaatgagtctgattggaacacctgttccaacgagagtggtaatggctcttgacat

SEQ ID NO: 15100 - DNA, 440 bp, Homo sapiens
  misc_feature 207,216..217: n=a, g, c or t
ttctttttaaaatttctccttcctttgttcttcatcctttctttctgttataaacattcacatatttacaaagctcatcaataagtgcaagcagtaatgggattgggcaaagcaaaatgttgaattgtgagataaaaagaatcactttttgtttactagagaaattgaaatataacagaataacaatagattattttaaatgcctrntagctatannttgtactttccattagttatataaaacaatggttttgggggcaaaaaaaagaagcaagttctgaagtdcactcttgattgcacccaccctgtagaatcatggatgctgccaattttgagcagtttttgcaagaaaggatcaaagtgaacggaaaagctgggaacttggtggaggggtggtgaccatcgaaaggagcaagagcaagatcaccgtgacatccgas

SEQ ID NO: 15101 - DNA, 573 bp, Homo sapiens
ttttttttttccgaacgcccgcagcagggtcagaagggaggtggtcgccctccgtcgtggtctggcgtgtattccgagcgttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatattttcaatgctgcgaaactgccaaaagtgacatgcagggatgtccttcctgagatccgtgctatctgcattgaggaaattgggtgttggatgcaaagctacagcacgtctttcctcaccgacagctatttaaaatatattggttggactctgcatgataagcaccgagaagtccgcgtgaagtgcgtgaaggctctga

SEQ ID NO: 15102 - DNA, 290 bp, Homo sapiens
aagtgggcgtgtcttcagacaaaggtggctttgctttgttgaagttactgatataaagatcagcgcctgaaacagattctccgggatattaccggagacggagtgttttattattagcctttcttaggtggacatttccatttgaattaaaagtcctttaggctgggcgtggtgcatggctgtaatctcagcaccttgggaggctgaggcaggaagatcacttgaggccaggcgttggagagcagcctgggcaaggtggcaagaaccttgtctctacaaaaaaaaaaaaa

SEQ ID NO: 15103 - DNA, 489 bp, Homo sapiens
aacacacgtagcggccaagatggcgctasggttggagcaggggctctgctgcgacctttacggtagtgaggttagggacgatgggagagcagctttgttcctgaagtgccgtcgaggattaggatcgagtttcttcgatcgtgagggcaattattagtggcctctaggcccccagatggcatcttgaggagagagaatccacgctacgagaactaacatagtggacatcgcagttgtccgtagccgatttgcgggttacggagttgttgcaagtaaagaaggggaaatccgagcgttctcgcgttggatttcctccacgtgtgaagtgggaatggtagtgatatctcgtgctatctctgtcaagggcaagaaggagaaggaatttatttgaggccctacgacgtggtgcggtggctcacgcctgtaatcccaacactttgggaggccgaggcaggcggatcatctgagatcgagagttcgagaccagct

SEQ ID NO: 15104 - DNA, 368 bp, Homo sapiens
aagaatatttgtggttctactgactgaagtgatcctatcttgtgactcatgcatggcacgtctataagtcaagctggaatcctctaaaataagtcacatgggaaaaaattctgatcttattctagacgaagaatgaaaagccaggaagctacataacccaagggtccccagtttgaaatgtcttgttactgctgacaagacctgcatgactgaccatttgctccctaagatatgaaaactgaccttgctttgaagttcaaaatgacattgccaaaacaagaagaaatggaaaataactgcagcacgtttatgacattcgtttctttctccacatgaaacatacaatgagaacactcaaaaaaaaaaaa

SEQ ID NO: 15105 - DNA, 454 bp, Homo sapiens
agtaagcagtcaagaatatttgtggttctactgactgaagtgatcctatcttgtgactcatgcatggcacgtctataagtcaagctggaatcctctaaaataagtcacatgggaaaaaattctgatcttattctagacgaagaatgaaaagccaggaagctacataacccaagggtccccagtttgaaatgtcttgttactgctgacaagacctgcatgactgaccatttgctccctaagatatgaaaactgaccttgctttgaagttcaaaatgacattgccaaaacaagaagaaatggaaaataactgcagcacgtttatgacattcgtttctttctccacatgaaacatacaatgagaacactttatagatgaattgtgtcttcgattgaatagggaatggtggactagctttggttttatggaattggataatttgtcatagtttctgtc

SEQ ID NO: 15106 - DNA, 405 bp, Homo sapiens
atttttgtggttctactgactgaagtgatcctatcttgtgactcatgcatggcacgtctataagtcaagctggaatcctctaaaataagtcacatgggaaaaaattctgatcttattctagacgaagaatgaaaagccaggaagctacataacccaaggattttagcacatggaagaaatgtccctacccatgcatacagaaacgcataagaacaggaagtgacgtattgtttatcaggaaaaacagtattcatgtattatttacaaaaattgaggctgatctccaagctctactgtggaaagagttcatcaagttcctagactgaagaaagctaattgtaagaaatacatatgtagtatgcacaagtttcattataaataagagtaaaaacgtgcattgtatat

SEQ ID NO: 15107 - DNA, 406 bp, Homo sapiens
aagaatatttgtggttctactgactgaagtgatcctatcttgtgactcatgcatggcacgtctataagtcaagctggaatcctctaaaataagtcacatgggaaaaaattctgatcttattctagacgaagaatgaaaagccaggaagctacataacccaagggtccccagtttgaaatgtcttgttactgctgacaagacctgcatgactgaccatttgctccctaagatatgaaaactgaccttgctttgaagttcaaaatgacattgccaaaacaagaagaaatggaaaataactgcagcacgtttatgacattcgtttctttctccacatgaaacatacaatgagaacactcaaaaaaaaaaaaaaaaaaaaaaaaaaaaaaaaaaaaaaaaaaaaaaaaad

SEQ ID NO: 15108 - DNA, 337 bp, Homo sapiens
tagaatctgaggaaatgtcagttaacaaaactacaggtttcagccctttctgatctagtctgagctcctctcccagaaggaaactgctacttcctgcacagtttgagcacaaaaatatcaatgtaaccatataaggaaaaattacagcaaatgcctgggaagaaggagccccagatgccatgaaagtgtatagtgggggaactggtctgcggggtcaggagagcctctttgtggaagggcatgtcgtctgacccttstagcattagccaaaggaagaagttgggggaggggaaatgccccaggaaagggcagcaccctggaggcttttktttttttt

SEQ ID NO: 15109 - DNA, 568 bp, Homo sapiens
  misc_feature 539: n=a, g, c or t
wkwwkkkwkkysgwmssccyscrkcrkggtcwgrmgkgwgktsskmgccytsskkystggyskkkysygwrykyygrksyytggygtctggcgtgtattccgagccttggtgtctggcggtttccgagcgttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaastgccaaaagtgacatgcagggatgtccttcctgagatccgtgctatctgcattgaggaaattgggtgttggatgcaaagctacagcacgtctttcntcaccgacagctatttaaaatatattggt

SEQ ID NO: 15110 - DNA, 481 bp, Homo sapiens
agaagaaatagcaagtgccgagaagctggcatcagaaaaacagaggggagattgtgtggctgcagcgagggagacaggaagatctgcatggtgggaaggacctgatgatacagaggtgagaataagaaaggctgctgactttaccatctgaggccacacatctgctgaaatggagataattaacatcactagaaacagcaagatgacaatataatgtctaagtagtgacatgtttttgcacatttccagcccctttaaatatccacacacacaggaagcacaaaaggaagcacagagatccctgggagaaatgccggccgccatcttgggtcatcgatgagcctcgccctgtgcctggtcccgcttgtgagggaaggacattagaaaatgaattgatgtgttccttaaaggatgggcaggaaaacagatcctgttgtggatatttatttgaacgggattacagatttgaaatgaagtcaca

SEQ ID NO: 15111 - DNA, 372 bp, Homo sapiens
ttctcccccgagccggccgggagccgggacgggggcgcgcagggtccgggagagttacaggcttcagactttatctcgttgtggaaagcaagagaccaagccaaaaactttggtcgtgcttttcaacatctccggtcaaaagaggtcgccaatctgcttttctcccattgctgcgtcttagaggggtgtggtgccatctcattgaacaatgaggatatttagctcccctcagagctaccctcagagttggatgagctatcctcagagttggatgccaccaccgggagcagcaaaagcgaaggcaactcatgattctgcctcagaagcaatcgaataaaatattttgaaaatggaaaaaaaaaaaaaaaaaag

SEQ ID NO: 15112 - DNA, 391 bp, Homo sapiens
aatcccctgtggttggtgatcaaggaagagcatagtgccagacctaggkgycctcctgggaatgttccaggagggcaggagtaggaggaggagtgttagagtagaggggaaatgatgagagcagaaaggagagtctcgctctgtcacccaggctggagtgcagtggcaggatcttggctcacttcaacctccacctcccgagttctgcctcagcctcccaagtagctgggattacaggtccagtcactccacgcttgcagagtccaattaacaagagcaagttctggtagaaagaaggtgactttattccagagctcaggtgtttgaactgatgtctgatgaggatgaatccagcgactacctctgcctgtccatcctggggcctctttct

SEQ ID NO: 15113 - DNA, 406 bp, Homo sapiens
gtcacaagggagatgtccgcccccagtcgtagcctcggacggtttctgagcgttggtgtttggcacgcgccaccctctcttgctttggttccgccatgccgatgtaccaggtaaaaccttatcacgggcgcggcgccttctccgtgtggagcttcccacctgcatgtaccggctctctaacgtgcaaggcaggagcggcggcccagcgcccggcgttggccacctacagtctttggtagatgagtggctggatagctacaagcaagaccaggatgcaggatttctggagcttgttaactttttcatctgatcttgtggatgtaaagctatgaaactgatgacctccctggtaagagttgccctccaactgagtctgcacgaagatatcaatcagcgtcagtatgag

SEQ ID NO: 15114 - DNA, 539 bp, Homo sapiens
ttttttttttccgaacgcccgcagcagggtcagaagggaggtggtcgccctccgtcgtggtctggcgtgtattccgagccttggtgtctggcggtttccgagcgttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaastgccaaaagtgacatgcagggatgtccttcctgagatccgtgctatctgcattgaggaaattgggtgttgatgcaaagctacagcacgtctttcctcaccgacagccaaaaaaaaaaaaaaa

SEQ ID NO: 15115 - DNA, 408 bp, Homo sapiens
accttttttactttcacagcaatagtgcagaatccagaatggatgtcctctttgtagccatctttgctgtgccacttatcctgggacaagaatatgaggatgaagaaagactgggagaggatgaatattatcaggtggtctattattatacagtcacccccagttatgatgactttagtgcagatttcaccattgattactccatatttgagtcagaggacaggctgaacaggttggataaggacataacagaagcaatagagactaccattagtcttgaaacagcacgtgcagaccatccgaagcctgtaactgtgaaaccagtaacaacggaacctgtggaagaaggctgctatgactctttggatgggagtctggcaagaggaaattggaagataaaataaataa

SEQ ID NO: 15116 - DNA, 558 bp, Homo sapiens
aaatcagtccctatgatctgatacagattagcttgaagggggaagaaaaactttttcagatattggtgctgcaaatttattttaaatggaggcaggctggctttttactaaaagatgaagaaaaggaaccaattaaaatagaaacttcttcccaggtagaatcagaaataaagcaggaatcgtgattggaatccaccagcccagcaccctgtactctggtgccccaagtgattacatgtgagcctcccagaaagaacaaatattgctcttgccactcctctccaatgctgacaggactgagtcctggggcaagtggatccgggaattgcattgcagacaattacgcagtaatttccctgtctggagaagcacaccagttaacactagactgtcacagccctaggagagctgtaggtatgcatcatagcttctgtgatctcagaaccgtttctctgaccagcaaaagaagagatgaaaatgctcctcttgacctctatctgcactacaccagaaacgtcattgagcagtttcttctaaggagatacagaacttctatgc

SEQ ID NO: 15117 - DNA, 529 bp, Homo sapiens
  misc_feature 500: n=a, g, c or t
gcgcccgcagcagggtcagaagggaggtggtcgccctccgtcgtggtctggcgtgtattccgagccttggtgtctggcggtttccgagcgttggtgtctggcggtttccgagcgttggtgtcttggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaastgccaaaagtgacatgcagggatgtccttcctgagatccgtgctatctgcattgaggaaattgggtgttggatgcaaagctacagcacgtctttcntcaccgacagctatttaaaatatattggt

SEQ ID NO: 15118 - DNA, 407 bp, Homo sapiens
attgagttcaaagcagtgatgtttggatcaggcagtagatgaggttaagggttcctgtggtggtttatttggatctgaacgtctatgacactctttcgagctgacacagtgaagaacatagaaggagaactcacccagtctgccagggtcacagaatgatcatactcaagatcttcctggggagtcaatggcaaatttcactgggctattttacagatgaagaaggaacataaagaaggttctgggaccccgaagtccacggaacacccaccattacctgatctttggagcttgtcatttggccagtggaccctaataaacacgtccacggggatgtggggatagaatgccggagcctggctcgctarggcatccaggttcttccttcctctttgccctgctgtctc

SEQ ID NO: 15119 - DNA, 495 bp, Homo sapiens
ttacatagttactatcagtagttattagactctaaaattggcatatttgaggaccatagtttcttgttaacatatggataactatttctaatatgaaatatgcttatattggctataagcacttggaattgtactgggttttctgtaaagttttagaaactagctacataagtactttgatactgctcatgctgacttaaaacactagcagtaaaacgctgtaaactgtaacattaaattgaatgaccattacttttattaatgatctttcttaaatattctatattttaatggatctactgacattagcactttgtacagtacaaaataaagtctacatttgtttaaaacactgaaccttttgctgatgtgtttatcaaatgataactggaagctgaggagaatatgcctcaaaaagagtagctccttggatacttcagactctggttacagattgtcttgatctcttggatctcctcagatctttggtttttg

SEQ ID NO: 15120 - DNA, 478 bp, Homo sapiens
aataaacaatggactgttttattcttggtgctttcaagacctgatgctttgttttgaacaggttgatacatctaggagtgaaatacatcaccgctttccctgctcccgccgccattaaaattgtgtttggcatctgaccaccaagatacagatatttcctagactgttttgcagctaggtacttagcatttctctttcctctggagaaaaatatctgctttctttaaaataaatgttccatccatgcagctaagcagctaaggacacgaacagccactgatacaggccaactcatcagtagattattgagatttcatactaggacctttcattggctgaacaaagacaaagacagaaatcaaggaaggtcaaagaagcagtcagttttctggcacccaaagttgttggagaagggtacagagtcggtaaataagtcatatgacagacaggcagtattttcttattttaataacaagtt

SEQ ID NO: 15121 - DNA, 483 bp, Homo sapiens
  misc_feature 442: n=a, g, c or t
ataagcaatggactgttttattcttggtgctttcaagacctgatgctttgttttgaacaggttgatacatctaggagtgaaatacatcaccgctttccctgctcccgcsgccattaaaattgtgtttggcatctgaccaccaagatacagatatttcctagactgttttgcagctaggtacttagaagtttttctaagttatttaaacttctcaccacacaaaatctggatttgtatctgtcacgtataattgcttgataaatcatttctctttcctctggagaaaaatatctgctttctttaaaataaatgttccatccatgcagctaagcagctaaggacacgaacagccactgatacaggccaactcatcagtagattattgagatttcatactaggacctttcattggctgaacaaagacaaagacagaaatcaaggnaggtcaaagaagcagtcagttttctggcamccaaagttgtt

SEQ ID NO: 15122 - DNA, 525 bp, Homo sapiens
ataaacaatggactgttttattcttggtgctttcaagacctgatgctttgttttgaacaggttgatacatctaggagtgaaatacatcaccgctttccctgctcccgcgccattaaaattgtgtttggcatctgaccaccaagatacagatatttcctagactgttttgcagctaggtacttagaagtttttctaagttatttaaacttctcaccacacaaaatctggatttgtatctgtcacgtagtaattgcttgataaatcatttctctttcctctggagaaaaatatctgctttctttaaaataaatgttccatccatgcagctaagcagctaaggacacgaacagccactgatacaggccaactcatcagtagattattgaggatcattctcttcagtcagatcacgatttgagtttgaactaaccagagagtagcagaaggaacgttttctcatttccatgtccagaaagatatattcctgctascctcctgaagtcagaggatgaaatcatagtcaaa

SEQ ID NO: 15123 - DNA, 478 bp, Homo sapiens
cagaacagggatttccctgcaagtgtctccctcatgctgaagtgaactagctgaatatgctcttaaagaaagtagtcagaaaagaaaaaaaagattatcttctccaaaatttgagaccaagtagctgtaaaaaacataataaacccagatgaaaaccaggcttcgttttcttgaaatgattttcttcatcagaatggtagatcagagccattggtgtgcagattccaatcctttaaaaagtaaacacatgccttttgataaagcggaattgaggtgatcagaaattctgttgagaacccagctatttgtgtgagtatattttagctatcccaaaaactttttctgacctttctctttctgggataggatatgtgtgcttagagtatcattcagaagggtacctaatagttaatctgttaattagttacatcaggtttcaatactaggtcagtgatatgagagcgagagagagagattt

SEQ ID NO: 15124 - DNA, 375 bp, Homo sapiens
aattaaaatgaatgggagttacatgcaaatacctcaaataaaatacctcaaataaaaaatgtagaatacctttccactgatgatttttagttgtcaggacaagtgagacccaaacagcagacagaatggtcccagcatgcttgttgcctttttttgtttgcacagtggctgtcagttccagccttgcaggtagtggaacccagccggaagaaggggcgggacccagcattgcagcctgaactgagagcaaatttaaattactgagccttttttttcctttttttatttttctactctgcgacaaactgaaaagattccagcacgctaatttaaccaccctgcttcttctttgcctttttttttttttgggatttt

SEQ ID NO: 15125 - DNA, 64 bp, Homo sapiens
ataaaaagaaaagactccgcacggcgcgggtgagtcagaacccagcagccgtgtaccccgcaga

SEQ ID NO: 15126 - DNA, 100 bp, Homo sapiens
ccctctcagcatcgcttttgctgggccgtgatcgtccccctttgtgggctggaaaagcaggtgagggtgggctgggctgaggccattgccgccactatct

SEQ ID NO: 15127 - DNA, 165 bp, Homo sapiens
ccctctcagcatcgcttttgctgggccgtgatcgtccccctttgtgggctggaaaagcaggtgagggtgggctgggctgaggccattgccgccactatctgtgtaataaaatccgtgagcacgaaaaaaaaaaaaaaaaaaaaaaaaaaaaaaaaaaaaaaamaa

SEQ ID NO: 15128 - DNA, 144 bp, Homo sapiens
ccctctcagcatcgcttttgctgggccgtgatcgtccccctttgtgggctggaaaagcaggtgagggtgggctgggctgaggccattgccgccactatctgtgtaataaaatccgtgagcacgaaaaaaaaaaaaaaaaaaaaa

SEQ ID NO: 15129 - DNA, 235 bp, Homo sapiens
aatcacacaggatccggagctggtgctgataacagcggaatcccccgtctacctctctccttggtcctggaacagcgctactgatcaccaagtagccacaaaatataataaaccctcagcacttgctcagtagttttgtgaaagtctcaagtaaaagagacacaaacaaaaaattctttttcgtgaagaactccaaaaataaaattctctagagayaaaaaaaaaaaaaaaaagg

SEQ ID NO: 15130 - DNA, 421 bp, Homo sapiens
tcttagattagtgaatgccaagtgactattctttcatcagggccaaggtggcactaacactttattagcccatatggatgggtctcaaaagcagtaatatagaaactttgcagcttagctgtataagaataatgcttataaataaaataccataacgtgtaaaagtaaaaatgtctctcttcyttttaaawawacttcagtcwattcaagacaaagaagtagccaagaaacataagaaaaaaatgctcaacatcactgatcatcagagaaatgtaaatcaaaaccaccataagacaccacctcacattatccagaatagctattattaaaaagtcaaaaaagattggctgggcgcggtggctcatgcctgtaatcccagcactttgggaggccgaggtgggtggatcatgaggtcaggagt

SEQ ID NO: 15131 - DNA, 617 bp, Homo sapiens
atcaccatggcaacagccttatctgccgccctagagccttttccctataacagtgaaatcaacaatgactgtgtcaggagagatctttaacttattatttattacaagatattctaatgtttaaagagcaatccaacataaatgaagagaacataagaaacagcatacacaatactggacatcacaggaccctctccggctggataccaggctgtagaaccaccagatgcttcagatgagaaaggttggatctgtttcacagggaaggggctaaactgtttcaagaggcgaccacgcgctgggcactctgtgtctcgctctgtcacccaggctggagtacagtggtgtgatctcggttcamtgsaamctcaaactycyhmgsttcagkkggatcctccsaacstcagctycttaagtagctgagactacagtactttgcaacctaccaagtatcatcacaagagctatgaaagtgaagagagacatacgttatctaagaatctgagagagatgactcagtcagcatcctctctcttggtgtacaatggtagggacagctactgtgtcatctggarcatgacaatgagaacacagacactggatcgtcctgatatagc

SEQ ID NO: 15132 - DNA, 540 bp, Homo sapiens
aaatcaacaatgactgtgtcaggagagatctttaacttattatttattacaagatattctaatgtttaaagagcaatccaacataaatgaagagaacataagaaacagcatacacaatactggacatcacaggaccctctccggctggataccaggctgtagaaccaccagatgcttcagatgagaaaggttggatctgtttcacagggaaggggctaaactgtttcaagaggcgaccacgcgctgggcactctggctggagtacagtggtgtgatctcggttcactgcaacctcaamctcctcggytcakgtggatcctcccamctcagcttcytaagtagctgagactacagtactttgcaacctaccaagtatcatcacaagagctatgaaagtgaagagagacatacgttatctaagaatctgagagagatgactcagtcagcatcctctctcttggtgtacaatggtagggacagctactgtgtcatctggarcatgacaatgagaacacagacactggatcgtcctgatatagc

SEQ ID NO: 15133 - DNA, 232 bp, Homo sapiens
  misc_feature 144: n=a, g, c or t
agcaatgtcatccagaccagagcagggacagaggggctctggtgtgtagaascagggaaacagcatcaggcctgggtatcagrragaaccaaattccagccttagctcacccactaactgggctcactaaccctcggcaagtcnvttatcctctttgagcttcttcttcccctaaaacatgggatttaataatgcctgccttgacctggcttgcaaagttgttgtaaggaac

SEQ ID NO: 15134 - DNA, 351 bp, Homo sapiens
  misc_feature 147..148,351: n=a, g, c or t
agcaatgtcatccagaccagagcagggacagaggggctctggtgtgtagaagcagggaaacagcatcaggcctgggtatcagaaagaaccaaattccagccttagctcacccactaactgggctcactaaccctcggcaagtcaadnnatcctctttgagcttcttcttcccctaaaacatgggatttaataatgcctgccttgacctggcttgcaaagttgttgtaaggaacaagaaatacagagtgtgaaagtgcattgtaaaaaaaaaaaaaaaaaaaaaaaaaaaaaaaaaaaaaaaaaaaaaaaaaaaaaaaaaaaaaaaaaaaaaaaaaaaaaaaaaaaaaaaan

SEQ ID NO: 15135 - DNA, 440 bp, Homo sapiens
cccatatttaaaaaatataaccacaataccttatcagagccaaaacaaatatggtcgcacacctgtaatcccaacactttgagagactgaggcgggcagatcgcctgaggccagaggttcaggaccggcctggccaacatggtgaaaccctgtgtctgctgaaggtgcaaagattagctaggcatggtggcgggtgcctgtggtcccagctactcgggaggctgaggcaggagagtcacttgaaccagggaggtggaggttgcagtgggccggggttgcgccgctgcactccagcctgggcaacagagcaagactctgtctttaaaaaaaaaattaattaattaattaatttaaaaaactacttactatcgtttaatacctatcagtgttcatatttcccccacttgtcaaaaatatcttgttattcagcagcaaagcag

SEQ ID NO: 15136 - DNA, 493 bp, Homo sapiens
aaaggcacacaaggtgggactgtccagttacagggaacacacttcagagtttctaccaattctacattatgacgtccctattccctgagacacaatcaaaattaggccagttaataaccctacaatggcctctaaatgttcaaatgggaggaagagttacacatctcttcttttaaatcaaaagctacaatgattaagcttagtgaggaagccatgttcaaagctgagctaggccaaaagctaggccttttgcaccaaacagctaagttgtgagtgcaaaggaaaagttattgaaagaaattaaaaagtgctaccctggtgaggacataaatgataaaaaagcaaaacagccttaatgctgatctgaagaaaattcaagtgttctgaatagatcaaaccaaccaaaacactcccttcagccaaagcctraatccagaccaaggcactaactctcttcaattctgtgaaggcttagagaagtaaggaagctgca

SEQ ID NO: 15137 - DNA, 348 bp, Homo sapiens
aggcgcgcggggattggcgggatgcggcgcgccgccgtgaacctccttggcctgggcgaastgtgtggaccaagcaagtcaggagtgtggccatgttttctgagcaggctgcccagagggccacactctactgtccccaccatcagccaacaatgccacctttgcccgggtgccagtggcaacctacaccaactcctcacaacccttccggctaggagagcgcabtttagccggcagtatgccacatttatgccacccgcctcatccaaatgagacccttcctggagaaccgggcccagcagcactggggcagtggagtgggagtggaagaagctgtgtgaactgcag

SEQ ID NO: 15138 - DNA, 399 bp, Homo sapiens
aaggcgcgcggggattggcgggatgcggcgcgccgcggggtgagacatcggtatccaggcacgataaatttccaagtggacacaatgtctggtgtcaactacagctgttctccttcttttcccagtatcctttgggtgcagtgagacaccaggagagctgctgctttgggggatggacaggggcagcaggaatgcctttgtgttttcgcagtgaacctccttggcctgggcgaagtgttgtggaccaagcaagtcaggagtgtggccatgttttctgagcaggctgcccagaggsccacactctactgtccccaccatcagccaacaatkccacctttgcccgggtgccagtggcaacctacaccaactcctcacaacccttccggctaggagagcgca

SEQ ID NO: 15139 - DNA, 225 bp, Homo sapiens
agaccttgcctgatgtcccctgggggaagtcaccctgggggacggctgctggtgagcgctcacagatgtgtgtccatagcagctgactctcctttgcatctcctccccgaggacgcatggcaggcaggccacgcccctccatgtgtaagacctgccgaaaacactcctcgtggggttggggtgggagtgcaggggccttggtggtttctacacccatgggcctgc

SEQ ID NO: 15140 - DNA, 535 bp, Homo sapiens
ccaacatctattgtcaacatgtacatctaccttagtatggtctgcattctttttctgagagtacctcatagggctcctgcctgatctttgtagtttgttcattcatccatccacctgttcatttgttcatccatgtattctaacatttctatgtagtgtgcaactctaatgtcatgcttttgaagaagagatagctgcccatagcagccatccgtctggataatagcaaaacactctagataagttattttgcactttcttatgtataaagttggtagaaacttatttttgctttgtatcatttaaatacattttgttttggtaaatgaactgtgtataaaatatttatgccgttaaaactgtttttagaaagtatttttaatttcagcaagtttgattacttgttgcatgactcttaacacagctgactttttgtgtcagtgcaatgtatattttttgtcctgttattaacttgtaagccctagtaatggccaattatttgtacagcaacagaagtaaattgaagatactggct

SEQ ID NO: 15141 - DNA, 439 bp, Homo sapiens
agagggagggaacggtgcggasggccaacatggcggaactcaggagacacaagaagcggatccaggaagttggtgaaccatctaaagaagagaaggctgtggccaagtatcttcgattcaactgtccaacaaagtccaccaatatgatgggtcaccgggttgattattttattgcttcaaaagtagtggactgtcttttggattcaaagtgggcaaaggccaagaaagggagaggaagctttatttyacaaccagggtagtctgtggttgactactgcaacaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagaagacaaa

SEQ ID NO: 15142 - DNA, 289 bp, Homo sapiens
  misc_feature 289: n=a, g, c or t
aacacacctgtaaccccagcatttaggaaggctgaggtgggaggatcacttgaggccaggaattcaagaccagcctgggcaacatggcctgtgatacttgggctgtgatcctctagagccagcttggactcacatcattctatggggttgaagacaactcattccctctgaggagccttgtacatacaagccttttatttataacttattttgtattgaaacttttaaacaatactgaagaaaaaaaaaaaaaaaaaaaaaaaaaaaaaaaaaaaaaaaaaaaaaaaan

SEQ ID NO: 15143 - DNA, 479 bp, Homo sapiens
cattagatgaaataagaatgaaggcactttgttggcggagaccgtatctcatttacagaaaagcagtggtctctttcaaattcaagttcatatctaatttgaaactacatcttatattctgattgttctaccatttcccttgagtgcttaagcaatcatggtatctctctgccaaattaagtcaagacagagcttactatatgacttattaaagaatcagcaccaggctgtgaacagcagtagtcctgagcagggggtggttgtgtgccttaaagattattaattgcaatagactacccatgctagtaaattaccttttacgtgttaacatggtaaggccacagtgggctgaattgtttgcagatagacgacaataagaagccagaaattgtggggaaatggaatgtatactgtggtaaagatgggggagatggaggctacaagaaagaagagatcagcatagaagactgagttttgtg

SEQ ID NO: 15144 - DNA, 447 bp, Homo sapiens
attttattttaccaaggagcaaaactgagtaagtttcctgacgaaaataatgagtgtctactgttctagggcctttaacaacaacaacaacaaatttacattaacgcacattatgtgccaggaattgcaagatgcataagattagtttttaaaatgtgcctgctagagctgaacaggtaacgagagttcgaagccgggtccagagctatcttctgtaacattcttctgggtcgagtccctgccccgctacgagactatacgtaacatggacctggaaaagcttaaaaatatgaagaggattgaactggctgccatctgtgcatcttcatttatgaaaacactcctcatagacttaaaacaaatgacagagaacaaattagtcagcttcttctaaaatacagtggtctcccttamcctcagtttcactttctgcagtcaactgcagtc

SEQ ID NO: 15145 - DNA, 457 bp, Homo sapiens
ataaagactgttccagtcagggaatctcacggaggtccctgtcctgggtctgattggagaagaatcaccaggaagccctgaggttactcaggactctgatccttgtgaccatggttgaggaattttcatccgtttcarcgtcaatctgcattttgtgccarggagaaarggtcctcatatgcatagagaagacattgttaggcacagttttctaaatttaagaggttccctggggaactgtcagaagaagacaaagtcccacatcctgacaggaaacagcctccatctgcacctgcctccagggctgactctgatcagtggctcctgagcgccccctgcagctgatttccccccagcgttcctgsagggaggtttgtgtctgggcsacaatgacctcccctcactgtgtattactgtggcgaaagattccaggcctctagggggaatagtgacagcc

SEQ ID NO: 15146 - DNA, 462 bp, Homo sapiens
catcttctgagttctatgtgtctcatttcagacatttacatctggtcaggatcctttcctagggagctagtgagaggctttggagatcacaaaacactctggctttgtgtattgccagacttcttgtgcttattcctttccatctgcgggagttgacacttcttttttgaatttgcttcatttagatggggtttgtattagtcagagttctctataggtaccgaagtaataggatagatgtacatttgaaggggagtttattaaggatcattgactcacacgatcacaaggtaaagtcccacaataagccatctgcaagctgaggagcagggaagccagtccgagtcccaaaacctcaaaagcagggaagctgacagtgcagccttcagtctgtggctgaaggctgagagcccctggcaaaccactggtgtaagtccaagagtccaaaagctgaagaactgg

SEQ ID NO: 15147 - DNA, 353 bp, Homo sapiens
aaacagcctcgccccgcctacgcgggacccaaccgcggcgaccggacgtgcactcctccagtagcggctgcacgtcgtgccaatggcccgstatgragragktgagcgkgtccggcttcgaggagttccaccgggccgtggaacagcacaatggcaagaccattttcgcctactttacgggttctaaggacgccggggggaaaagctggtgccccgactgcgtgcaggctgaaccagtcgtacgagaggggctgaagcacattagtgaaggatgtgtgttcatctactgccaagtaggagaaaagccttattggaaagatccaaataatgacttcagaaaaaacttgaaagta

SEQ ID NO: 15148 - DNA, 486 bp, Homo sapiens
tagaaatgcagcatctttgtggacgtctttttcacaagcctccaaggctccttagattgggtcgttactaaaagtacattaaaacactcttgtttatggaagtatattgatgtattctaaagctagtaaacttccctaacgtttaattgccctacagatgcttctcttgctgtgggttttcttttgttagtggtctgaaataattattttcctgttctattaatacatagtgtattttgcacaaaaaaattaacctggtcaatagtgattaccaaaatatatattaataatcttggcaatttttgacattaattatgaaacattttagcccacgttagttctacattattcttcacttaaactcagctactgcaaattttgtctttctgtaaatgttatttaaatatccagtgagctcagaaggactcagtattatttcaagactatttttgaggtaattctagccttttaaaatattctacagac

SEQ ID NO: 15149 - DNA, 437 bp, Homo sapiens
tatttaacctgttatctgtagctatctgcttgggaacaaaaggaaaagcagtttattgcatgactcagcttgcagcttaattttttctcttgacatggtggattggggtcccaagtttttgttttgtttttagtgtcaacagcctaaaataggcaataggaaagaaaatactgtatgagagatgtcatagtgttagactgtggagtttggcaatctattgtatatgaaagttgacagcagagagagtttaaaactattattaagattttagcctgggctggggcacaatgtctcacacctatagtcccagcactttcggaggctgaggcaggagaatcacttgatcccaggagttcaagtctccagtcagccatgatcacaccactgtgacagcctgagggacagagcaagactctgtctcaaaaaaaaaaaaaaaa

SEQ ID NO: 15150 - DNA, 570 bp, Homo sapiens
aagtatacatccataggtaatggctgcaagtgagaatctactttttgaaacaagttgaaaaaaagcatttgtctacaaaagaacatcagatactgcactttttacaaattgaatgtttgtggcaagcctgcatcgagaaagtccattgatgccatttttttcaaacagcctttctattgcttgagacacaacaatattgaaattaggcaaattgatagccctacaatggcctctaagtgttcacgtgaaaagaagaatcacagacctctcatttgaaattcatgttgttttcatgcctgctaacacaacatccattctgcagcgcatggatcaagggttaattttgattttcaatgttattatttaaatatatttcataatgctatggctgccatagatagtgattccattaatggatctgaaattgaaggaaaagtaaagatgtttctggaaggcaccaggagtcctgtctgcactgagcaccatgaagttcacctgcattgagttctttccctttgtacaacacttactcccagaccaaaaaataactccttctctccaatctgtgtt

SEQ ID NO: 15151 - DNA, 464 bp, Homo sapiens
tttatctgatattttgaagggtatattgctttgaagtaagtctcaataaggcaatatattttagggcatctttcttcttatctctgacattgttcttaaaattatttgaatatcataagagccttggtgtctgtcctaattcctttctcactcaccgattctgaatacccagttgaatcaaactgtcaacctaccaaaaacgatattgtggcttatgggtattgctgtctcattcttggtatattcttgtgttaactgcccattggcctgaaaatactcattgtaagcctgaaaaaaaaaatctttcccactgttttttctgcttgttgtaagaatcaaatgaaataatgtatgtgaaagcaccttgtaaactgtaacctatcaatgtaaaatgttaaggtgtgttgttatttcattaattacttctttgtttagaatggaatttcctatgcactactgtagct

SEQ ID NO: 15152 - DNA, 201 bp, Homo sapiens
tagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggcaaaaaaaaaaaaaaaaaaaaaaaaaaaaaaaammm

SEQ ID NO: 15153 - DNA, 344 bp, Homo sapiens
agaccagaccaacagtaacaccaagggcaggtgggcagaaccaggaagagaacatgcagaaggcactaagcttcctgggcccctcacccccagctggaaattaagaaaaagtcgcccgaaacaccaagtgaggccatagcaattcccctacatcaaatgctcaagcccccagctggaagttaagagaaagtcacctgcccaagaaacaccgagtgaggccatagcaactcccctacatcaaatgctcaagccctgagttgccgccgagaagcccacaagatctgagtgaaatgagcaaaagtcacctgcccaataaagcttgacaagaaaaaaaaaaaaaattg

SEQ ID NO: 15154 - DNA, 484 bp, Homo sapiens
cccttctggatgtgattctgggtcgcaagtccttatttatatgtgaggctggggaatgggctgggggtattggcagtccttttgcagggcagtgtgtgtggtggggtgacaccgctgtggcttagcccaagacactcccagaggaaaacactgcagaaggaactgtttgcagactgtggaaggatctgcagttttgtttttgatcaaaaaaataataataagttagctctgaagggcagagggaatacccaagcccctgatgcctatgagaagtccctggacttcaaccctcctgttgtttggccttagcccagagggagctgctcacctgagcacccttgggggtgggcagagaggcagggtgggattttagagttagtgtctgtgcgtggcagccctgagcctggagttgagactttggggtctcttagtttggaggtgttgagtgcatttgtgcccctgcctggttgagagcttcttggta

SEQ ID NO: 15155 - DNA, 896 bp, Homo sapiens
ccaaagattaaagccttgacataagatctcatttgcagaaagcagattaaagaccatcagaaggaaattatttaggttgtaatgcacaggcaactgtgagaaactgttgtgccaaaaatagaattccttctagtttttcttgttctcatttgaaaggagaaaattccactttgtttagcatttcaagcttttatgtatccatcccatctaaaaactcttcaaactccacttgttcagtctgaaatgcagctccctgtccaagtgccttggagaactcacagcagcacgccttaatcaaaggttttaccagcccttggacactatgggaggagggcaagagtacaccaatttgttaaaagcaagaaaccacagtgtctcttcactagtcatttagaacatggttatcatccaagactactctaccctgcaacattgaactcccaagagcaaatccacattcctcttgagttctgcagcttctgtgtaaatagggcagctgtcgtctatgccgtagaatcacatgatctgaggaccattcatggaagctgctaaatagcctagtctggggagtcttccataaagttttgcatggagcaaacaaacaggattaaactaggtttggttccttcagccctctaaaagcatagggcttagcctgcaggcttccttgggctttctctgtgtgtgtagttttgtaaacactatagcatctgttaagatccagtgtccatggaaaccttcccacatgccgtgactctggactatatcagtttttggaaagcagggttcctctgcctgctaacaagcccacgtggaccagtctgaatgtctttcctttacacctatgtttttaaatagtcaaacttcaagaaacaatctaaacaagtttctgttgc

SEQ ID NO: 15156 - DNA, 475 bp, Homo sapiens
  misc_feature 251: n=a, g, c or t
aactttcagattaatgaattaaactttttgaataatcaaagggaatctatgcgcagttgtagggagggggcgacgtaggggaaaagttagttttacaaagtgaagctaactcagtttaataaatagttttagaagtttttagtggttaacaaaagactgcatctctcttatgcaagaactgcccatgtttcatcttgtccgaggttgaccatccgcctgtgctctcaatgagacttctagcccctcagagnccacaccagcgagcaacatcgccacctgctgggagttagaaaaattacagaattggattatctttattcaaatattcttggattctgggtttaaagatggagtctcagttttataagggggagtttccctgcacagctctctctctttgtctgctgccattcatgtaaaatgtgacttgctcctccttgccttccgtcatgattgtgatgcctcccagccatgt

SEQ ID NO: 15157 - DNA, 79 bp, Homo sapiens
agaccagaccaacagtaacaccaagggcaggtgggcaggcctccgccctcctcccctactccagggcccacttgcagcc

SEQ ID NO: 15158 - DNA, 315 bp, Homo sapiens
gaagcgggagagawsagagccgaggacgcgcgtttggggaggacgcagaagccgccgaaacaataagggcgaccgasaccttagacagggagagacagagacctcgatcggctgccggccgtcgcgccgagggacgatggagggactgagaaaggcgaggctaagtcagacgttgttattgaagatgataggattgatgacgtgaaaaatatgaccgacaaggcacctcctggtgtctaactcccccaaagacaatgagttaagggagagaataagaacggcggtaacagttattggcaaaaaaaaaaaaaaaaa

SEQ ID NO: 15159 - DNA, 495 bp, Homo sapiens
ttgtatgagcagttgggtttcgggacgctttttggggagaacccgatggagtctgaaggatctctaaatcaggcggaacccacggacggagagagatgcttcaaattggtccacggataagctgaaaacactgttcctggcagtgcaggttcaaaatgaagaaggcaagtgtgaggtgacggaagtgagtaagcttgatggagaggcatccattaacaatcgcaaagggaaacttatcttcttttatgaatggagcgtcaaactaaactggacaggtacttctaagtcaggagtacaatacaaaggacatgtggagatccccaatttgtctgatgaaaacagcgtggatgaagtggagattagtgtgagccttgccaaagatgagcctgacacaaatctcgtggccttaatgaaggaagaaggggtgaaacttctaagagaagcaatgggaatttacatcagcaccctcaaaacagagtcacccagggcatgatc

SEQ ID NO: 15160 - DNA, 495 bp, Homo sapiens
aagttaaggaggggagggggtggagggaaaagcaagccaggaggtgcttgcggccgcttctagtagtttccaggcgctgccggcggctggcactaagcggtcctgaggctgtggctacggctgctccggagctggtggcgccgcgataggagagccgatggccaagtggggtgagggagacccacgctggatcgtggaggagcgggcggacgcaccaacgtcaacaactscactggacggagagagatgcttcaaattggtccacggataagctgaaaacactgttcctggcagtgcaggttcaaaatgaagaaggcaagtgtgaggtgacggaagtgagtaagcttgatggagaggcatccattaacaatcgcaaagggaaacttatcttcttttatgaatggagcgtcaaactaaactggacaggtacttctaagtcaggagtacaatacaaaggacatgtggagatccccaatttgtctgatgaaacagcgt

SEQ ID NO: 15161 - DNA, 203 bp, Homo sapiens
tcgcctcksggagctggaaatgcagctattgagatcttcgaatgctgcggagctggaggcggaggcagctggggaggtccgagcgatgtgaccaggccgccatcgctcgtctcttyctctctcctgccgsctcctgtctcgaaaataacttttttagtctaaagaaagaaagacaaaagtagtcgtccgsccctcacgcccty

SEQ ID NO: 15162 - DNA, 420 bp, Homo sapiens
  misc_feature 114: n=a, g, c or t
tatctgtcaacctgtcttgggcagaaacagcggcggcgacasagcaggagcgtcatggccgtggcgctgtctgcgccggcggatccgsctttcggactgaggcccagcgcagcnttgcaaagagcagcagctacctggcaactgaacccatcatcaccacagccactcctgcagctgccacggtttctgccacctctaagatgtgccctggtaactggctttgggcttctatgacttttatggcccgcttctcccggagtagctcaaggtctcctgttcgaactcgagggaccctggaggagatgccaaccgttcaacatccctttcctcaatgtcttcgagttggagcggctcctctacacaggcaagacagcctgtaaccatgccgacgaggtctggccaggcttctatctcggagac

SEQ ID NO: 15163 - DNA, 436 bp, Homo sapiens
  misc_feature 351: n=a, g, c or t
gctttgtaattggtgcagctctgagaacacacgcatgcattccaggcggtgctgctggggctcggcggggccgtgtctggtctgcaaggcgcgcgggctcgtggggggttggctggggagcccacgctgcctggcgactcgggccaccgaatgtgagaccgagtccctttatgtcaccagcgcacacgctgatttttgaaccctgcttcgacgtgtgtgtcatggcttaaaaatagctgctaatctgtcaacctgtcttgggcagaaacagcggcggcgacasagcaggagcgtcatggccgtggcgctgtctgcgcgggcgatccgctttcggactgaggcccagcgcantttgcaaagagcagcagctacctggcaactgaacccatcatcaccacagccactcctgcagctgccacggtttctgccacctcta

SEQ ID NO: 15164 - DNA, 533 bp, Homo sapiens
acagaaaggctaagtcacttcctcaaggaaaccaggataacaacagaatctactcccagcagtgttgtgaggatttggagcattgcgtaagggaaagcccgttgctgagtgcctggcacgtggggaagagtgggtggaagaacatgcttcctctcatcactgtgcccccatctgagaggtcgcatccgattctccagaaacaaggaagtagatgagaggccccaaacatcccatgctgttcccatctcgaggcctctgcacgtgcccttcttgtctgaaatgcatgcatctgtcctttctcaacatggccaaccccaacccatcttctaagactcggctcagccatcacctcccctgggctgcttgacttctgagctcccagagtaccctgcgtcacccagcatcgtccgatggaaagatctggcaagccacatcttcaaaatccaatgaactcactgcacatctcaagttggacaccagattttcatcggcacatgatctgtgtgctatcattatcatcatctctacagata

SEQ ID NO: 15165 - DNA, 254 bp, Homo sapiens
ataaaaaaaagctggccaccgaaacaccaagtgaggccatagcaattcccctacatcaaatgctcaagcccccagctggaagttaagagaaagtcacctgcccaagaaacaccgagtgaggccatagcaactcccctacatcaaatgctcaagccctgagttgccgccgagaagcccacaagatctgagtgaaatgagcaaaagtcacctgcccaataaagcttgacaagacaaaaaaaaaaaaaawtgcgaaa

SEQ ID NO: 15166 - DNA, 484 bp, Homo sapiens
ttatcaatagaaatgccgaatattataatttcatatttttatgtagttggtccatctgaaatgtaacaaatgcatcaagataagagtatatttatttgctagcagtgaagtgtttttaagtaaacggttggggagagttatgtaactgacactgttggcaaatgtaaggattgaaaacctttggtaataaaggttcatgtgggctgaatacagtggctcaggcctgtaatccaggcactttgggaggctgaggtgggaggatcgcctgagcccaggagtttgagaccaacctgggcaacacagtgagacctcatctctacagataataaaaaaaaaaattggttggctgtggtggtgtgtgcctgtgattccaggtactcgggaggctgcagtgggaggatcactcgagcccgggaaatcaagtctgcggtgagctgggatcacactactgtactccaaccttccagcctgggcagagagtgag

SEQ ID NO: 15167 - DNA, 351 bp, Homo sapiens
attggctgaaggcacttccgttgagcatctagacgtttccttggctcttctggcgccaaaatgtcgttcgtggcaggggttattcggcggctggacgagacagtggtgaaccgcatcgcgcgggggaagttatccagcggccagctaatgctatcaaagagatgattgagaactgtttagatgcaaaatccacaagtattcaagtgattgttaaagagggaggcctgaagttgattcagatccaagacaatggcaccgggatcaggaaagaagatctggatattgtatgtgaaagatgaggtattaatcccctccattgctctccaaaagccaataaagtgattacacccg

SEQ ID NO: 15168 - DNA, 294 bp, Homo sapiens
atcatctaatacaatgatggttgagtgaaaatacagaaggggtgtttgagtattcagatttcataaaacacttccttggaatatagctgcattaacttggaaagaagcctgttgggccagaagacagaaactccaactggcaaaaaaaagcaagcatctaagaaaaaaaaccaccaaagttcttgaatttactatatttaaatgcattggttaagtttattttgctaaataaagtgaactgctttttgtctctaaaatgatattctaaataaaaccttaactttttgttgaaaa

SEQ ID NO: 15169 - DNA, 140 bp, Homo sapiens
tcactgtggtgtccagcagcatccggsttcatggggggacttgaaccctgcagcaggctsctgstcctgcctctcctgstggsttttaccttstttttcctcctcaggtctccgtcctgtccaggcccaggcccagagcg

SEQ ID NO: 15170 - DNA, 478 bp, Homo sapiens
taaggccaggcacggtgggtcacacctatagtcccagcactttcagaggccaaggtaggaagattacttgagtccagaaatttgagatgataaatatccattggctaataattaaatgcatcatctatagttattgctgaacagatatgggcagcacagtgagaagatttcttgtctctacaaaaaaattaaaacaggccaggcgcagtggctcacgcctgtaatcccagcactttaggaggccaaggtgggcagataacctgaggtcaggcatttaagaccagagtgaccaacatggagaaacccattctctactaaaaatacaaaattagccaggcatggtggtgcatgcctgtaatcccagctacttgggaagctgaggcagaagaatcgcttgaactcaggaagcagaggttgcggtgagccgagatcgtgccaccgcactccagtctgggcaacaagagcaaaactatctcca

SEQ ID NO: 15171 - DNA, 416 bp, Homo sapiens
gcctcacacctcagccctgtgcctaaggacatctggctgtgcaatccatgttccggagtctcaccactgcatttttcagagacgccatgggcttcttattaatgtttgacctcaccagtcaacagagcttcttaaatgtcagaaactggatgagccaactgcaagcaaatgcttattgtgaaaatccagatatagtattaattggcaacaaggcagacctaccagatcagagggaagtcaatgaacggcaagctcgggaactggctgacaaatatggctgcaaattgagtacactgggaatcaacaaatttgatgaagcctgtctgtctcttcaccagtggagtgagtgcagcagttagaaagagaagcaatattgtgcaactggtgcagtggtgattttgttttcaaatgctcct

SEQ ID NO: 15172 - DNA, 437 bp, Homo sapiens
  misc_feature 281..282: n=a, g, c or t
atkatgssagaaatggactataagacctacttggrstttgtccttgcattagaaaacagaaaggaacctgcagctctacaatatattttcaaactgcttgatattgagaacaaaggatacctgaatgtcttttcacttaattatttctttagggccatacaggaactamtsmaaatccatggacaagawcctatttcatttcaagatgtcaaggatgaaatctttgacatggtmaaaccaaaggatcctttgaaaatctctcttcaggatttaatcaacdnnmatcaaggagacacagtaaccaccattctaatcgatttgaatggcttctggacttacgagawcagagaggctcttgttgcaaatgacagtgaaaactctgcagaccttgatgatacatgatctctgaaagactagactgtcttatattatgagat

SEQ ID NO: 15173 - DNA, 475 bp, Homo sapiens
agctgtttcttgaagctctgcataagcctcgcccgcggccgccgggttgcgtccgcacttctgcgcgctggcccctcccttgctcctctccctagcagtctccagggttttaccgggaggacctaggcaacggcctgagactccgagactctatgttgaagatgcctggactaacctactgaagatacgtggttttaccaacagccagcaccaataggaagatatgaatgaagccatctgagaccagccatctggcagccaaactgccaactgactgcaaatgcatgaatgatcccactgacaccacgtagagcacaaatgagttgcctccactgagcccagcccaaattgttatcctataaaatcataaaaacataaacagttgttttaagtcactaagttttggatagtttgttatacaacaaaagctagctgaaacaaatgtattagctagagcagctgtgaatggcactat

SEQ ID NO: 15174 - DNA, 508 bp, Homo sapiens
ttatagtagtttggattaatagatttaaggaggtatggtcaataatctcaaatgcctctcaagtgtgtttttgtattataagattttctaaataaaagtttctaaataaaacctaataatatttattttttaagagatagagtcttctattttgggagtggcgggtccggcagagagggatcttgctgtgttgctcatgctggagtgcagtggctattcacacatgtaatgatagtatactgcaactatgaactctagcaatgtttccagctcagcctcccacatagctgggactacaggtacatgtcaccatacctggtcataattattatttttaatgggaagcaatcgggagtcttcacttcttaatctgtctctgacattgttagctaatgtcaagtgacttcttccccaggtcatgttacctgtagtcccagctacttgggaggctgagacaggagagtcgcttgaacccaggaggcggaggttgcagtgagctgagatcacg

SEQ ID NO: 15175 - DNA, 487 bp, Homo sapiens
attctacaggaagcaattttttggttgtgaagggagaaatgggctcctcatggaggttcctgggctccactgaggaagagcccttcctcccagcagtgttgtataaagtagagaagataaatggatggagaacgcctgctccaagccggacgacgacattctagacatcccgctggacgatcccggcgccaacgcggccgccgccaaaatccaggcgagttttcggggccacatggcgcggaagaagataaagagcggagactaggccagaactgagcattttcaaagttcccgaggagagatggatgccgcgtccccttcgcagcgacgagacttccctgccgtgtttgtgaccccctcctgcccagcaacctgccagctacaggagccccctgcgtcccagagactccctcacccaggcaggctccgtcgcggagtcgctgagtccgtgcccttttagttagttctgcagtctagtatggtccca

SEQ ID NO: 15176 - DNA, 445 bp, Homo sapiens
agaatctgacattccaggactccactaggcctgttttcctctgtgggaactagagccaaggcgagagacccgtgccagccccgaggctcccggggcccatgggcaaggcggggctggtacagggccccggggctctctcagcccatctgtsayccctcccccccaacacccagatgtcccgtcttggcagtgctgtcccggactgccacattaatgctccagaacccgccagctgggccctggggcgggtggggctcctgcagagccttggacaaaggcgagggagggagggaaggggatcctaagcacccctccctccctggccctaggaggcagacatgcccgatgagatcaacattgatgaattgttggagttagagagtgaagaggagagaagccggaaaatccagggatcctgaagtcatgtgggaaactgtcgaggact

SEQ ID NO: 15177 - DNA, 478 bp, Homo sapiens
tttttttctgttagtgactaatcattggagacaaccatgtttagtatttgagcattggttaaatgctaaagaaaaatcgccgttaaagcagttttctttttcactgtctttttcttttcgcggggaaccagctgttcctgcgagggccacctcctcaggaagaccccgcagctctcccgcggcgcttctgcaggaggcagcgacagtttcgagaacccgggccttcccctcccagtgcctcccggggttccggcgtttcaggcgctgctgttttccgggaagggcaggcgcgctgggccttggggagctgcgctcggcgggcggacgcgggggatcatggaagctgataaagatgacacacaacaaattcttaaggagcattcgccagatgaatttataaaagatgaacaaaataagggactaattgatgaaattacaaagaaaaatattcaactaaagaaggagatccaaaagcttg

SEQ ID NO: 15178 - DNA, 312 bp, Homo sapiens
cctgttcattaagctcctgggcaatgccccgcctttaggcttcctaggacccattgtgaacctcagcgagcccamcggccatgaggggtccacagtgaccgtgagttgcatggctggggctcgagtccaggtcacgctggacggagttccggccgcggccccggggcagccagctcaacttcagctaaatgctaccgagagtgacgacggacgcagcttcttctgcagtgccactctcgaggtggacggcgagttcttgcacaggaacagtagcgtccagctgcgagtcctgtgtgagtcggtcaccctgac

SEQ ID NO: 15179 - DNA, 473 bp, Homo sapiens
caactgtaagttcagctcagggcttcctagcagccatgtttagcgaagtgtgatttttttttttaaacaaaaacaagcaaagatttggaagaaaatgctttagacctaactttacaattattataacataagatgttccagggtccttgaataaatgctgagttttagggaaatgattccaagggaccaagaattggtagaaataatttcaaggcagagaagactaattctacaggccgggcgtggtggcttatgcctgtaatcccacactttgggaggctgaggtgggtggattgcctgaggtcaagagttcaagaccagcctggccaacatggtgaaacctgtctctactaaaaatacaaaaaattacccaggcatggtggcgggcgcctgtaatcccagctacttgggaggctgagacaggagaatggcttgaacccaggaggtggagattgcggtgagctgaggtcgtg

SEQ ID NO: 15180 - DNA, 463 bp, Homo sapiens
  misc_feature 74: n=a, g, c or t
acgacagaccgtgtgtttccaaaatggcggcaggatggatgtggataccccgagcggcaccaacagcggcgcgngcaagaagcgctttgaagtgaaaaaggcatagaatgtcaagctaaccaggcgtccgctacttcagaagagtgtactgtcgcatggggagtctgtaaccatgcttttcacttccactgcatctctcgctggctcaaaacacgacaggtgtgtccattggacaacagagagtgggaattccaaaagtatgggcactaggaaaagacttcttccatcaagcttaattgttttgttattcatttaatgactttccctgctgttacctaattacaaattggatggaactgtgtttttttctgctttgttttttcagtttgctgtttctgtagccatattgtattctgtgtcaaataaagtccagttggattctggaacgaaaaaaaaaaaaaaa

SEQ ID NO: 15181 - DNA, 591 bp, Homo sapiens
tcctctgtccacgcctgttcccttcgtcgccgcggctctcgtccgggacacggctttccggagtagagcccttggaggtgttaagtgtgatgcttccataatacatttggatgctktcagctaagttcacttctgaactaaggggttcctccaaatgttggctgaaattcatcccaaggctggtctgcaaagtctgcaattcataatggagctactgtactggctattggaaggaggagattctgaagataaggaggtaaaacctgtttagaaattaaaaatgagttacgatttaaagaaaattcagatgactcattgtgagtgctagttctcttgtaggatgccactggaaatgttgaaatgaaaaatattcagccgttggtctttgaaatttcctgtgatgtgtttcaatctagatgcaaagaayatggaaaaatcaaagtgctcgagtggtttaaatatgttttgggtattcctgtttatagactataatacttttccaattaaaatcctcagttgtcacgcagaagaaggttaagctgtatttgattgccagttttactgaaaatgcttagtattttacagtatcac

SEQ ID NO: 15182 - DNA, 250 bp, Homo sapiens
aaagatggattttggagawgttgcctgggctggtcttgaactcctgggctcaagtgatccacccacctcagtctcccaaagcgctggaattataggcatgagccactgcgcccggcctaatttgactatttttgcgtgatgagtatgcagtggaatgtggcaaattttattttcagctacataaatggaatatttgactcgtatacaatctcttcccttagttgtgtgtgtggctttttttttttttggg

SEQ ID NO: 15183 - DNA, 377 bp, Homo sapiens
  misc_feature 233,323: n=a, g, c or t
acacggtgttgtcattggatgtgactttctgaagtggtgggcaattcttgttaatgttttaaacaaaaaaaaaaaccttacagtcttgccctgatttacacagcagtcacattcctggaaaattcaagtgtttattaaaactatgcaacagttactgtgtgttatacgttgaaaggtcttcactaatatctcactaagtaatgagaatgcctacatatcagaatttttttttncaggagccaagcacatatactgatttggaaaaaggcacaggtagctcagtttatttgctttctaccctgcctggccacttgctgtttctncagtttctaatttgagctgtaactacacaaggaaagctaaatagtctggaaaat

SEQ ID NO: 15184 - DNA, 454 bp, Homo sapiens
aaagtttctctagcaacaaaattccatcagaatcatagcagcttccagtcagatccaaatgctaataaccaactccaaaattactttttatcattctcaaatctgctttatttttttgcttcttttcccaatgtctcatctctctgttaatttactggtggctactctgacttttcaggctcaagaaagccacacatcttaatctgaccattatatcaatgtgtagccactcggctacacgtaagactgagaagtcttatggggtcttttttgctcaaagccttcttaaaatccatcttttatttttgagagtttaaaaacagtcattttttccaattctgaatttctggttattattttctttcactcctgtaaaccaaacaatagtttcctaaactcatctcttccttgactacatttggcaaggtaatgcaattacaatgaacacacacta

SEQ ID NO: 15185 - DNA, 376 bp, Homo sapiens
tgagtaccaagatgcattcaggcaagtttggtgttgcccaggcatcaggaatggtgctccggtttgagacatactgatgttcagacaactttgtagaaggctcagacaatgacaaggaattagtttctctgagaactggacctcactggcctgtgttgattgcagattttcatcagattgtttgcaatgccatttctcctcccaaatcatgtgagctgtaggggctttttagactttctgttgtggggacctctctttgaaatggaccgtttctatcctagtttcttggcccttatgaaatactatcactggtttgagatagtgcaaacctttgtkaaatcaagatggtcagattttagcccaagagttaaatcat

SEQ ID NO: 15186 - DNA, 436 bp, Homo sapiens
caatcctggcctttcaggctgctgagaagttatacttactgaggagaaggatagaacatttaagagaaggtattggtctgatttataatttttaaatatttagatttaagggtgagtggacaccagcctccaccaatatcaagagtgtgtttggcctagaccctaggagatattcaatatttatcaaatagatggatgaatctcatttaatttaatcctcacacagactcaacggagggaaatcacatcgtctgtgctttattgatgagggaactaaggcttggagagatttaatgactggcctatttgtcaagttagaagtttgtctagcagagctgagagcctcaagccctaacgtgtctgattccaaaatccattgcaattggttcatgacaagttcactcccattatgaccacattaaatatattataactg

SEQ ID NO: 15187 - DNA, 382 bp, Homo sapiens
atggttttaggcctaggcagggattagattttatctcagattttgctaagagtatttcttctggagactagcaggctgctagtaagawttgatagaattggctctgtgtcactgggagaactggagttgaagggttacaggagatgagtcctggagaaggggaggcagggacaagggtgccaggaagctcaggggatgaaagggaaatggagagtccagtgagagaaggctggtgaggtgtagagagtggccagacacatgcctgacagttgggaccacttctctatacaaatcwggaggaggcgaggtaggcaggatagttcagagtttgtgggaaggaacctgacatctgaagtcagtggagtgtgtcttgggctgctgc

SEQ ID NO: 15188 - DNA, 494 bp, Homo sapiens
tttctaagccagttttctgttccatagaatggaaggtattcattttataggtggttaggcaggctaagtgagaatgcgtgtaaaagcacacagctgaataccagacacattcatgacaaacactcagatgtcatccatctatcttcattaaatatttgaagctgatcttattaaacactttgattcccaaagtcaaaaccaagcctagacctgatcaccttaaaacacttttggtataaggscggattttaattatcaaatgagactgtttctccaaactattgccagtctctttctccctacttctctttttttctcctatcccgttcaaatgaaaacatatatgatgtagaactagtatttgtgagagaagaaaaataccatcatttttattcttttccatttctatgtgtttctgttctgatctcttttaactcatttaatattcaagatcatttctacttatacacagacctttctacctacttgacccc

SEQ ID NO: 15189 - DNA, 521 bp, Homo sapiens
aatggactcattcagccccaggtttgaattttttctagttttcacacacacacacacccacaaaaaggcataatacctgtaagaaggaaagcagtcctctagaattgaagtgtttgaaaaaaagctatgagctcaatgttttggaggaaatcccttctatagcagtggaaagaaggcagctcactttggagtaagtgtggatagaactggaaataggagatatgggagggacaagagaaggccaataatctatgagtttatgtcctcagctttgaatggtaggaccgtatctgctattcagtttttgaaatacagctgtgccatgtgcactgaaccttcacactgggactcagctgccatgcttcaccttgggtataatgatgacagaggttgagaaaggtgactccctccattgatgtatttcgccatgattacctcccaccaaatgatactaatactcctgaaaatacttaacatttataaaatgtttattttctgattcatgtcaaaaaaaaaaaaaa

SEQ ID NO: 15190 - DNA, 503 bp, Homo sapiens
agtgctctttcacactgtcatgggctgcactctggtcattctttattcagggaaaagcacacaatcgtaaacaacggagagtgaagacagtaacaactggtttgatattgaatttttaaaatcttgattcaaatggaattttcataatctaccacttaaaatttatttttaattagaagaaaactatgtaactgtgaagagaagcacatttcagcctctcagtcagccccaccgtgcctctgcttcacatccaggaagaagggagtcctcggggcagccaccaaatgcaaggacagagagtccagagaataccacttggcctccaggtgcatgccttccaagtctactctgcagacgcaaatgtcatgtgggtttttgccaaaatctcaatggaaacatttctatttgctttaatttatttttaaagtcaaacaccacagttcaggatgtggaagaaatatgaagtcagtggatgaagatcttgcttctaccagcttatgatc

SEQ ID NO: 15191 - DNA, 433 bp, Homo sapiens
ttttggtccctaacgcttggctacagccagtgctctttcacactgtcatgggctgcactctgggtccttcagaagacctgcaaggrwggaacgcagatgtcagcgtctactggggaaagaaccaccactggaaaagcacacaatcgtaaacaacggagagtgaagacagtaacaactggtttgatattgaatttttaaaattttgattcaaatggaattttcataatctaccacttaaaatttatttttaattagaagaaaactatgtaactgtgaagagaagcacatttcagcctctcagtcagccccaccgtgcctctgcttcacatccaggaagaagcgagtcctcggggcagccacgcaaatgcaaggacagagagtccagagaataccacttggcctccaggtgcatgccttccaagtctactctgca

SEQ ID NO: 15192 - DNA, 567 bp, Homo sapiens
atttttcatagagacatggtttcaccatgttagccatgatggtctcgatctcctgacctcgtgatccacatgccttggcctcccaaagtgctgggattacatgcgtgagccactgcgcccggctagttttctctttttgtcgtgtctaccttcctacttgcctcacaccagtcagttggctttctgtgtcaagcctgaggaatgaatctcatgaaagagcattgggagagcggagattttggaaattgctttcagaacacaaaatcccacatgcgtgggcttgttccctgcaagcttaatcttgcctgatgtatatgtgtacatgtggaaggctgaaggaagtgctataaatgccccattcgtaagtattcagccatcgtgtgctgaaasctgccgtctgccggacactgaaatgtggccttcacaggccgagggtctttaagaagcatggccgtgggggctgagagcagggtggggtgacaggacaggttactgagactgaattttgtctgaagagtagggagagctgtagtggttcccctttgctggttgttggtttttgtgtgc

SEQ ID NO: 15193 - DNA, 215 bp, Homo sapiens
atcgcttctcggccttttggctaagatcaagtgtaktatctgttcttatcagtttaatatctgatacgtcctctatccgaggacaatatattaaatggatttttggagcagggagatggaataggagcttgctcgtccactccacgcatcgacctggtattgcagtacctccaggaacggtgcaccccctccggatacaaaaaaaaaaaaaaaaa

SEQ ID NO: 15194 - DNA, 264 bp, Homo sapiens
aaaatcccagccaccgccgccctgtttggcgtctctgatggagagctgagcttcctgtgtcctcggagcctgcagggatcagcacccgccacggtagctcccctttcccgcctgctctgctggatgctgggtttcagtccaggtccttcgggcgccctggaaccctcttcccctccccgacctgggcctgtcatgggccactttagggccctggatggcggccctgctccctggcgccgcatcagccatccgtggcagactccc

SEQ ID NO: 15195 - DNA, 451 bp, Homo sapiens
tttctattgtagttccatttgtgaagattgtgactttttgtttattagctataatttctacacttgtaaggcttacaaacaagttaaaaagaaaattgcaaataacatttgtccctttcagtcttcacctagttgtgtaattattttaattcactttgcctttgcagaaatttgggtattttctttgtagtgctattgagtctcatctggaaagattatataaattgcattctccttgcttatgtgggtagaatgggagaagaaggcaagacaaagtatacttaaattctatgcatatttctgttatgctttctgttttttttagttgattctgaaatgaatatgccctattcttttgaaagaatggccttttagttgtatagccaaagacatttagtattttccggttccttaaggtattactgtaccattttgtaaaaggaatattata

SEQ ID NO: 15196 - DNA, 368 bp, Homo sapiens
acttttacgtcggccttcgcgagcgtctgggcgggtggtaggaacaatggcgctgtcttaagtggcacagtggagcagctctgaagatgcaaagatacacgaaaaaacttccagaacatctgggagaatatttaatggaaaatcgcttggttaaaacctgacacttttaacagtgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttgaaaaaaaaaaaaaaaaag

SEQ ID NO: 15197 - DNA, 302 bp, Homo sapiens
cttttacgtcggccttcgcgagcgtctgggcgggtggtaggaacaatggcgctgtcttaagtggcacagtggagcagctctgaagatgcaaagtgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttgaaaaaaaaaaaaaaaaagsctttttttttttt

SEQ ID NO: 15198 - DNA, 459 bp, Homo sapiens
acttttacgtcggccttcgcgagcgtctgggcgggtggtaggaacaatggcgctgtcttmagtggcacagtggagcagctctgaagatgcaaagatacacgaaaaaacttccagaacatctgggagaatatttaatggaaaatcgcttggttaaaacctgacacttttaacagtgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatttagttgaatccatggacatgaaacccacagatatagagggttggcccggtgcagtggctcacgcctgtaatcccagcactttgggaggccaaggcgggtggatcaccttaggtcaga

SEQ ID NO: 15199 - DNA, 431 bp, Homo sapiens
cttttacgtcggccttcgcgagcgtctgggcgggtggtaggaacaatggcgctgtcttmagtggcayagtggagcagctctgaagatgcaaagatacacgaaaaaacttccagaacatctgggagaatatttaatggaaaatcgcttggttaaaacctgacacttttaacaggtatgtgttgttttagtactttatgattgagcatagcatttaatccacacctagactaaatcaaattttttttgtcagtgaacagcgttctgagtgtggacgagtagccagtgaagataatgaatgtcgaatgtgactgactagcagcttcattttgaagtaggttgtatggcttaaaagttctgtagtatttgtactataatacttgccttttagcattaccttggtttgtagtcagtgtcacagaagtgcagtttta

SEQ ID NO: 15200 - DNA, 460 bp, Homo sapiens
aamactttttttacgtcggccttcgcgagcgtctgggcgggtggtaggaacaatggcgctgtcttaagtggcacagtggagcagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttggawaaaaaaaaaaaaaaaaaaac

SEQ ID NO: 15201 - DNA, 464 bp, Homo sapiens
ctttttttacgtcggccttcgcgagcgtctgggcgggtggtaggtgagtgggtattgcgggctagtatccgagcaaaagatggtggcgcaggccgagttaagagctttaatcctgtgaagacatcttagtgaagagtttagagtgctgagagttgaaagcttgcacgtgggaaacgtgcggccggactgccacatgtactgaggttgagtcgtgacggccacaggctccgaattttggcgtgaggaaccgctgatcggccacgggcgccgaacttgctggcctccggcatgtgcctgagcggcggcggaaaaaccaccttaattggggcggagggttagttttaagagcaaagggcctttactaaaatggcgaaggccttccgtcggcgttgttttaaaatgggaagcctcgaccctgtattgaaactgagctgttcgaaggcggcgttgtgtgcaattcggat

SEQ ID NO: 15202 - DNA, 496 bp, Homo sapiens
ttttctttttttacgtcggccttcgcgagcgtctgggcgggtggtaggaacaatggcgctgtcttaagtggcacagtggagcagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttggattatgttcctttttgttattacttttaaataggtcctgaaataacatggggagcatt

SEQ ID NO: 15203 - DNA, 397 bp, Homo sapiens
cttttacgtcggccttcgcgagcgtctgggcgggtggtaggaacaatggcgctgtcttaagtggcacagtggagcagctctggaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctggctagtgccacgaggtttacttgactgttgtgtgaaaagctgataagaaaaccatccaaaaaaaaaaaaaaaa

SEQ ID NO: 15204 - DNA, 394 bp, Homo sapiens
cttttacgtcggccttcgcgagcgtctgggcgggtggtaggaacaatggcgctgtcttaagtggcacagtggagcagctctgaagatgcaaagatacacgaaaaaacttccagaacatctgggagaatatttaatggaaaatcgcttggttaaaacctgacacttttaacagtgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttgaaaaaaaaaaaaaaaaaaaaaaaaaawwwaaaaaaaaaaaaaaaa

SEQ ID NO: 15205 - DNA, 436 bp, Homo sapiens
  misc_feature 414..415,421: n=a, g, c or t
ctttttacgtcggccttcgcgagcgtctgggcgggtggtaggaacaatggcgctgtcttaagtggcacagtggagcagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaannaaaacngtawtttgaaaaaaa

SEQ ID NO: 15206 - DNA, 435 bp, Homo sapiens
cttttacgtcggccttcgcgagcgtctgggcgggtggtaggaacaatggcgctgtcttaagtggcacagtggagcagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttaaaaar

SEQ ID NO: 15207 - DNA, 448 bp, Homo sapiens
aaaatcccgctgcagccattgccgcagacacgatgccgaaacgaaagaagcagaatcatcaccagccaccgacacagcagcagcccccgctgccgagcgggaagagactggagatgaggaggatgggagtcccatcggaccacccagccttctgggcsctccccccatggccaatggaaaacctggcgaccctaagtcagccccaaactggataccacccacatgtccatcatcagtagaatggataaataaattgttgtgtatgcatgcaatgggactacactgcaacgaaaatgaatgaactgctgctacaggcaacctggatgaatctcacaaacatgatgttgagcgaaaggagccagacataaaagaatgcagactctcttcacagaggtcctccaggatcaaggggaccactgattccaccactgctgagtctcccacctcc

SEQ ID NO: 15208 - DNA, 437 bp, Homo sapiens
cttttacgtcggccttcgcgagcgtctgggcgggtggtaggaacaatggcgctgtcttcagtggcacagtggagcagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttgagaaaaa

SEQ ID NO: 15209 - DNA, 435 bp, Homo sapiens
cttttacgtcggccttcgcgagcgtctgggcgggtggtaggaacaatggcgctgtcttaagtggcacagtggagcagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaatttcgaaaaa

SEQ ID NO: 15210 - DNA, 435 bp, Homo sapiens
cttttactcggccttcgcgagcgtctgggcgggtggtaggaacaatggcgctgtcttaagtggcacagtggagcagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttgaaaaaa

SEQ ID NO: 15211 - DNA, 474 bp, Homo sapiens
attctactgacattctctacctttgacttactgatgagttaaggaaggactgaagacaaaagaaactatgggctgctctctctttccctttctttctatgtcaccattttcacttaagtggttggtcgatacaaggaattaacactaatgctatgtgcaaatgggataggaagaaatggcagcatgcattatgcacacctctcatctgctcagacactcccttgcaccatatttgcttgtctaatgatgtacttgcttagaagttccaggggctaatcttgaaataaaccaggcatagagatccagttgtggaagtctcccccacctagaaattgcctcaaggtggttaatctacaacccaaccattgtcaaaatggccccagttcatactacaggtggacaacaactcaagatagccattggagcaagatatgccgacctccatcctgcaccactcccacatgcttcccatac

SEQ ID NO: 15212 - DNA, 509 bp, Homo sapiens
  misc_feature 482: n=a, g, c or t
aatgctctgggcaatcccacaaagcgaccacctggcccatatctggcatgactttcatgtcccgccagacattcaaggaatccgactatgttttctatataaacatatagtatttttcacatctgaaaatatacactgaattttccaggactgtgtataaatagaggtttggaagktgagaccagagagctggcacatcggtctctaggtcatgtactggatcatgaaacatctgatggcttctgactcccagtcccctagtccctctgttgaaccatagctacctctcagtggaaaactaaaaagaaacacaccatgtaacttgattaattatccttcctgctgtgactgctagccaacgtgccttttagttgttttgcttatatctgttgccacatgaaaattggaacatatggtctggagggccaagatggtattctaagaatatctcataccctgcatgaaactagaccaaagaaganaggtagagaaacagagaggattgacaa

SEQ ID NO: 15213 - DNA, 490 bp, Homo sapiens
aaaatgttgaagccctgagtcttcagggaagactgttctttttcactagaagaatctcacatgctccaggtattatatgaggttctaattcctactcgtttattgtaaaaatcctggagaaagctcattgatgtaacaataaaatatgaatttttccctttaatgcagccctgtaaaacacatcctcaaacctcatgtcatccaatataccttttgtattttttcttataattcatgtgtatgaatgcatagagctgctttttttaaatgaaaaaatacagaatttcacggtctttttggatttcttttaaggcctttcagtatatccaagctgaagtaacatctatgcattgttttgttattatggtaataacaagttctagtttataataatatatagtacttttttgggactaggagcaatgatatactgctttttagtaactggtaaatagtatgtttttgtctatttgaactagaaatgagaagg

SEQ ID NO: 15214 - DNA, 472 bp, Homo sapiens
aaaacaatgctctgggcaatcccacaaagcgaccacctggcccatatctggcatgactttcatgtcccgccagacattcaaggaatccgactatgttttctatataaacatatagtatttttcacatctgaaaatatacactgaattttccaggactgtgtataaatagaggtacaagaatctgagcctcccttgtcctttagtgcaatcaagcagagtatccacatactgaaatacacaacattttctgattacaaaggcccaggaatagctagttagcttgccctggtgtcactgctcactcctgtgaagaataaggataaaccatgaggatagtagtggtaatggtgaaacagaaagaacacagaaagctgattctagagtagggctatctaatagaaatatcatgcaagccaccaattggagccacatatgtggtttacatttggaagtagctacattttaaaaagta

SEQ ID NO: 15215 - DNA, 461 bp, Homo sapiens
aatgctctgggcaatcccacaaagcgaccacctggcccatatctggcatgactttcatgtcccgccagacattcaaggaatccgactatgttttctatataaacatatagtatttttcacatctgaaaatatacactgaattttccaggactgtgtataaatagaggtttggaagktgagaccagagagctggcacatcggtctctaggtcatgtactggatcatgaaacatctgatggcttctgactcccagtcccctagtccctctgttgaaccatagctacctctcagtggaaaactaaaaagaaacacaccatgtaacttgattaattatccttcctgctgtgactgctagccaacgtgccttttagttgttttgcttatatctgttgccacatgaaaattggaacatatggtctggagggccaagatggtattctaagaatatctcataactgcat

SEQ ID NO: 15216 - DNA, 406 bp, Homo sapiens
catataataatattgttaataaaatgtatctaaaattcataccaccagcacacaaggtctccggctagcagcagtaaatggcatttagtacttacttagcccccaagcctggatgactgactatactgacttattattacttttagctatttgtaggtagttacatctgaaaattgaccaggcacagtggttcatgcctgtaatctcagcactttgggagaccaaggcaggaggatcagttggggccaggaatttgagaccagcatgagtaacatagcaagaaccatctctacaaaaaataaaaattaaccaggcatggtgatgcatgctacttggggggccggggtgggaggatcgcttgagcctgggaattagaggctgcggtgagctaggaaaggtgccactg

SEQ ID NO: 15217 - DNA, 469 bp, Homo sapiens
gatattattgtatttctttgttctgcccacttggactttcctgatttcacatttgtaattttgactacttatgagtgaacttgtatcactccgggtagcactttggatgaggcatgaaatttcatttcatgagttgtgtgcttaatctttgagaaagaactttcagctaatgtgtgagtcaactctagctggccattcaacatcaacatctacatgatatgactgtttttacactgcaggcacttctaggaaattgtgtgtgtttatagtgtgctcaaacacatacttatagtgagcatttgttgttttattatttccagcatcctcccatagcctgaaaacagaactcgaactttgctttggaggaaccatttttaatcacctttcatgatatatataagattgacctcatccccaaattttaaagtgggaattgattagcttaagtcctcttgtgatctctccggcc

SEQ ID NO: 15218 - DNA, 460 bp, Homo sapiens
gggatccgtctgccctagaagagggggcaaggaaggaaaacaaagctgcaagcactgaagaatattaacaagagaataaggttgccagatttaacaaataaaaatataaaacgccggccagcttttcactgtgcccactggtcaccccttgctgggcctccaggggtctcagtaaggctggcccaggtacctgctgccctgcctggaacccacctccctaagaatcctgactgctccacaggaaccatgggctcctcagagaaatggctgattctaggactggggcaagaaatatacaagataaatctacataaaggaagtgctaaaaaaaatctccaaatcctacattaaagggacacaggagccaactggaagagctcccaacggccaaagccagaacaacttgagaaacaaaataaagtagggtcgagtcatgacccataatgaaaaaaaaaaaaaa

SEQ ID NO: 15219 - DNA, 519 bp, Homo sapiens
aaagaagaaggaagccaaagtatctgatgcactggagaatgaaaacccgttcaaaatcagaagtatagagaagttttctgtaaaatggaaatgagtatcatgaagttttaaatgaacagtgtaaaacagaagacatcagcattcattaggtcccagacctctttgagaatctgatgaaattctggacaacctctcctcccacaaacaagatgtacttgaatacctacacataaaatgttgcattcaattttggaatgtgaagagatcatttgaagccgatccagaggcctctaaggacttgactggtgcagtattggtggctgctgggtcagatgagctccctgctattccaagaaacaatacatgtttgcagccactaagatttgaggacttttgttattactgcctatcctgacagactcaggtgctacaactatttaagggctgaccggatctcactctggcacctagactggagggtactggcatgaactcctgggctcagatgtcctcccacct

SEQ ID NO: 15220 - DNA, 544 bp, Homo sapiens
attttcccagagcgagaggcagtgacactgagcgggcgcagggggccgagtcggagaccgtgccggagttcgggagcggcaacagagtggggcatagacactccgagcagcctcgccgtcgtctctgcgttcctgttgactgcctggctgccccctcccctactcctcggttcctggtgaagaggctgcgcgctgctgtttggggagggggtgtgtggagccgggtcctgtgtccgcagtggctgctgtcggggggtcgcctgttcgcggaggtgcggagagactccttgggggtcgagcacataacggggttcgggtgtctcgtgtgtgaacatcacagggtttgtggatgcacttagatgtttgcaatgagcactgtggctggcatgccccagtgttttggataccaatgcataggactccatagtaatcgaatttaccagaggcgaacgtcatgagcatagtgatcccattgggggttgatacaagcagagacgtcatacttggaaatggctgcaggttcagagtaagtattttaaattgg

SEQ ID NO: 15221 - DNA, 349 bp, Homo sapiens
  misc_feature 174: n=a, g, c or t
attttttcccagagcgagaggcagtggctgctgtcggggggtcgcctgttcgcggaggtgcggagagactccttgggggtcgagcacataacggggttcgggtgtctcgtgtgtgaacatcacagggtttgtggatgcacttagatgtttgcaatgagcactgtggctggcatnccccagtgttttggataccaatgcataggactccatagtaatcgaatttaccagagkcgaacgtcatgagcatagtgatcccattgggggttgatacagcagagacgtcatacttggaaatggctgcaggttcagaaccagaatccgtagaagctagccctgtggtagttgagaa

SEQ ID NO: 15222 - DNA, 556 bp, Homo sapiens
gtgtcatgagaatgtaagtcttttttctactttaaaatttagtaggttcactgagtaactaaaatttagcaaacctgtgtttgcatatttttttggagtgcagaatattgtaattaatgtcataagtgatttggagctttggtaaagggaccagagagaaggagtcacctgcagtcttttgtttttttaaatacttagaacttagcacttgtgttattgattagtgaggagccagtaagaaacatctgggtatttggaaacaagtggtcattgttacattcatctgctgaacttaacaaaactgttcatcctgaaacaggcacaggtgatgcattctcctgctgttgcttctcagtgctctctttccaatatagatgtggtcatgtttgacttgtacagaatgttaatcatacagagaatccttgatggaattatatatgtgtgttttacttttgaatgttacaaaaggaaataactttaaaactattctcaagagaaaatattcaaagcatgaaatatgttgctttttccagaatacaaacagtatactcatgaa

SEQ ID NO: 15223 - DNA, 544 bp, Homo sapiens
gaagatttttagaaaaaaataaagaaaaagattttagagccacagaatctctttttagagtatgggaagaacagaaattctctgggtagagcaatttttgacagaagatgatttgggtttatatgagatatacaaaactattcttacgcatttttactgcatgccacaacttgggatttcttagtattttccacatcaaccacactactttaagtcgtctggttagaagtgtatgaacatgttataagctcagaaaatggcatgtaaaagcaatagagggccaggtgcggtggctcacgcctgtggtgccagcactttgggaggccgaggtgggcagattgcctgaggtcaggagtttgagaccagcctggccaacttggcagaacctcatctctactaaaaatacaaaaattagccgggcattatgacgggcacctgtagtcctagctactcaggaggctaaggcaagagaatcacttgaacctgggaggcggaggtttcagtgagccgagatcttgtcactgcactcagtctggcgacagag

SEQ ID NO: 15224 - DNA, 494 bp, Homo sapiens
aagaagaggctgtgcttcggcgctccggctcctcagagagcctcggctaggtgtggaaacaggaagagaactagaactggaagtaaagcattgaagatgtgactgaattgctgcaatctcatgatcaaatttgaatggatgaggagttgctttttagggatgagcaaagttgctccttgagggcaggacagttcttatggctttatccgttgcgtaasacagagaggtctgcgaggtcaaaactattgtcatgatagcaagatgcctgtctttttcatttattctcacggtgtgcagaggctacatgatgtgtgatgacatcctcattgatgttaatgaatggtgctatacttgaattttctaaggtgtcattaggtaggtttaggtatgcatacttgtttttagaaattatttttttcctttttcccatttttagaaatcaactcattttttaggttatgccttcagtaatctttgcaacctcaatattgtgt

SEQ ID NO: 15225 - DNA, 484 bp, Homo sapiens
aagagagcctcggctaggtgtggaaacaggaagagaactagaactggaagtaaagcattgaagatgtgactgaattgctgcaatctcatgatcaaatttgaatggatgaggagttgctttttagggatgagcaaagaaagtggtttctcgagatggaatctactggtkgctccttgagggcaggacagttcttatggctttatccgttgcgtaasacagagaggtctgcgaggtcaaaactattgtcatgatagcaagatgcctgtctttttcatttattctcacggtgtgcagaggctacatgatgtgtgatgacatcctcattgatgttaatgaatggtgctatacttgaattttctaaggtgtcattagcaattctcctgcctcagcctcctgcataactgggactacagggaagcaccattttccacaaaactctcaagaaggacttgttgcaaactggaaaagcaattaaatgtgaatc

SEQ ID NO: 15226 - DNA, 86 bp, Homo sapiens
aattttttaaatgtgtgtttgtgggtgaaatggctgcgcaggtcggagcggtgcgcgtagtactggcggtggcggcgcaggaggag

SEQ ID NO: 15227 - DNA, 417 bp, Homo sapiens
aacttcacctccggttctaggtgtcatggctgccccaagagtctaggtaagagtttgttcccgtggtgcggagggtcaaggcccacacccggaaacctagcgaggtaaagttgcgtcttggttgtagagacgacaacttctccgcttcctcggcgatggcggcgtccgggagcggtatggcccagaaaacctgggaactggccaacaacatgcaggaagctcagagtatcgatgaaatctacaaatacgacaagaaacagcagcaagaaatcctggsggcgaasctkggactaaggatcaccattactttaagtactgcaaaatctcagcattggctctgctgaagatggtgatgcatgccagatcgggaggcaacttggaagtgatgggtctgatgctaggaaaggtggaatggtg

SEQ ID NO: 15228 - DNA, 523 bp, Homo sapiens
cattttatgtcacaagagccttagggaagcttagattttcaggcatctgtggtatgaactttacagattattgatacataacgccaaatggctttccagagaatctacagcagaataaccatgctgatagcgagcagccttatctccttcctgtcaggcctctgagcccaagccaagccatcacatcccctgtgacttgcacgtatatacgcccagatggcctgaagtaactgaagagtcacaaaggaagtgaatatgccctgccccaccttaactgatgacattctgccacaaaagaagtgtaaatggccggtccttgccttaagtgatgacattaccttgtgaaagtccttttcctagctcatcctggctcaaaaagcacccacactgagcaccttgcaaccccaactcctgcccgccagagaacaaaccccctttgactgtaattttcctttacctacccaaatcctataaaacagccccacccctgtctgcctttgctgactctcttttcggactcagc

SEQ ID NO: 15229 - DNA, 511 bp, Homo sapiens
ttaaggacctgtcgccttcgaggtcgtgttgatctttttgtcctcttattttttcctcctctttcctctaattgctcagagtgggccgtgtcccccctcttcccactcccccgggaagatcccctaactctgcgcggatgtttgtaactcaccaaccctcgcacacagatacacatactccattcctgactgccgcgctgcaactacagctcggtgcctcctgaggctgctcggggacccaagcactggagcctcaggactcagtgctcagcctcagcgcctggcctgggtgctcagctgcctggacgcgaccgcagctgcccgaccctgcccccaccacccccaagtctcacttttctgagcaagagaagaacggttgccccgctggccccttttgtgccactgggcgagggctaaaatccctcttacggagaaagccgagtttcagtaattgctcagctcccctcataatcacactatttggttaaggctttgctgttctggagcgact

SEQ ID NO: 15230 - DNA, 348 bp, Homo sapiens
ttaaggacctgtcgccttcgaggtcgtgttgatctttttgtcctcttattttttcctcctctttcctctaattgctcagagtgggccgtgtcccccctcttcccaccacccccaagtctcacttttctgagcaagagaagaacggttgccccgctggccccttttgtgccactgggcgagggctaaaatccctcttacggagaaagccgagtttcagtaattgctcagctcccctcataatcacactatttggttaaggctttgctgttctggagcgactgctcagttggcccgattggtctatgattagacttttttatttagaaattaaaaaataaattctactcc

SEQ ID NO: 15231 - DNA, 517 bp, Homo sapiens
aacttcacctccggttctaggtgtcatggctgccccaagagtctaggtaagagtttgttcccgtggtgcggagggtcaaggcccacacccggaaacctagcgaggtaaagttgcgtcttggttgtagagacgacaacttctccgcttcctcggcgatggcggcgtccgggagcggtatggcccagaaaacctgggaactggccaacaacatgcaggaagctcagagtatcgatgaaatctacaaatacgacaagaaacagcagcaagaaatcctggcggcgaasctggactaaggatcaccattactttaagtactgcaaaatctcagcattggctctgctgaagatggtgatgcatgccagatcgggaggcaacttggaagtgatgggtctgatgctaggaaaggtggatggtgaaacatgatcattatggacagttttgctttgcctgtggagggcactgaaacccgagtaaatgctcaggctgctgcatatgaatacatggctgcatacataga

SEQ ID NO: 15232 - DNA, 300 bp, Homo sapiens
atatcacgctgtactctagctaaggactgggaagcaagtctatccaaggctccttcatgtaaccacgcggcagttggcaggcactagtcctagacaactgagttctccctgaagaagagttaaagcaaaataaaaactcacaaaaaggaaaacaacacgaataaaaagaactagcatgggacctaaaggacgttgctgaacaaggaaaagagcccatcaggtagaagacccagaggaacaccaggcctctgaaaactatttctgaacctaaaataaagatatttagaaaactgaaaaaga

SEQ ID NO: 15233 - DNA, 398 bp, Homo sapiens
  misc_feature 299: n=a, g, c or t
atcacgmwgtactctagctaaggactgggaagcaagtctatccaaggctccttcatgtaaccacgcggcagttggcaggcactagtcctagacaactgagttctccctgaagaagagttaaagcaaaataaaaactcacaaaaaggaaaacaacacgaataaaaaagamctagcatgggacctaaaggacgttgctgaacaaggaaaagagcccatcagctctggaggctggaaaatccaagatcaagaccctgggagattttttgtctggtgacggctgctttctgcttccaagatdntgttttcttgtggtgccctcacagggtggaagcaacagaagtgccaggcagctctctgaagcctctgtaataaaggctttaatcccatcaaaaaaaaar

SEQ ID NO: 15234 - DNA, 389 bp, Homo sapiens
atcacgctgtactctagctaaggactgggaagcaagtctatccaaggctccttcatgtaaccacgcggcagttggcaggcactagtcctagacaactgagttctccctgaagaagagttaaagcaaaataaaaactcacaaaaaggaaaacaacacgaataaaaagaactagcatgggacctaaaggacgttgctgaacaaggaaaagagcccatcagctctggaggctggaaaatccaagatcaagaccctgggagattttttgtctggtgacggctgctttctgcttccaagatggtgttttcttgtggtgccctcacagggtggaagcaacagaagtgccaggcagctctctgaagcctctgtaataaaggctttaatcccatcaa

SEQ ID NO: 15235 - DNA, 338 bp, Homo sapiens
agttgtttccgggaagcgggactccaaatgggtcgcagtcgcggccgctctccacggagggaacgtaggcgttcccggtccacatcccgggagagagaacgcaggcgccgagaaaggtccaggtctcgggagagagatcggagaaggagccgctcgcgatccccgcaccgaagacgctcccgatctccaagacgacatagatccacatctccttccccttctcgactgaaagaaagaagagatgaggaaaagaaagaaacaaaagaaacaaagagcaaagaacggcagattactgaggaagacttagagggcaaaacagaggaagaaatagaaatgat

SEQ ID NO: 15236 - DNA, 311 bp, Homo sapiens
actcttaagaagggacggggccccacgctgcgcacccgcgggtttgctatggcgatgagcagcggcggcartkggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaatcacacctaaaagaaaacctgctaagaagaataaaagccaaaaaaaaaaaaaaaaaagct

SEQ ID NO: 15237 - DNA, 514 bp, Homo sapiens
ggataggccgagttccgggcgcgaggcggccaccgtggagagcagagcgcggcggctggaagctgctaagtcagagccgcgatgttccggattgagggcctcgcgccgaagctggacccggagagatgaaacggaagatgcgcgaggatgtgatctcytccatacggaactttctcatctacgtggccctcctgcgagtcactccatttatcttaaagaaattggacagcatatgaagacaggacatcacatatgaatgcacgatatgaagagcctggttacagtttcgactcctctctgcaagtgaataggcccagaaaggtgtaagagactctttgaatggacataaaattctgcttgttaagaacaagtttggctctggtaactgaccttcaaagctaaaatataaaactatttgggaagtatgaaacgatgtctcgtgatctggtgtacccttatccctgtgacgtttggcctctgacaatactggtataattgtaaataatgtcaactc

SEQ ID NO: 15238 - DNA, 442 bp, Homo sapiens
ggataggccgagttccgggcgcgaggcggccaccgtggagagcagagcgcggcggctggaagctgctaagtcagagccgcgatgttccggattgagggcctcgcgccgaagctggacccggagagatgaaacggaagatgcgcgaggatgtgatctcytccatacggaactttctcatctacgtggccctcctgcgagtcactccatttatcttaaagaaattggacagcatatgaagacaggacatcacatatgaatgcacgatatgaagagcctggttacagtttcgactcctctctgcaagtgaataggcccagaaaggtgtaagagactctttgaatggacataaaattctgcttgttaagaacaktttggctctggtaactgaccttcaaagctaaaatataaaactatttgggaagtatgaaaaaaaaaaaaaaaa

SEQ ID NO: 15239 - DNA, 394 bp, Homo sapiens
actatacctgagtgaagtggagacaccgaacgctcgggcccagaggcttgctcggccaccgctcctccgggacttatgtacatgggatacaaatttgagcagtacatgtgtgcagccgcctgggaagccaccctctgctcttctcaggggaggtagactgcacagacccccaagccccatccacacagcccccaacctgctatgtggagctcaagacctccaaggagatgcacagccctggccaatggaggagtttctacagacacaagctcctgaaatggtgggctcagtcattcctcccaagggtcccgaatgttgttgctggcttccgtaacccagacggtttgtctcttcctcaagacctttcctaccatgaagatgtttgaatatgtca

SEQ ID NO: 15240 - DNA, 475 bp, Homo sapiens
atcatagatgtcctaatgtagcacgggtaaacaagcctactgcactgccagtcatgtaaaagtatagcacatataattatgtacagtgcataatacttgataataaataactatattactggcttatttactatactatactttgtatcattattttatagtgtactctttctacttatttaaaaaaaaaagattaactgtaaaacaacttcaggcaggtccttcaggaggtattccagaagaaggcattgttctcataggagatgacagctccatgcgtgttagtggccctgaagacctttcagtgggacaagatgtggaggtggaagacagtgatattgatgattctgatgctgtgtaggcctagggtccacagagcagtcagagaagagcaacacatgcctgtccgatgagtgctgactgagcaccaggaactgtgctagaagttagaagttaagtgatttgccctgagtca

SEQ ID NO: 15241 - DNA, 435 bp, Homo sapiens
tctcagccttccgctcccggcaggttcgcagacccaccggagctcccgagagagggccgctctacccgcccccgccccgggactgtgcccgtgctcacctggctaccaccgtagcgacactgccggcctaaggaagtaccttcggggagagaaaggagagacgggtctgttggggcgaaacatgggccccgacggaagcggctccgagccggcttctctcgtggctcccaactctccctcctttctcttcacgtgccatgggcggcggtggggcactgagggcctcctggtaaaatccgaagaggggagattcaaccggggttccatatgggctttacgaataaacaagaggttgaaaatcccagcttcgtgggagctagctacagaaagagtggattggtttcaatattcttgccccaaaaaaaaaaaaaaaaa

SEQ ID NO: 15242 - DNA, 394 bp, Homo sapiens
tgtaaatgtaaaatagatatttgatttcaaagccttagtaccaaaaaaagtaagccatttcataaataattttaatcttgaatacatattgagatattttgtatatattggaataaataaaatatatcattgaaatgaaaacctgtttcttcttaccctttttaaaaatgtaactagaagattttaaactatgtttgtgacttgcatgatatttcgtttggatagcactggtctagaaatccctaagagtaaatactttcttttttttttttgagatggagtcttgctctgtcacccaggctggagtscagtggtgtgatctcggctccctgmaagctccacctcttgggttcamaccattctcctgcctmagcctcctgagtagctgggacta

SEQ ID NO: 15243 - DNA, 276 bp, Homo sapiens
agaaaagctttgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatcatcaatgccacagacccctgagcgccagaccctgccccacctcacttccctccyttcccgctgagcttcccttggacactaactcttcgccagatgataacaatggaattaggtgcct

SEQ ID NO: 15244 - DNA, 601 bp, Homo sapiens
aaggagattggcctggattatccaggtaggctcaatgtaatcaggaagggcctttaaagtgagagagggaggcagaagaggaagtcagagcgatgtgctgtgaaatctactaccgtttgctggttttgaaaatggagaaaaagagtgaggaactgagaaacatggatggccttgggaacgtggaaaagggtcactgaaatgggacgacatgaactcaaggaggctatttatgaccatgtcatttgcaacatgaagaaagcttatctggagtgaaagtaaatgagaccaacagagatragagacccggagaaatcctggttacactgcttgaatcctgtcagtcctatactggagtcctgttaatacaaaataatagtaataatccctctgtttcttatgtttatgccaacttcaacaaaaagaaacttgactaagagacaatataagaayttaatgtgtaattaagaaagaactctccaccacggggaatgtgaaaggtatatgagtcccttttcacgatgcgatgtcatgtcttttaaataagccatactttatgttcaataaaaagagaataagcaaaaaaaaaaaaaaaaaggctttc

SEQ ID NO: 15245 - DNA, 506 bp, Homo sapiens
agaaaaaagaattggatctttgactaaagaacaacaaaaacccaaacaaaaaatccaggtggattaaagacctaaatatgaaaagaaatacagaagaaaacagatgtaggggaggacttcctgagtaaaacacaaaaagcacaaagtaaaagttcaacaacaaacttactgagaacagatgaatgaaaccttgcctgtcctataaggaatacagtcatctgccagaagaaaaatggtgattcttcccagtccaaaggtgaagatggtgactgtgaaagtatcagctttagccagaccactgatgaagctcccagatgtcacagcatccatgggcttgtgatctcaggtgaaggcgttgaaccctgagccctggattcccatctcttcacttgctccctccaccaccccacccccatattcagaatggcctctaggcttctaggtttgtgtctttaatggcacctaggcaataaataaaaaatacagtgcagtgctgactgcatctt

SEQ ID NO: 15246 - DNA, 521 bp, Homo sapiens
aagtcagagcgatgtgctgtgaaatctactaccgtttgctggttttgaaaatggagaaaaagagtgaggaactgagaaacatggatggccttgggaacgtggaaaagggtcactgaaatgggacgacatgaactcaaggaggctatttatgaccatgtcatttgcaacatgaagaaagcttatctggagtgaaagtaaatgagaccaacagagatgagagacccggagaaatcctggttacactgcttgaatcctgtcagtcctatactggagtcctgttaatacaaaataatagtaataatccctctgtttcttatgtttatgccaacttcaacaaaaagaaacttgactaagagacaatataagaatttaatgtgtaattaagaaagaactctccaccacggggaatgtgaaaggtatatgagtcccttttcacgatgcgatgtcatgtcttttaaataagccatactttatgttcaataaaaagagaataagcaggattcgcaaaaaaaaaaaaaaaa

SEQ ID NO: 15247 - DNA, 468 bp, Homo sapiens
aattctaatttacttcatcaatatgacaaaggaagacctttatactgtggtaaaagcatcatggattttatcattttaatattatatttttggaaaatgccatatttagagtcctaactataatttggcacagcattactatctccaaataatgttttttcctcctggactgggtcacaattcgtcagatgctccacacaggaacctctggcacagataagttaacaggttaacatccacacagagggaaatacagcataagctatatcaaggaattcctttcctggcaccttggctggagagccagaaagattgcttctttctgtggttgatgtgttgagatataaatgtacactcaggtaggagcagcaataaaagaaaataggaggacctggaaggcatttatattccttacttttagttgttttcctacagtccagatgtattgctatctttggaccctgggaa

SEQ ID NO: 15248 - DNA, 345 bp, Homo sapiens
aataactggccggcactgggccatgaatacactggatcatgtgtccactcttgggtgaggtcacccaaggctgccccttcctgagctatggcaaagcagattagttcagaaattgactgacaggtttggtagagatgccaaagagaaacaatcaaagacaacagtaaggacaactcattcttactggaaaacactggtgyacttcactgaaagaaaagcatgaacttgggcatttggtaaacttcaacaccaggtgttgttgttgttgtatgtwgttgttgytgttgttgttgttytgttrctgttragacggagtctggctgtgtcacccaggctggagctgta

SEQ ID NO: 15249 - DNA, 293 bp, Homo sapiens
aakwrrwratatgaccaywctccagctgggatcacatgtggacttttatttccmstgaaatcagttactcttcagttaagcctttggaaacagctcgactttaaaaagctccaaatgcakctttaaaraattaatctgggccagaatttcaaacggcctcactaggcttctggttgatgcctgtgaactgaactctgacaacagacttctgaaatagacccacaagaggcagttccatttcatttgtgccagaatgctttaggatgtacagthmtggattgaaagtttacagk

SEQ ID NO: 15250 - DNA, 109 bp, Homo sapiens
gggagtttctgagggtctgctttgtttacctttcgtgcggtggattctttttaactccgtctacctggcgttttgttagaaatgtcagataggaaaataaaaaccattt

SEQ ID NO: 15251 - DNA, 577 bp, Homo sapiens
accccaggatcgaagagggcgcacgggcccggccctcccacgcgccctccarggacccggcagccagacagacggacaggcggaccgctagggagctcaagtacccggacacacgcacgagcgcagaacaaagggccggacatgctccagcccgctccgcctgcgcctcggccttgcgcgcgggggcccgggttacctgcgcagagccagctgtgatgtaaagaagtttgtgctgcatgagagagatagcacctgaagaaaatgaggccctggaggatgagagactctaaaggaaaagggaagggcctgctgtcttccagccacgccagcccccaactgagaagctgggtgaagccatcttgcatctttagccccagtcaagttacctcagcaaagactagctgaccctgccaagccctgcccaagttacagaatcatgagcaaataaatggctgtttctgttttaagcttttaaattttgggggtggtttatgtgtcaataataactgaaacagataatatatacagaataaactttagttttaataatctaagtaaaagcccactaattcatttt

SEQ ID NO: 15252 - DNA, 425 bp, Homo sapiens
acaacgggcgtaatatggccgctggtgccgggacctgccgggcgcgcggagggtcgggccgaggtccgggatccggaactgctcccggcattcctcgcgagtgtatggcgtgggctcccttccccctctgtgggtcccgcgaggagactctcgggctttgaggtgtgcctgcacaggagacagcaccagccaagctgattgtgtatctacagcgtttccggcctcaagactatcagcgcctgctagaagtgaacagctccagagagaggccacaggagactgaagatcctgaccastgcctgggctaggggtgtcacttcctagaaggggaagggaactctgggtctaacggatccactgcctgggcccactgtrcctstcacctcagtgtcccttctgacagtgactcctstctctccagcgct

SEQ ID NO: 15253 - DNA, 185 bp, Homo sapiens
ctctaatatttattgtgagaacctggtcaaactcttggaggtaaaactcacagaagcttgggttctccctcccctgtttctggtttcttctggaatttttgactctcagacttgtctacacttgcctctggcaattcaattacagttcatgtttttctgccctggcattggttcctttgtggaga

SEQ ID NO: 15254 - DNA, 434 bp, Homo sapiens
atatagtggtcaagagagacaaagtgatgtcaccaaagtcaaccaacttcttcctttcttctaggatggcttgatcaggaggctcttcaggtgtggctgccagcagtaccaaacttttccttacaacttagcaactctattccagcaaagtcccaggctagtcacatgccatgctaatttctgaatctgtcaccatgactctgtccaagtctggcttctgtcgagctctgaagccagaacgtgaaattggccccatgaaaccacatggcccgaagtaggaaaggaacgattttccaaaaagaaagagcctttttttttgaaaccaaagggaccatggtattaggcaaacatgcctctcaggaaagccaaaggggagatgatattctcccagacagattawaaaaaaaaaatcagrgatctaaaaaaaaaaaaaa

SEQ ID NO: 15255 - DNA, 198 bp, Homo sapiens
caacttcctggttcgagcctcctgccgccttcgcttgtaacctgggaaagaatatttgatcatgggtctggatggggccacctatgacctcgagggacagtgagtcatctggtcccctcagtctcttgtcctccccatgcctcgccacctaggccttgccctcagaagccagatgcctgtgctctccgtttccacctg

SEQ ID NO: 15256 - DNA, 501 bp, Homo sapiens
tgagatgggtttctggactcgcgavggctgcaacaaggcatcactcactgtataagtatttccatttctgagagcaaaaggaagaacttaagcgggcggcacttggagtgtaaattgctttgtagtatttaaaggcagaatggatcctgggcagccgagctgatcatgaggttcctgaggcctcctagccatgcttcctgtgcagcctatggaactcaacaaaccggcaggacttcctgtgaaatcatgaccaccatgtgctctttcagcctctatcagttcctacctctaagcacctgagagccaaagcaaaccacaggaaaccacagactcaaactaaacgtcagcttttcccggctctcaagcctgctggtccctgaactaaaactcacattatcaactctactggttcttaggmctttggagtcagactggaactacagcattgactcttccggaactccagcttactgactacagatcttggaacttttcagcttc

SEQ ID NO: 15257 - DNA, 493 bp, Homo sapiens
agctcaaaataaaagatgcagaccaggggccggacgcggtggctcagcctaaaatagattgttttttatatactaaaacccatcaggattggtaggtattgctagatgcttcaggttgtgactaaggagtgacatcatattctgatatgttttttctccttaacattttcctatattatatctcaaaagaccaaaaacaaacaaaaacttgtaattaactagtagataaaataggggtagaagttgtggtgagaacatgtcacttcctatttccagtaagacccaagtaagatagtaaaaagaaagcagagctgaggaacttggtctgttgggggtgaaggtagctggttgtaggtgtgcagagcaggaatgcatgtaagtgtagatcatctgatcttacccatcggatcgcttgtaacttgatgatactgtttttttgttgtaagactgagaaaaccctgtatttcagtgtcttaagatacagtgatattct

SEQ ID NO: 15258 - DNA, 454 bp, Homo sapiens
atacttagaaatggaagttctgattctaaatgtctaaggttacttcctagatcttttgaaggctgccatccttcagaaattggtatatttcttgaaatttttggactctggaggtctcttctcagggtataaagaaaaaacttggccaggtgcagtggctcatggctgtaatcccagcactttgggagaccaaagcagctggatgacctgaggtcaggagttcgagaccagcttggccaatatggtgaaaccccatctctactaaaaatacaaaaattaaccaggagtggtagcatgcacctgtaatcccagctactccagaggctgagacaggagaattactggaaccaaagaggcagaggttgcagtgagtcgagatcgtactacgccaggcactccagcctgggtgatagagcaagattctgtctctgaaagaaagaaagagagagagaga

SEQ ID NO: 15259 - DNA, 466 bp, Homo sapiens
aagatctggttgtttaaaagtgtgtggcacctcccccttcaccctcttcctcccgctccagcctcaaaggatgtgccggcttccccttcaccttccaccatgatggaaggtctcccgaggcctagccagccgtgcttcctggacagcctgtgggaacgtgagccgattaagcctctttataaattacccagtctcaggcagttctttatggcaatgtgagaacagactacaataccaaccaacattatcggtgtatctacaggaaaatgtctttccctacaaaagcmaatccataaaattagaagaaatgactgttacaccagatgctcagatatcaacacaaggacacaagaaacacacacacacaaaggaaacgtgacgcctccaaaggaacacaatatttctccaggaacagatcctaaagaaatgatgaaatgctcaaaaaaaattcaaaataagtttaaaa

SEQ ID NO: 15260 - DNA, 199 bp, Homo sapiens
ataggggcgggaacagccagcgggcgtcccatcggcttttgggtctgttacccaaagaatgataaagttggttttatttcaagaagtcgatcaaaaagaaagccccagcgctctagagctcagctgacgggaaagggggtgcgcasctcgagtttgagagctacccggagctccaagacaggggtgggttccagctgcc

SEQ ID NO: 15261 - DNA, 402 bp, Homo sapiens
tggacaaatggacctgcggtaggagagagggacaacagtaggagcaggcagatcttgctgtttcaaccaaaacctcatgctgaccagagttgaggaacagaagaagatggtgaaggcctgcaggtataggtgttcagcatgtcatctgaaatattccccacagaggcaaaaagaaaggaaattatctctgaaaaggaatgggaggacaagtcagcagaatatgtcaatgttttggttgaagaagctgcttgaatctgggcttttctgtgccatgtgttctcccagggccagcacaaagatgggcttttggtgcaggcccaagaccaccataatcatcattgattattcctctccacgccagtgtctctaaataaactttctcttctttctctgaaaaaaaaa

SEQ ID NO: 15262 - DNA, 448 bp, Homo sapiens
aacttgttatctattgcaggaaagtgcctgcaatatgccattgtgacaaggcaccatcaatcatcatgtccctttaccaggagggcccgtgtcataagccactatataaagggaatgatgggtggactgctttggacaaatggacctgcggtaggagagagggacaacagtaggagcaggcagatcttgctgtttcaaccaaaacctcatgctgaccagagttgaggaacagaagaagatggtgaaggcctgcagtcagcagaatatgtcaatgttttggttgaagaagctgcttgaatctgggcttttctgtgccatgtgttctcccagggccagcacaaagaagggcttttggtgcaggcccaagaccaccataatcatcattgattattcctctccacgccaggtctctaaataaactttctcttctttctctgaaaaaaaaaaa

SEQ ID NO: 15263 - DNA, 492 bp, Homo sapiens
aaaatggacctgcggtaggagagagggacaacagtaggagcaggcagatcttgctgtttcaaccaaaacctcatgctgaccagagttgaggaacagaagaagatggtgaaggcctgcaggtataggtgttcagcatgtcatctgaaatattccccacagaggcaaaaagaaaggaaattatctctgaaaaggaatgggaggacaagagcctccctctaatcttgtccatgcagtaaagagagatcacacgaaccctggacctacctctttgaggtggtactctcaaactctttgaagtcagcagaatatgtcaatgttttggttgaagaagctgcttgaatctgggcttttctgtgccatgtgttctcccagggccagcacaaagaagggcttttggtgcaggcccaagaccaccataatcatcattgattattcctctccacgccagtgtctctaaataaactttctcttctttctctgaaaaaaaaaaar

SEQ ID NO: 15264 - DNA, 381 bp, Homo sapiens
gggcacagaactgcgggaaacatggcagtgaaaaaaaggaaacccgtgggggaccttacagttgtttagtgtgaaagctgaaacagggcaaagcagggccgggcatggttgcgcatgctataatcccagtgctttgggaggctgaggcgggtggaatacctgaggtcgggagttggagaccagcctggccagcgtggggaagaccccgtctctactaaaggtgcaaaagccggccgaacatggtggcgcacgctgtggtcccggctgcttgggagactgaggcagcagaatcacttgaacccgggagtggaggttgcagtgagccgagttcgcgccactgcactccagcctgggtgacagagtaagactctgtctccaaaa

SEQ ID NO: 15265 - DNA, 530 bp, Homo sapiens
aaaagtctcacctaggttgagaaggaaggggaatagacttcagctcttgatgaaaagtggcaggattctggaaaagcacataggaaacattgctgtggccagtttcagttaatacagtctgcagtcggtggtcacctgtccaaaacagaattacattaaacgaggctgcttgtaaagtgaggtgcaaatccatactgaagactataatttcatgtactgctacatcctgcggagtgattaccagataaagtacctcagtggctacataaaagtcatttgcagcaactattcaatttccagaattaggttatacttgtgtttgtggttgttttcctgaggaaataatctaataatcagaaaagctaatatttatttgtgtttataagagccaggcactgtggtattttttgatttaatgagagaaattcgagcgagaaagatggaagacagcaaagaaaagaatggaaaaaagaagaggaaaagtttagccaagagaatcagagaaagatgctgcattttataatcaaagc

SEQ ID NO: 15266 - DNA, 437 bp, Homo sapiens
acaaaaaaaaagccaccgcccccgaaacccgcgggaaatctgtttcctgtgaaaggcctggcctccgggcattggcggtttccctgatcctctctcccaaattttccggcaggggattgatcgaggcgacatttaggactggggtgggcgagggagtggcggttctcgtcccaagttacaggtgaggcgttcaggccaaggcgtacaagatcgcgccgccctgtagcttgaggaggcgccgggattcgaaccaaggctgtgccaatcctaagccctgcgaggtcttgtggaccgacatgacccactctttggtttgtccagagacagtgagcagggtgagttcagtgctgaatcgcaacactcggcagtttggaaaaaaacatcttttcgaccaggatgaggarrcatgttggaactcagaccaggttcacagggca

SEQ ID NO: 15267 - DNA, 488 bp, Homo sapiens
tatcatttatttgatgcctttacaaaatatagacaagactacaagaaacagaaacaagaagaatttaagcacatagcagtatttccctgcaagataaaaatcctccctcagtacatttttaattctcgagatccgatagtgatgggggtgacggtggaagcaggtcaggtgaaacaggggacacccatgtgtgtccaagcaaaattttgttgacatcggaatagtaacaagtattgaaataaaccataaacaagtggatgttgcaaaaaaaggacaagaagtttgtgtaaaaatagaacctatccctggtgagtcacccaaaatgtttggaagacattttgaagctacagatattcttgttagtaagatcagccggcagtccattgatgcactcaaagactggttcagagatgaaatgcagaagagtgactggcagcttatttgtgggagctgaagaaagtatttgaaatcatctaattttttcacat

SEQ ID NO: 15268 - DNA, 201 bp, Homo sapiens
atctgaatcaggaaataaaattctggaaggacgatcttcccataaatacataaagtccagggaaaactacagtgaaaacagaattgtcaggatcaactgtgtgactgataaggcaaatggggataggaaatgtctgaggccagaataaacaactgctcaacaaaaaaaaaaaaaaaaaaaaaaaaaaaaaaaaaaaaaaar

SEQ ID NO: 15269 - DNA, 201 bp, Homo sapiens; identical to SEQ ID NO: 15268

SEQ ID NO: 15270 - DNA, 180 bp, Homo sapiens
atctgaatcaggaaataaaattctggaaggacgatcttcccataaatacataaagtccagggaaaactacagtgaaaacagaattgtcaggatcaactgtgtgactgataaggcaaatggggataggaaatgtctgaggccagaataaacaactgctcaacaaaaaaaaaaaaaaaaaaa

SEQ ID NO: 15271 - DNA, 163 bp, Homo sapiens
atctgaatcaggamataaaattctggaaggacgatcttcccataaatacataaagtccagggaaaactacagtgaaaacagaattgtcaggatcaactgtgtgactgataaggcaaatggggataggaaatgtctgaggccagaataaacaactgctcaacar

SEQ ID NO: 15272 - DNA, 226 bp, Homo sapiens
cttttttcttttccgtggcgcctcggaggcgttcagctgcttcaagatgaagctgaacatctccttcccagccactggctgccagaaactcattgaattggacgatgaacgcaaacttcgtactttctatgagaagcgtatggccacagaagttgctgctgacgctctgggtgaagaatggaagggttatgtggtccgaatcagtggbgggaacgacaaacaaggy

SEQ ID NO: 15273 - DNA, 512 bp, Homo sapiens
  misc_feature 18,484: n=a, g, c or t
ctcttcgcttcgcctgcnaacgcggtgggggctgctcggcggtcaggagcaggttaccctccgtctgcatgcccaccatcaaggtatgaggatggtagaagctctcgtcgaaccagatggatgaagaccactaacggcttttgtttcctctggtaacagcaagagacagagcgacatgagagattggaccgcgggctgcactggagaatttactggtaggataattcatccctaaagagattgaagtgagcttcagaatggcaaaagaggagccccagagtatctcaagggacttgcaggaactsagaagaagctgtctctgctgatagactccttccagaataactcaaaggtggtggcctttatgaagtctccagtgggtcagtacttkgacagccatccgtttctggccttcaccttgctggtgttcattgtcatgtcggccgttcctgttggattcttcctgctcatcgtggtgcttacnacctggctgctctgctgggggtcataat

SEQ ID NO: 15274 - DNA, 187 bp, Homo sapiens
  misc_feature 162: n=a, g, c or t
cttttttccgtggcgcctcggaggcgttcagctgcttcawgatgaagctgaacatctccttcccagycamtggctgccasaaactcattgaagtggacgatgaayscaaacttcgtactttctatgagaagcgtatggccacagaarttkctgctgacgcyntsggtgaagaatggaaaggttatgw

SEQ ID NO: 15275 - DNA, 155 bp, Homo sapiens
ctcttttccgtggcgcctcggaggcgttcagctgcttcaagatgaagctgaacatctccttcccagccactggctgccagaaactcattgaagtggacgatgaacgcaaacttcgtactttctatgagaagcgtatggccacagaagttkctgct

SEQ ID NO: 15276 - DNA, 149 bp, Homo sapiens
ctcttttccgtggcgcctcggagggttcagctgcttcaagatgaagctgaacatctccttcccagccactggctgccagaaactcattgaagtggacgatgaacgcaaacttcgtactttctatgagaagcgtatggccacaggaagtt

SEQ ID NO: 15277 - DNA, 224 bp, Homo sapiens
ctcttttccgtggcgcctcggaggcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtcccgaatcagtggtgggaacgacaaacaaggttt

SEQ ID NO: 15278 - DNA, 157 bp, Homo sapiens
ctctcttttccgtggcgcctcggaggsttcagctgcttcaagatgaagctgaacatctccttcccagccactggctgccagaaactcattgaagtggacgatgaacgcaaacttcgtactttctatgagaagcgtatggccacagaagttrctgctg

SEQ ID NO: 15279 - DNA, 533 bp, Homo sapiens
  misc_feature 499: n=a, g, c or t
tgatgtttggagaatcatgtgataactctttcaaacagtatcctatgctgatttataaccccaatccagatgtctctaactatcttaataggaattgcacattttaaacaggtagagttaatatttgcttataattggaagtgacatgaaatcaaacaataaaaccttatcatgactgtaaaaaattgagaattgctgtttaatagaacataggtactgaagattcaatttaatccatatattcatacttaaaaagacaacatagaatattatagtgctcctacttttaagaactagctatttatcaacaagtgttaacttgtggtgtactaagtgcaagagacagcctttagcccgaagatagtgataaaaatgacatakkygctttgggaggctgagamrggtggatcacaaggkcaggagatcgagaccatsctggctagcatggtgaagccccgtttctactaaaaataaaraaaaatkggatggggrtgttggnttatgcctgtaatmccagcactttgggaggctga

SEQ ID NO: 15280 - DNA, 459 bp, Homo sapiens
catttaaaacagaaatatgctagaaaaaattgcaaatcactgatacgacatccatgttatacaaagctaatttcccttagttactgtgatttgattttatgttctcgttcgtttttaaaatttattttttttttcagtttcttttggtttgatgaatgtcaaacggtctctagtggttttggtttttatcttcctaatcaattatattgtgcatcttttccttcttcattaaggtttttaaagataggagaaagcttagatatgacttactatattacagtttctgcttttactgattattcaacagacccaaagagattaagatcccatattaaggtacaaaactaagattagaagtatagtgaggcactacctatagcaaagcctccccatacttaaaaagataaaatgttctctgtgcatttgaaaatacatttttattattaataaagaaagtgg

SEQ ID NO: 15281 - DNA, 460 bp, Homo sapiens
ttgtaagttaattgtttaattctccttgtgactagttattcatttcagtataaaatatcgttatcatttctaagtttttacagaggaaatatttcaagaatgttttcatccaaaagggaacatgagaagagacaggatcacatgttctaagtgcatgatttttcaaacagggaacaaaagcctctgatgagtttcttgtctagtaaaacataaaatgctaagatggggttggaggtgtatgtgggagtagggacaaataagaatagagattatcaattagaaaccataaaatttaaaatgaaaaaaaaaataccagctaatacattgcaccattctgtcagatgagaaaatgtactgaaaaaattgccatagacaagtcctggtccatgacaaaatattcaccaaataacagttgaaatgtaaaaaawtaaatagaggraaagctgtagawtttcatgaa

SEQ ID NO: 15282 - DNA, 506 bp, Homo sapiens
ttgtaagttaattgtttaattctccttgtgactagttattcatttcagtataaaatatcgttatcatttctaagtttttacagaggaaatatttcaagaatgttttcatccaaaagggaacatgagaagagacaggatcacatgttctaagtgcatgatttttcaaacagggaacaaaagcctctgatgagtttcttgtctagtaaaacataaaatgctaagatggggttggaggtgtatgtgggagtagggacaaataagaatagagattatcaattagaaaccataaaatttaaaatgaaaaaaaaaataccagctaatacattgcaccattctgtcagatgagaaaatgtactgaaaaaattgccatagacaagtcctggtccatgacaaaatattcaccaaataacagttgaaatgtaaaaaaataaatagaggaaaagctgtagaattttcatgaaactaaatgtatcaaaatgaaatgattattcattagtatgagttta

SEQ ID NO: 15283 - DNA, 641 bp, Homo sapiens
  misc_feature 47: n=a, g, c or t
acattcccccgaccccctccagcagtgaagtctaagagcaccgcganagtaatttaaattttcgagggaaagcacagcgccatctgtcggacatcatgccaattactcttgttaagttcctacctgacggttactttatactttgaactgctaggtactccttttggcctaaggacacagtgaaaaatgtaccgagaccttggagagccacgaaccaagaaacttcagaaacctctgatatctgatcaagagttaagagacgtcagaatcatcacaactgacaaaagaatgttttctctcttcaagattctcttttgaaagacatctaaaaagaaatagatgacaagagggggcccaacacacaaggggaattacagaatgcatcccctaagcaaaggaagcagagtgtgtacacaccacccaccataaaaggggttaagcatctgaaaggccagaatgaatcagcattccctgaagaagaagaaggcaccaatgaaagagaggagcagcgggaccattaattactggtctgcagcaagaaggcttcttggaaataactgaactattaacttttctgagtataccatggaattccactgcttgacttccagaagcatcctccatctctgcaccccacactc

SEQ ID NO: 15284 - DNA, 295 bp, Homo sapiens
aaaggaaaaaaaggataactgacaaaccacagctattcagacttgggacttgggaatctgttatgttaatgggctgctttttttgtttgtgtctttgaggcagggtctctgtggcccaggctggagtgcactggcgccatcacgactcactgcagcctcaaagttccaggctcggctgaggtaggagaatcgcttgaaactgggaggcagttgttgcagtgagccgagattgggccactgcacactccagcctgggcaacagagccatactccgtttcaaaaaaaaaaaaaaaaa

SEQ ID NO: 15285 - DNA, 445 bp, Homo sapiens
caaaccaaaaaaggaaaagcagctaaactcacactaatacaacataaatacatgtaaattttaaaagcgattgtcttaccctcagtaccatactactttttgcaacctatagtatttccgaataactcacttatttaacaaataatgatggaatacccagcaaggccttactctttttcaaggtggtgagaatgtagcagtaaataaaacagacataatctccctgcccatgtggaacttaagttctggcggaaggaaagagacactaagtaaattatctggttcatcagaagataagtaccatgggtcgtgcgcagtggctccctcctgtaatcccagtgctttgagaggctgaggtgagtggatcacttgaagccaggagtttgagaccagtcggggcaacacggtgagactccgtctctcttaaaaaaaaaaaaaaaaaggc

SEQ ID NO: 15286 - DNA, 292 bp, Homo sapiens
aatctttcttacctacacctcagaaaggaagcacttacaagggtgaataaaaaaaggccagtgcagtctctagcaaatacagctctttaatgaaatctccagaggaagaagagagaataattttcatgacaattagaagatagacagagactgaacatcactggaggcaaataaattgcttagaagactttgaaaaaaaagtccaaatgagagatgaagagcacccaaaccaagaaactggcagtgctcatggagagcaagaggatgtgatacagagatccacattaggtgt

SEQ ID NO: 15287 - DNA, 378 bp, Homo sapiens
gcggatggaatctcaatctttcttacctacacctcagaaaggaagcacttacaagggtgaataaaaaaaggccagtgcagtctctagcaaatacagctcttaatgaaatctccagaggaagaagagagagctgcagctagacgtggaggcaagaagaaggagccatatactactaccccttacattacctcttctcttctggagttaagttgccggacatggtgtctgcaaccttactgagacaaggctatttgaaacaccacaagggcaggacttgtgctgttcagaactctacatcaggtgaaaggtcaagcagacttcatcagagttgcagaagtttcttgcaagtaattctaaaacacttggaatgtacaataa

SEQ ID NO: 15288 - DNA, 503 bp, Homo sapiens
cacacgggcggacacacacacacgcgcgcacacacacacgcacagagctcgctcgcctcgascmacgaacgtggacgttctctttgtgtggagccctcaaggggggttggggccccggttcggtccgkgggagatggcgcscatcctgggccatgggagcctgcagcccgcctcggccgctggctggcgtccctggagctcgactcgtcgctggaccagtacgtgcagattcgcatcttcaaaataatcgtgattggggactccaacgtgggcaagacctgcctgaccttccgcttctgcggggtacttcccagacaagactgaagccaccatcggcgtggacttcagggagaagaccgtggaaatcgagggcgagaagatcaaggttcaggtgtgggacacagcaggtcaggaacgtttccgcaaaagcatggtcgagcattactaccgcaacgtacatgccgtggtcttcgtctatgacgtcaccaagatgacatctttca

SEQ ID NO: 15289 - DNA, 377 bp, Homo sapiens
catcatcaggaaagccaggcagcgcgtctctgtggttgggagatgctttctaaggccctgctgaactccaagaggccatgagaagcatatagtcttctaaacagaaaagcattaactctagcactctctggagcccctcccaccacacacggtccccagcaggtgcacagcctcaaacagcatcactgggtgggggctgagtaccaagaagtgtggtgacctgcccagggttgaaaactttcttagttcaatactgttgcccagattgttccccacaaaatcacaaaagaagttaagaggttcctggccggacgcggtgactcatgcctgtaatcccagcactttgagaggccgaggcaggcagatcacaaggtcag

SEQ ID NO: 15290 - DNA, 533 bp, Homo sapiens
ctcagactcttgttgaaacagcttattcattgtctctatttggatgtctaataggcatctcagacttaatatgtccgcagctgagttcctgatactaacctgttctgccttgagtcttcattatccagtaaatagcaactccatccttctagtttaggtcccttgcagtcatcctggactcctttctctcacatcccatatccaaactgtcaagaaagtcttgttggttctatctataaaacatattcagatcccaggcggggcgtggtggctcaacgcctgtaatctcagcactcggggaggccaaggcaggtacattgcttgagtctaggagttcaagaccagcctgggcaacatggcaaaactctgtctactaaaaatacaaaaaattagctaggcgtggtggcacgcacctgtagacccagctacttgggaggctgaggtgggagaatcgcctgagcctgggaggttgaggctgcagtgagcccagatcacaccactgcactccagcctaggtaaccagagtgagactc

SEQ ID NO: 15291 - DNA, 404 bp, Homo sapiens
accctcagccgttcctccacctctcagccatatctttcagccccccctcccctggatccgtgtgtgtgtgtgtccgtgtgtgtgtccccctgtaaatagccagctgttatttatacatatataatattatatatatktggtctgtttgtagttttattactagatgatttttccggttgtccttaacaccccttcctgaggttcccttcacccctctctcttgccttccttccctttccctttcttcctgactagccccaagtcccttcatttgcatctgctatgcaatagtcsctstsctttccttsttcttccctcagatttagcdgatccttsctcccaccctggccttcctttcctctttcctcctcactctccccgtcatgctccctctgmscgccctg

SEQ ID NO: 15292 - DNA, 230 bp, Homo sapiens
tctagattggagggtacagggcagcagctcacaggtgcccattagcacatcccacaagcagtcacggcactgcacttgcactggaaacagcttctcattttcccgggagtaccttctgccaactttgagaacaccaattcctaattcctgttccagtatccactttggttttatacataggacatcttttcctataagttttccctgaatgttttgtttttttttttttt

SEQ ID NO: 15293 - DNA, 534 bp, Homo sapiens
tcattccctgccccaggaagggacccagcctcaccctcctggggtggccccgtgttcctcctgcccaccctgcsccactgccctaccggggcagcccaggttcccaactgctgcttccacccccttcaccttgactggcttcagttcctctcagcgctcctgcctccaaagcgtgccctgtttcccttccttagcgcttttaagttatttattctgtacttgtggtttggggctctgaggaaaatcctaatcttgtgcctctcsssctttgctaggagttgggtgggaagagagggtggcctctgtgccccaggttgtcagtggaggggaaggggtgtcactgcacctctgtgggactgtcatgccagtgtgcccasctgactggtctacatcctaaagagatgtaccgtcccccctccatgcgggcacaccactcccaggagccaagctggaggaccgcgacstgggctgggagcagagctgactgasatgggtggaggtgacctgagccaagttctctggcacttgctggga

SEQ ID NO: 15294 - DNA, 142 bp, Homo sapiens
aagttatttcgcaaccttcatctgttcctggaagatacccgtagcctgccttccttcttgacaggctgatttaggggtgctccccaagaagatcaggactgctgaaagaatgaagaagaacttacttggcctaggatgtggc

SEQ ID NO: 15295 - DNA, 73 bp, Homo sapiens
asttatttcgcaaccttcatctrttcctrgaagatacccgtagcctrccttccttcttracaggctgatttag

SEQ ID NO: 15296 - DNA, 412 bp, Homo sapiens
accctcagccgttcctccacctctcagccatatctttcagccccccctcccctggatccgtgtgtgtgtgtgtccgtgtgtgtgtccccctgtaaatagccagctgttatttatacatatataatattatatatatttggtctgtttgtagttttattactagatgatttttccggttgtccttaacaccccttcctgaggttcccttcacccctctctcttgccttccttccctttccctttcttcctgactagccccaagtcccttcatttgcatctgctatgcaatagtccctctcctttccttcttcttccctcagatttagctgatccttcctcccaccctggscttcctttcctctttcctcctcactctccccgtcatgctccctctgssccgccctgaaaaaaa

SEQ ID NO: 15297 - DNA, 564 bp, Homo sapiens
aaaatccggatcgttgggactgcggtcgttagtctccggcgagttgttgcctgggctggacgtggttttgtctgctgcgcccgctcttcgcgctctcgwwatcattttctgcagcgcgccasagggatgggcccacaagcagatctactactcggacaagtacttcgacgaacactacgagtasccggcatgttaatggttaacccagagaactttccaaacaagtaacccttaaaactcatctgatgtctgaaagaggagtggaggagacttggtgtccaacagagtctaggctgggttcattacatgattcatgagccagaaccacatattcttctcttttagacgacctctttccaaaagatcaacaaaaatgaagtttatctgggggatcgtcaaatctttttcaaawtttaatgtatatgtgtatataaggtagtattcagtgaatacttgagaaatgtacaaatctttcatccatacctgttgcatgagctgtattcttcacaggcaacagagctcagttaaatkgcaactgcaagtaggttactgtaagatgtttaa

SEQ ID NO: 15298 - DNA, 172 bp, Homo sapiens
agtctccggcgagttgttgcctgggctggacgtggttttgtctgctgcgcccgctcttcgcgctctcgtttcattttctgcagcgcgccasaggatggcccacaagcagatctactactcggacaagtacttcgacgaacactacgagtaccggcatgttatgttacccaga

SEQ ID NO: 15299 - DNA, 491 bp, Homo sapiens
aatctaattttagaacattttcaatgccccccaaagaaactctctgcaggcctgggcaacatagtgagaccctgcctctagaaaaatttttttgattagctgggtgtggtggcactcacctgggaggctgaggtgggaggatcccaggagttagaggctgcagtgagccatgatcatgccactacacttcagcctgggcaacagagcaagaccctgtctctattgaaaaaagtggtgggaagtgggggagaaaccctgtgctacagcagtcttcctgattcctgcttacccatctcctactccatccccagacaatctctctatggattggcctattctgacatttcacatcagtcatctgttgcttaatgacagacacacatttggagaaatgtgtcattaggcaattttcttcatgtgtacacatcaaagagtgtccttacacaaacctaaatgggacaacctactgcagacctaggctgtatgacaga

SEQ ID NO: 15300 - DNA, 416 bp, Homo sapiens
aataacaccaactgtcacacttcctctcaccccctgcttcccaccctggtcctggtacaagatgctcttatgatccaagcactccccatgtggatgaggctggcaaaggatgcagtgttggtgacccctctagagtcatttagcttgtgttgagttcacagaacattagcagtcatgttgcttggaccttcttctgcccagtgcatatatgaaagtgttgataaatgtgttccatggctgttctggaagttcatgtgtagaatcctgttttgtgcttttgaataatttttctttagtgtattgaaaaatcttccataacacattgatgaaagtttatgtctctgggtagggaagagcagaattttgtggatggggagtcttcgtcaaaaagaacatttataacactaagtgggaga

SEQ ID NO: 15301 - DNA, 412 bp, Homo sapiens
gtagtggtagttatttttgcaagtgggtgttatgcaatgatggttatattcaaaatcctgaacctacttttctatacctttgaggtagtaattaagtttaagaatcacggccaggcgtggtggctcatgcctgtaatcccagcactttgggaggccgaggcaggtagatcacctgaggtcaggtgttggagaccagcctggccaatgtggtgaaactcgtctctactaaaaatacaaaaattagctgggtgtagtggcaggcgcctgtaatcccagctactcgggaaactgatgcaggagaatcacttgaaaccagaaggtggaggttgcagtgagccgagatcacgccactgcactctagctcgggtgaaagagtgaaactctgtctcaaagaaaaaaaaaaaaaaaaagc

SEQ ID NO: 15302 - DNA, 53 bp, Homo sapiens
stmttsgtagttatttttgcaagtgggwgttatgcaatgatggttatattcaa

SEQ ID NO: 15303 - DNA, 784 bp, Homo sapiens
agtagcactcaaccgttaatagggaaccagcagagcgctggaggctcattagaggaatcgttagagccggtcgttaacgcatcaacctctggaaaggacagggaaacaggaaccaccgtccagacactttcggagcttctgtctcgatcattcccgaactgaagtatggaaatttggtaatgttgtcattgaacatctataccactggatacacatctgttcagctctcatgaagataaccaaacaactaaatagtggtattacacctccgttgccctccaagactgacaattatatgtatgcaaaaatgccaggggaaggtttgcaagagaagtgataatggatgataatggaattgatactgtatttaggatcctttgtttgttatcagttttgtttgttaactataaaatattttccattggaaaggggtactataaatgtcttctgctgctaatatttatctcagcactttctaaacccaaaagtgctacctaagaagaaatttagccaaaaaatacccagctaaggtagccatagccaagtgtatttaagtatgttatagaatatatttgaaagcttcctttcagtttgagctttgtatctgctgtggaactgttatggttgattgggtagttatttttcattcttataaggttcaaagtaacagctgaggatttagaaaacaagaataccaaatagaatacgaaataataaagataaaccaaaaaaataccaaataataaagatttttaagaaatggaaaaaaaaaaaaaaatgcgaa

SEQ ID NO: 15304 - DNA, 488 bp, Homo sapiens
aacccatattttattttctaaattgttttttctaattgaggaagcttttattcctccttctcccctctcaattcctgtccctctctctgtccttccttttccctcatcctctttctctttctctcaaacctcatttttcctttgaaaagtttcaagtagaattaattcagtgttctcagccgagttccagcataaagagctcactatgcacttcgacagaattatctcctttgaagaatgcccactttaatctcctctaagacaggtttttgtggtgttagaacaaaatgacataatactcttcaagctaaatggcttattaagtagcattcagaaaatcctgcaacttcctcgtaattggaggcttaattgggtgggtttagtagcatttggttattagggctaatcaaatattccagaataattgactcaacttttttttgggggggggcaattatcatctctaatattgttgtgattaaaaagat

SEQ ID NO: 15305 - DNA, 445 bp, Homo sapiens
ggctccacttctaattctagtttttcccaccacatctgcagttatttcatccatgaggcttggaataaactcctccaaactcatattcatgttaatattctgatctgctcccatgaatcacaaatgttcttaatggcatctagaatggtgagtcctttccagaaggttttaatggacwttgcccagatccatcagagaaatcgccatgacaactacagccttacaaaatgtatttcttaaataacatgacttgagccaggctcagtgactcatgcctgtaatcctagcacttccagaggctgagacgggaggattgcttgagtccagaaatttgagacctgcctgggcactatagggagattstctctctataaaaattcttaaaaaagttagctgggcatggtggtgcatgcttgtggtgccagctactgggggaggctgaggt

SEQ ID NO: 15306 - DNA, 491 bp, Homo sapiens
ttataaacttttagaatagaataaaatcctggaattactcagatatatttgtaagtttcatccaaacatttataaatttatgtcagatagcagaagaggattgtgaaaatattttaactttcaccaaaagttaaagctagcacgtggtcttgggggaaaattctttagatccactttaatatgtgtctttttataatttgaataaattaccctgtgggaatgaaaacctctattctgggttttaattttgtgtttgggatattaacattaacctctgcattctgttgtgttgtgtttttccctgttttaagattacgggcagggacgacctgtcaaagcgcggagtggaccaaacctgcactcgagtaattagcaaagcaactccggccctacccacggtctccatctcatctagtgctgaagtctgaggactctgcagcatcagacccacctctaagagaactttctgaattttgcagctaatctcgggg

SEQ ID NO: 15307 - DNA, 480 bp, Homo sapiens
ttataaacttttagaatagaataaaatcctggaattactcagatatatttgtaagtttcatccaaacatttataaatttatgtcagatagcagaagaggattgtgaaaatattttaactttcaccaaaagttaaagctagcacgtggtcttgggggaaaattctttagatccactttaatatgtgtctttttataatttgaataaattaccctgtgggaatgaaaacctctattctgggttttaattttgtgtttgggatattaacattaacctctgcattctgttgtgttgtgtttttccctgttttaagattacgggcagggacgacctgtcaaagcgcggagtggaccaaacctgcactcgagtaattagcaaagcaactccggccctacccacggtctccatctcatctagtgctgaagtctgaggactctgcagcatcagacccacctctaagagaactttctgaatttgcagct

SEQ ID NO: 15308 - DNA, 490 bp, Homo sapiens
agtataaattaggttgtctcttaatttgttagtcccatttcactgagcagaatactgaagccagaaagttaagtaactggagatcacacggctgagtcctaaggatcccctgagctcagaacattaaacctcgagagagaagtgattgggatctaaatgttgaagtggttagattgtgttgaggaaagtgtctcctggtaaggagatataacatcctcaggtagacttaaaaaacaaataagccgggcgctgtggctcacgcctgtaatcccagcactttgggaggccgaggcgggcggatcgcgaggtcaggatatcgagaccatcctggctaacagggtgaaacccgtctctactaaaaatgcaaaaagttagccaggcgtggtggcgggcgctgtggtcccagctgctcaggaggctgaggcaggagaatggtgtgaacccaggaggtggagcttgcagtgggccaagattgcaccactgcactcca

SEQ ID NO: 15309 - DNA, 606 bp, Homo sapiens
agtagcactcaaccgttaatagggaaccagcagagcgctggaggctcattagaggaatcgttagagccggtcgttaacgcatcaacctctggaaaggacagggaaacaggaaccaccgtccagacactttcggagcttctgtctcgatcattcccgaactgaagtatggaaatttggtaatgttgtcattgaacatctataccactggatacacatctgttcagctctcatgaagataaccaaacaactaaatagtggtattacacctccgttgccctccaagactgacaattatatgtatgcaaaaatgccaggggaaggtttgcaagagaagtgataatggatgataatggaattgatactgtatttaggatcctttgtttgttatcagttttgtttgttaactataaaatattttccattggaaaggggtactataaatgtcttctgctgctaatatttatctcagcactttctaaacccaaaagtgctacctaagaagaaatttagccaaaaaatacccagctaagggtagccatagccaagtgtatttaagtatgttatagaatatatttgaaagcttcctttcagtttgagcttgtatct

SEQ ID NO: 15310 - DNA, 511 bp, Homo sapiens
attctatgttctagtctccctgctagaaacaggatgtccttcatgccttatcccagagtctcctgggaccctggcatataagacccaggattgctgctttctagaatcctccagggtcagtgcaagtgggacacatgcagataaaattccgtctaacccaagcagcttttctgagcctcagggaaccagctcacagtgaatcccaagtttctgttactccttgccgcccatctataaactgacttcatggatgtttggatgtgtgtgcggatgttctgactcattggactcggacaagttggtaactctgaactttcttcatatccatctaatcatggcactcaaaatgaattaacatacttgagaatttgaaaagatcaaaaatattttctctgatatggacttactactactgctgtatatacacagacaaatgatagtggctatgttccaacaaaactctatttacagaaacaggcaaaaattggccagtaggctgtccatttgctaa

SEQ ID NO: 15311 - DNA, 497 bp, Homo sapiens
ctagatcattttatgagagccataaagattatttgtcttggttgctgcattagtaattttcttcttccttttccttctgctattttaaagacttagccctgtgtatgtgtttttgctcatttttttgatgatggaatttgaccttaataacagtgaagacaaattaacatagtgttattagaatgtgaataggtttttattcagagtttaataccaatggattacatatgtttagtcctgttggaatgttaaacagatatgatctactaaattaaatagatatggattacagatgagatcatctatgatgttgagttaaaagttcacaataatgtaagaatgttcggcatggtacagtggctcatgcctgtaatcccagcactttggtaggccaatgcagaaggatcgcttgaggccaagagtttgagaccagcttgggcaacatagcaagacccgatctctacaaaaataaaaattaaaaaaatgagcaggacatg

SEQ ID NO: 15312 - DNA, 159 bp, Homo sapiens
accatacgaagttgcagcaagaagatgctatctatgaagcagagagtgagcctcattagacatagaatatggtgtctccttgatcttagacttcctagcctttagaactgtaagaagtaaaatcctgttatttgttaaaaaaaaaaaaaaaaaaaaaaa

SEQ ID NO: 15313 - DNA, 210 bp, Homo sapiens
accatacgaagttgcagcaagaagatgctatctatgaagcagagagtgagcctcattagacatagaatatggtgtctccttgatcttagacttcctagcctttagaactgtaagaagtaaaatcctgttatttgttaaaaaaaaaaaaaaaaaaaaaaawwaaaammwwrraarrraaarraaaaaawthaaaaaaaaaaaaaatgcgaa

SEQ ID NO: 15314 - DNA, 195 bp, Homo sapiens
accatacgaaktgcagcaagaagatgctatctatgaagcagagagtgagcctcattagacatagaatatggtgtctccttgatcttagacttcctagcctttagaactgtaagaagtaaaatcctgttatttgtttaaaaaaaaaaaaaaaaaaaaaaaaaaaaaaaaaaaaaaaaaaaaaaaaaaaaaaaaaaw

SEQ ID NO: 15315 - DNA, 490 bp, Homo sapiens
cagaatttaattttaaaatatctgtaaccttacaacagaattatatcctgtggtttgggagtttaaaagaggagtacattctcatttggaattcatcccaaggattagcaattactgaacaataaaacagatgattctcacagaagtaaagggaaagggggaaagaaaagcatgtataagagaattggatggaaggagggagatatttttagcctttgtatttctcgaaatacaaatgtaacacattgagttaaaaagaaatcaatccatttggttcttttttaatgtattttttttttaacgtttgctttggtagccttggcagcaaacaaaccawaatggaaaaataattctcttcttcttcttcctttttaggaaaaacctccataccttggattctagatccctgggtcccytaccccaggtgggcactaatagcttactcagtggtattgaggctgtccagcagaccatccmactttgatttggg

SEQ ID NO: 15316 - DNA, 168 bp, Homo sapiens
accatacgarktgcagcaagaagatgctatctatgaagcagagagtgagcctcattagacatagaatatggtgtctccttgatcttagacttcctagcctttagaactgtaagaagtaaaatcctgttatttgttaaaaaaaaaaaaaaaaaaaaaaaaaaaaaaaaw

SEQ ID NO: 15317 - DNA, 194 bp, Homo sapiens
accatacgaaktgcagcaagaagatgctatctatgaagcagagagtgagcctcattagacatagaatatggtgtctccttgatcttagacttcctagcctttagaactgtaagaagtaaaatcctgttatttgttaaaaaaaaaaaaaaaaaaaaaaaaaaaaaaaaaaaaaaaaaaaaaaaaaaaaaaaaaav

SEQ ID NO: 15318 - DNA, 166 bp, Homo sapiens
  misc_feature 126: n=a, g, c or t
accatacgaagttgcagcaagaagatgctatctatgaagcagagagtgagcctcattagacatagaatatggtgtctccttgatcttagacttcctagcctttagaactgtaagaagtaaaatccntgttatttgttaaaaaaaaaaaaaaaaaaaaaaaaaaaaa

SEQ ID NO: 15319 - DNA, 173 bp, Homo sapiens
accatacgaaktgcagcaagaagatgctatctatgaagcagagagtgagcctcattagacatagaatatggtgtctccttgatcttagacttcctagcctttagaactgtaagaagtaaaatcctgttatttgttaaaaaaaaaaaaaaaaaaaaaaaaaaaaaaaaaaaaaa

SEQ ID NO: 15320 - DNA, 180 bp, Homo sapiens
accatrcgaaktgcagcaagaagatgctatctatgaagcagagagtgagcctcattagacatagaatatggtgtctccttgatcttagacttcctagcctttagaactgtaagaagtaaaatcctgttatttgttaaaaaaaaaaaaaaaaaaaaaaaaaaaaaaaaaaaaaaaaaaaaa

SEQ ID NO: 15321 - DNA, 215 bp, Homo sapiens
accatacgaagttgcagcaagaagatgctatctatgaagcagagagtgagcctcattagacatagaatatggtgtctccttgatcttagacttcctagcctttagaactgtaagaagtaaaatcctgttawttgtttaaaaaaaaaaaaaaaaaaaaaaaaaaaaaaaaaaaaaaaaaaaaaaaaaaaaaaaaaaaaaaaaaaaaaaaaaaaaam

SEQ ID NO: 15322 - DNA, 178 bp, Homo sapiens
accatacgarktgcagcaagaagatgctatctatgaagcagagagtgagcctcattagacatagaatatggtgtctccttgatcttagacttcctagcctttagaactgtaagaagtaaaatcctgttatttgttaaaaaaaaaaaaaaaaaaaaaaaaaaaaaaaaaaraaaaaaaa

SEQ ID NO: 15323 - DNA, 179 bp, Homo sapiens
accatacgaagttgcagcaagaagatgctatctatgaagcagagagtgagcctcattagacatagaatatggtgtctccttgatcttagacttcctagcctttagaactgtaagaagtaaaatcctgttatttgttaaaaaaaaaaaraaaaaaaaaaaaaaaaaaaaaaaaaaaaaaw

SEQ ID NO: 15324 - DNA, 450 bp, Homo sapiens
tcgatgacattattgaccattaggaagaggctagcctcctgccctttaatattacatcttaattagataaattaaccaagtggaaatctggactatatccatagctcaaatttggtcctctccacacactttcataaaacatttctggggccgggcgcagtggctcacgcctgtaatcccagcactgtcggaggccgaggcgggtggatcacctggggtcaggggttcgggatcggcctgaccaatgtggagaaaccccgtctctactaaaaatacaaaaattagctgggcgtggaggtgcacacctgtaatcccagctactcgaaaggctgaggcaggagaattgcttgaacctgggaggcagaggttgcagtgagccaagatcgtgccattgcactccagcctgggcaacaagagcaaaaaattccgtctcaaaaaaaaaaaaaaaaa

SEQ ID NO: 15325 - DNA, 573 bp, Homo sapiens
aaagctcccagaatccaattggatgctgggttgcagggtggttagagctataggcagtgagctgaggcaggaatcagatggctttacccatggagatttttgttgctggctaatttgctacatattcttagaactggtttgattaagaaaaaaaagctgttggtgtggtgactggaagtctaacaacaatcaccacaatagatatctgcagccctgaaaccaattttcaggcttgaatttcttttacttttcttctttctttcttattgtgtgtctccaagtcctgagtctactggggttatgtagaaaaaaagttttaaacatttttttgggaaataattgcaaagttacagctaaattataagaaaaaaagaagagttctacactktgggaggccgaggcgggtggatcatgaggtcaggagatcgagaccatcctggctaacaaggtgaaacccgtctctactaaaaatacaaaaaattagccgggcgcggtggcgggcgctgtagtcccagctactcgggaggctgaggcaggagaatggcgtgaacccgggaagcagacttkcaagag

SEQ ID NO: 15326 - DNA, 381 bp, Homo sapiens
ctacaaattaatatctctaagagggtaattcccaatttaacagaaaattggaccaatttcagacaaaaacaaatctcatagaaaacacacacttgttggccgggcgcagtggctcacgcctgtaatcccaggactttgagaggctgaggcgggcagatcacctgaggttaggagttcgagaacagcccgtccaatatggtgaaacccgtctctactaaaaatacaaaaaaattagccgggcgtcgtggcacgtgcctgtcgtcccatgcaactcgggaggctgagacagcagaatttcttgaacgcaggaggcggaggttgcagtgagcaaagatcacgccactgcactccagcctgggcgacagagcaagactccaaaaa

SEQ ID NO: 15327 - DNA, 490 bp, Homo sapiens
gtagagcatatgatctttactgatgcacctgcatctggctcagacttagtcacccagccctgaaattatatcatatcacaggtcattctctgagtctcttaatgtgaggccttgagagaaaaatcaacatgccttctgttggatgaagaccaatcagcaagatggtggtgattgtgagtcgttgcaaggatcaagtgagttgaaatccgtaagtgcttgggagaatgcctggcgcctggaagcactgtatattccaaaaaaggagatataaacatgaccataaaagacatgaaaagatgtttaaccccattagtcatcgtggaaatgcaaatgaaaaccaccatacagacactagagtggtttaaatttgaatgacttccaacaccaaatgccagacaggacatagagcaactggatgtctcatgctcacaggcagaagggaaaactactgtgtgtgacaggaagatggacttacccaacctttcagcat

SEQ ID NO: 15328 - DNA, 504 bp, Homo sapiens
ctcgcataaaaagccaccgcccccgaaaacccgcgggaaatctgtttcctgtgaaaggccttgcctccgggcattggcggtttccctktatcctctctcccaaattttccggcaggggattgatcgaggcgacatttaggactggggtgggcgagggagtggcggttctcgtcccaagttacaggtgaggacgttcaggccaaggcgtacaaggatcgcgccgccctgtagcttgaggaggcgccgggattcgaaccaaggctgtgccaatcctaagccctgcgaggtcttgtggaaccgacatgacccactctttggtttgtccagagacagtgagcaggtaagagtctgtggggacaggcagtggcgaggccctaagcctggggtcgagccctcagtggacagatctggggggtcaggccctccgcggastgagagctggtctcagcccctctcttcgccttgatcctggtgcctccagggtgagttcagtgctgaatcgca

SEQ ID NO: 15329 - DNA, 315 bp, Homo sapiens
attgattaagtggctaacccttttctctccaagtctctttatcctccagtaaaagaggagtgacagaatacacctcccaggaactgttacaaggattggtgagataacacaagccagaagagataacaccatccacctgctccaaggggaggtgacagccacaagctcagcatttgcagccctcctataccctgcccttatgtgtcttcctttgactggtactagtttgtatcctwttcttgtaataaatgtgactatgagcataaaaaaaaaaaaaaaaaaaaaaaaaaaaaaaaaaaaaaaaaaaaaaaaarr

SEQ ID NO: 15330 - DNA, 545 bp, Homo sapiens
attctcacctaggacttgggcctgacggccacacctgcagtcttcctattagatcatgaaccttggaatagaaacttaccagctttcttacaaatagcctcttctccttcaaaagcagatctaagggcttgaactcttgcaaactaatgcctaccttccttgtgatggggatggggaggggtggatctcttccagtgatcttccctccaacctactcccagcctctcacctccctggccacatgcgacaaattgtctttataataactgcaattcctcaataatctcaatttcatacacactttttaacaccacttctcatattccagctcactttgtctggtcacaaaactccaaaagtcctttgaaaatctaactcactgcacctacagtccattagtctcatatcctttccctggcctggacccccacaccctgtgtcctcacttcactacttaactaaattccacggtcaatcgtcataatcactcccatgcagataccttcactaagtttttccccattccttttcttacctatctgtgc

SEQ ID NO: 15331 - DNA, 167 bp, Homo sapiens
caaattagacatgtctcttgtatagttttatatttcactgaggaaaatttcaagtttggcttctgttttcttgtacatagagtaaatgtagttgtttcatttacactctgtgtctgatactttcagkatttgaagtccctgctctggkgtcttggcttattagatgc

SEQ ID NO: 15332 - DNA, 443 bp, Homo sapiens
agtccgcagcctttttcctccctccttcggccccggggctcacatcctcgctgcctcacaccttgggcgtgtgtgggagcaggagagggattctctggggtccccatttggaacctggagacccacttctgccaacaagtccttcagcccctctgggccttagtttccccccagtgaagtggggatagtgacagctcccccgggagccagtgaaaactttgtgaagggagtgattactgcgggcgaaggcgcttggcacagccacaactgaagctcagccgtcggatgtgattattgttgctattgttaccgctccgcctrractgggtgcccggtcggaaagtcccgctccccgctcctcctcccargcgcggaagcttcgcrccgcmcgcmtcgggggacacctcccgcgccatctggggcactggagataaggaaaggdm

SEQ ID NO: 15333 - DNA, 454 bp, Homo sapiens
aggagacagctacagtgatccaactaaaccaacaggggattttcatcagcacttccctggtgtaatcatggtacagattattaaagacacgggatggtactatcaagaaaagcagccaaggggcaaattgataaagaagggctttcttcctcctggacttttatttcctgcctgacttcaggtgaatcccagaccagctcctagtacatcccatcctgtatctgatcccatggatcgtacctcagttgtgcttggaaaattccatggaactgccggacacaaactcgcagtggttcaattttcttcgaaacggtgtggtccctgcaaaaggatgtttcctgttttccatgagctggctgaaacttgtcacatcaaaacaatacccacatttcagatgttcaagaaaagccagaagatgggggaccaaaactttgtctggtctttgtaaccagaa

SEQ ID NO: 15334 - DNA, 457 bp, Homo sapiens
caaatgattctggaaatggtgagcacaaatctgagagaaagtcacctgaagagaatctacaaggtgctgtaaaatctttctgcacaagtgcctcaggagcacccttgggtcccaaaggagatggtcattatccatggagttgtccagtgactcatacacgggaaaaaatttatgccatctgttcggactatgcctttctcaaccaggcgacctcaatctataaaactccaaatccatcccgctctccttgcctccctgatagtacctctttatctgctggaaataattcatcaagatacattggtatcccgactagtacatcggaaattatctacaatgaagaaaatagcttggaaaacttatccaacagcctgggcaagctacctctcgcatgggaaattgataaatctgaatttgatggggtgaccacaaattcgaaacacaaatcaggcaatgc

SEQ ID NO: 15335 - DNA, 278 bp, Homo sapiens
attgattaagtggctaacccttttctctccaagtctctttatcctccagtaaaagaggagtgacagaatacacctcccaggaactgttacaaggattggtgagataacacaagccagaagagataacaccatccacctgctccaaggggaggtgacagccacaagctcagcatttgcagccctcctataccctgcccttatgtgtcttcctttgactggtactagtttgtatccttttcttgtaataaatgtgactatgagcataaaaaaaaaaaaaa

SEQ ID NO: 15336 - DNA, 361 bp, Homo sapiens
ataacacccgcgaccccgcagctaagcgcastcccgacgcaatggacccggcgctggcagcccagatgagcgaggctgtggccgagaagatgctccagtaccggcgggacacagcaggctggaagatttgccgggaaggcaatggagtttcagtttcctggaggccatctgtggagtttccagggaacctgtaccgaggagaaggcattgtatatgggacactagaggaggtgtgggactgtgtgaagccagctgttggaggcctacgagtgaagtgggatgagaatgtgaccggttttgaaattatccaaagcatcactgacaccctgtgtgtaagcagaacctccactccctccgctgc

SEQ ID NO: 15337 - DNA, 376 bp, Homo sapiens
atccagagaggcgctgctgacaccgccgccacaccgccgccacaccgccgctgcctcagtcatgccgatggtctcatttccagagattttaaaataaagtattggtataagtaatccttgtgtgaaagcaaagcaaaagatccagaagttcaaaccagccatgtcaattatccattgactcaaaaaagcacgagttctctgtggacatgacctgtggaggctgtgctgaagctgtctctcgggtcctcaataagcttggaggagttaagtatgacattgacctgcccaacaagaaggtctgcattgaatctgagcacagcatggacactctgcttgcaaccctgaagaaaacaggaaagactgtttcctaccttgg

SEQ ID NO: 15338 - DNA, 489 bp, Homo sapiens
agaactatggaaagaaccatgtgtggagtttggcaccacagatattctctgagtgattgaagtctcttctaccatggtgagtggtaccatggaagtaatcttgtccccaggcctcctaagcttacttatgatgaagtgatgagactcttacccaagaaaccattacagaaaaaaaaatcctcgcctaataaaattgtgccagtgaacaaactctcagatatatggcgatattgacaagatctgcaatggtatcaaaagaggtcaagctaataacctgaggaaacaggaagaaaactccaattgtcttatacagaaggtctacaatcaataggatgaagtctaacactggcgagagtgggaggccttgaaagctccatgatagagatgacagagctataagatgaaagcagcccaaatccctgagtcaccaatgtttgaagaagagcttcccaggagaggtaccagacccacatgagacttcacatgatt

SEQ ID NO: 15339 - DNA, 200 bp, Homo sapiens
ggattccgttcctgtcagttcagtctctcttatcccaccaccaccgcctccgaaaaatgttgcccgaatgttggcgctasattagctgagtccgcacagcaagcctcaactcagtcattgaagagaccagggacctctcaggctgggtatacaaattatggagacatagcggtggctacaactgaagataatctgtccag

SEQ ID NO: 15340 - DNA, 522 bp, Homo sapiens
attatccattgggtggctgttgaaataattggtggagctaaaatccttcagttctcacaactgggactcgctttccaaatacgttcgtgtatagactctagtcacagtactctgcctgcacttcatcagcacctaccctgtctgctttcagctggatcattgcatccagccggctgtcatcaccaaggatgtgtgcatggtcttctactcccgagatgccaagatctcaccaccacgctctctgcgtasctctttggcagcggctactcaaagtcaccagattcgtaagtttttcacacaagttagcttccagtgtgtttgttcagtacaacagaatcattagtccttaagtattctcggcttactgtctcacggttagtttacagtttatgaaccattttggtaactgacacctggaatgtactgacttgcatgctgacatttaataaaatgttgatggatggacgagttatgagggaaggaaggatattacattgtgaacacgtctaaaacaattttgca

SEQ ID NO: 15341 - DNA, 197 bp, Homo sapiens
acagtggcagccgccattttggagctggagactagcggcggagacgaggaggaacctgggcgagaccatctccggggggtgggcacggtgctgtcggaaggcgacggcggtcacstggcacgcctcgtctgtctggagcagaaattttattcagaaattattggtaatgtttggaagccaaaaaaaaaaaaaaaaag

SEQ ID NO: 15342 - DNA, 350 bp, Homo sapiens
atgattaagtggctaacccttttctctccaagtctctttatcctccagtaaaagaggagtgacagaatacacctcccaggaactgttacaaggattggtgagataacacaaaatttaccaagtttgagttcttcacttgatgatactttcactggaagcggcatcagctggtcacgtgttccaccatttcccagttgtccatcttttccagaaccaaaggaaaagacctttcccaaatcagaaacataggcaagtgtgtgccacctattaaataaaagcacatatggtcaaaaaaaaaaaaaaaaaaaaaaaaaaaaaaaaaaaaaaaaaaaaaaaaaaaaaaaaaaaar

SEQ ID NO: 15343 - DNA, 121 bp, Homo sapiens
acagtggcagccgcattttggagctggagactagcggcggagasaggaggaaccagggcgagaccatctccggggggtgggcacggtgctgtcggaaggcgacggcggtcacstgcacgcc

SEQ ID NO: 15344 - DNA, 428 bp, Homo sapiens
acctgctggctcacctccgagccacctctgctgcgcaccgcagcctcggacctacagcccaggatactttgggacttgccggcgctcagaaacgcgcccagacggcccctccaccttttgtttgcctagggtcgccgagagcgcccggaggaaccgcctggccttcggggaccaccaattttgtctggaaccaccctcccggcgtatcctactccctgtgccgcgaggcatcgcttcactggaggggtcgatttgtgtgtagtttggtgacaagatttgcattcacctggcccaaaccctttttgtctctttgggtgaccggaaaactccacctcaagttttcttttgtggggctgccccccaagtgtcgtttgttttactgtarggtctcccgcccggcgcccccartgttttctgagggcggaaat

SEQ ID NO: 15345 - DNA, 482 bp, Homo sapiens
ttactttgtctaactcttgctaatgaagagctaattttgacttgtctttaaattggatgagctgctggggaagcttcttttatgaaattcaggaggtatggagtgagagatatgggtgagaggacgcccagccgcaaccaaactcaagattgaccagctgtgattaaaacaataggggccaggcatggtggctgatgcctgtaatcccagcactttgagaacccgaggcaggcagatctcctgagagatctcctgagagtttgagaccaacctggccaacatggtgaaacccgtctctgctaaaaatacaaaaaatgagccgggcatggtggcaggcacctgtaatcccagatacttgggaggctgaggcaggagagtcacttaaacctgggaggcagaggttgcagtgaatcaaggtcacaccacagaacttcagcttgggtgacagagcgagactctgtctcaaaaaaaaaaaaaaaaaa

SEQ ID NO: 15346 - DNA, 499 bp, Homo sapiens
attcctaggctgtttctgtttgtgctcactttctttttttgaggctgtgagtggaaagtgtggatccctgtgcccatccaggcctgccttttgcataactctaagcgtgcacagtcccattcctgtttgcagtgttctctcctggaccagctttgaagaatgccatccgggactttgagtacccctgctccacactgtcaaaatcctttcagagaactctgctcccagaaaacaaaagccaaggaaacagatttgttttaggcccagtgatagaactcttctcaaaggaaaggtgacatttaggtctgtttattctcagaacagggaaaaaaaaaaatcctagcaaggagcacagcatgcatcagtagctcaatgatttattctgcctcagtaggatggggtggacttactgggcaaccactgacttcatttaatggtaacctgcagatatctcccggggccaattcagcatctctacctggccatcctaacaaggtga

SEQ ID NO: 15347 - DNA, 447 bp, Homo sapiens
atgccttattctgttttggtgtatttggtgaaacaaacaattttgatgacaccttttccctttctaaacaggtttgctgttatagaagactggaaagattggaaaggttattagagaacacacaggcttctatgttctatgctccttttcctcaggaggaattaacagcttctttatgtttctagagttactatctgaagatttttctcaacctcccaacaaaatcctttgtttgagacatgggattttaaagggacgtggctgcaaatttctcaagaccttgaagtaaggaagcttatgctttgaaaagaaaagtaaaactgggtgtgatggcctatgcctgtaataccagtgctttgggaggctgaggtgggaggatcacttaaggccatgagctcaagaccagcctgcgcaatagagtgagaccttatctcaacaaaaaaattt

SEQ ID NO: 15348 - DNA, 395 bp, Homo sapiens
aggggtatagtgggctgsagtaagcactgggaccttgagagactcaggccagcagaaaaatcaagctgtgacaaccggggcaaaacccagcaaacatcatggctggaaacaaacacagtcgcagctcctgtaagcctagaagacagtgcctttcccgttccagaagagcggastgcagtttcttgttagccacatggaacgctgcctgcgagaaggtcagtatgcccggcacctgagctcaaccacacctgttttcctggctgctgttctcgagtacctgacagccaacatcctggaacaggcaggcaaggaggcccagaacagccacagggtgtgcatcaccccaggaacacctgaagagagcactgcaaaagaatgagcagctaagatggatc

SEQ ID NO: 15349 - DNA, 263 bp, Homo sapiens
ccaaagtaagaaatcacatacgcttacgttttactattcaattcaatcctccctcccattgcacttatctaccttccccaagttgtttgtattaaaaaaaaaaaaaaaaaaaaaagtaaagaaacataaccaaagccatttcatttggctggggggttggggagtggggaggaaaacaatctttatyytaccccatctattgaagagtattattacattkgaaataaaacttccatcagkvcagaaaaaaaamaaamaaagct

SEQ ID NO: 15350 - DNA, 392 bp, Homo sapiens
  misc_feature 335: n=a, g, c or t
aggggtatagtgggctgcagtaagcactggcaccttgagagactcaggccagcagaaaaatcaagctgtgacaaccggggcaaaacccagcaaacatcatggctggaaacaaacacagtcgcagctcctgtaagcctagaagacagtgcctttcccgttccagaagagcggastgcagtttcttgttagccacatggaacgctgsctgcgagaaggtcagtatgcccggsacctgagctcaaccacacctgttttmstggctgctgttctcgagtacctgacagccaacatcstggaacagcaggcaaggaggcccagaacagccacagggtgtncatcacccagaacacctgaagagagcactgcaaaaraatgagcagctaaaraatgga

SEQ ID NO: 15351 - DNA, 517 bp, Homo sapiens
aaatattcaccttgtctttgatcttttcagttttwtatttgttctttccaattcttggtggatttgtaagctcatagaaggcaaggactatgtattattcatttttctgtagcttttttgtagcacttttagccatatgcgctttaaaaatgttaatttataattgacattgaaattgtactccaaagagttaaagaaataaatgcctaacagattcttgagtttgtaggatgacagattaaaaaaacaactacttgctgaaatgctggaactccctctgcttgtaggataacaaaactggctgaaattgattggaaccaatatggctgactacagtctatgcagaatgaacttgctgacatcacagtccaaattcccgccacatggttcatactakcttctcctgaaattgcatgtgtgactcatgaagaggcatgaagagataacagtacatgcttgaggrctctccagacctcctctttccctcccccaatcatgtactaaagccagaatccac

SEQ ID NO: 15352 - DNA, 390 bp, Homo sapiens
aattttttatttgttctttccaattcttggtggatttgtaagctcatagaaggataacaaaactggctgaaattgattggaaccaatatggctgactacagtctatgcagaatgaacttgctgacatcacagtccaaattcccgccacatggttcatactatcttctcctgaaattgcatgtgtgactcatgaagaggcatgaagagataacagtacatgcttgaggactctccagacctcctctttccctcccccaatcatgtactaaagccagaatccacccttgaacattttctaataaaaatactgccttgaaggtggcaccaggagacagaaaaaaaaaaaaaaaaaaaaaaaaaaaaaaaaaaaaaaaraaaaaaaaaaaaaaa

SEQ ID NO: 15353 - DNA, 258 bp, Homo sapiens
tgatgagagagttacaaagaacaaaactccagacacaaacctccaaattcttcagcagaagcactctgcgtcgctgagctgaggtcggctctgcgatccatacgtggccgcacccacacagcacgtgctgtgacgatggctgaacgcaaagtgtacactgttcctgaatattgaaataaaacaataaacttttaaaaaaaaaaaaaaaaaaaaaaaaaaaaaaaaaaaaaaaaaaaaaaaaaaaaaaaaaaaaaaaam

SEQ ID NO: 15354 - DNA, 485 bp, Homo sapiens
acaggattggggttgtgtatttttaaaagtattgagctttataatgtaattattcaagaaatagaatcatggtttttttatgatgttgccagcattttaaattacatgtttattaagtggcattgctcaaataactacagagtatgcgtggaaatatttgctgtctgaatagtttggagattcaaagagaaaaatcaagcttcagaggtgtctgatgatttgtgagcctcaagtgactactctgtggaatcatctgtccttgcctttgaattagctttccctaggccatgagtcaacattagtagtttatacatccaaattgatgacaagagcacctcaaaggcagcagctcaaggagcagccatggccccagacttgtcgcacggatgcagaaaacttaatggaggaggctgaggtcagaatgggaagagtttttaaaaaataaaggggagctaatatgtgagcaaaaaaaaaaaaaaatgcga

SEQ ID NO: 15355 - DNA, 444 bp, Homo sapiens
atgaacacagatgtgaggggatttgaaccatctacaatcaatccatatgtgaccaatggaggagaagcagccccaaaagacgaaggaaccctcaaaagaagatgagcctcagcagaaggagatgccaacccatttgtccttaggagcagagtcaaaggcagaggctaaaactccagttctggttgagacacagacagtggacaatgccaatgagaaatcagaaaaacccccagaaaaccaaaagaagctctctgacaaagatacggtagccaccaagatccaggcctggtggcggggcacctggtsgtcgggcactgttgcacgcagccctcagtgcctgcatcattcagtgctggtggcggctgatactgtccaagattctgaagaagaggcggcaggcagcgctagaggccttctcccggaaggagttgggcagcagtcaca

SEQ ID NO: 15356 - DNA, 500 bp, Homo sapiens
atttttcaaccctactgccgtagagcaggcggagtccctcttttcgcgccttaagacagaaacacaaaatgatcctctgacaagtgatgaagaagaatgggaagatgtgaaaatccaagcaagaagaacttaggggaagcaactcaacatctaagaagaaatgaatagggatcagttccaagaagagataaaggggaaatacccaagaactgggatgcttcgtctttggtttcttctggatcctccctaaattttggctaagaaatctgagtctccatttaagagtgttcccagaaatgatgacatccacatccaggaacctcctccttccttcacttgaactctcttgcttctggggagccaggacctatggagtaaaaatcaagttcatttggtgacacattccctccgggcccagatgctgtctctgctgctgtaaactctcctgcagtcaaggccaagcaatatatcttaagcatccctaaaaaaaaaaaaaaatg

SEQ ID NO: 15357 - DNA, 426 bp, Homo sapiens
atttttcaaccctactgccgtagagcaggcggagtccctcttttcgcgccttaagacagaaacacaaaatgatcctctgacaagtgatgaagaagaatgggaagatgtgaaaatccaagcaagaagaacttaggggaagcaactcaacatctaagaagaaatgaatagggatcagttccaagaagagataaaggggaaatacccaagaactgggatgcttcgtctttggtttcttctggatcctccctaaattttggctaagaaatctgagtctccatttaagagtgttcccagaaatgatgacatccacatccaggaacctcctccttccttcatttgaactctcttgsttctggggagccaggacctatggagtaaaaatcaagttcatttggtgacacaaaaaaaaaaaaaaaaaaaaaaaaa

SEQ ID NO: 15358 - DNA, 415 bp, Homo sapiens
  misc_feature 287: n=a, g, c or t
atttttcaaccctactgccgtagagcaggcggagtccctcttttcgcgccttaagacagaaacacaaaatgatcctctgacaagtgatgaagaagaatgggaagatgtgaaaatccaagcaagaagaactttaggggaagcaactcaacatctaagaagaaatgaatagggatcagttccaagaagagataaaggggaaatacccaagaactgggatgcttcgtctttggtttcttctggatcctccctaaattttggctaagaaatctgagtctccattbaagagnvttcccagaaatgatgacatccacatccaggaacctcctccttccttcatttgaactctcttgcttctggggagccaggacctatggagtaaaaatcaagttcatttggtgacacaaaaaaaaaaaar

SEQ ID NO: 15359 - DNA, 413 bp, Homo sapiens
atttttcaaccctactgccgtagagcaggcggagtccctcttttcgcgccttaagacagaaacacaaaatgatcctctgacaagtgatgaagaagaatgggaagatgtgaaaatccaagcaagaagaacttaggggaagcaactcaacatctaagaagaaatgaatagggatcagttccaagaagagataaaggggaaatacccaagaactgggatgcttcgtctttggtttcttctggatcctccctaaattttggctaagaaatctgagtctccatttaagagtgttcccagaaatgatgacatccacatccaggaacctcctccttccttcatttgaactctcttgcttctggggagccaggacctatggagtaaaaatcaagttcatttggtgacacaaaaaaaaaaaa

SEQ ID NO: 15360 - DNA, 416 bp, Homo sapiens
atttttcaaccctactgccgtagagcaggcggagtccctcttttcgcgccttaagacagaaacacaaaatgatcctctgacaagtgatgaagaagaatgggaagatgtgaaaatccaagcaagaagaacttaggggaagcaactcaacatctaagaagaaatgaatagggatcagttccaagaagagataaaggggaaatacccaagaactgggatgcttcgtctttggtttcttctggatcctccctaaattttggctaagaaatctgagtctccatttaagagtgttcccagaaatgatgacatccacatccaggaacctcctccttccttcatttgaactctcttgcttctggggagccaggacctatggagtaaaaatcaagttcatttggtgacacaaaaaaaaaaaaaar

SEQ ID NO: 15361 - DNA, 412 bp, Homo sapiens
atttttcaaccctactgccgtagagcaggcggagtccctcttttcgcgccttaagacagaaacacaaaatgatcctctgacaagtgatgaagaagaatgggaagatgtgaaaatccaagcaagaagaacttaggggaagcaactcaacatctaagaagaaatgaatagggatcagttccaagaagagataaaggggaaatacccaagaactgggatgcttcgtctttggtttcttctggatcctccctaaattttggctaagaaatctgagtctccatttaagagtgttcccagaaatgatgacatccacatccaggaacctcctccttccttcatttgaactctcttgcttctggggagccaggacctatggagtaaaaatcaagttcatttggtgacacaaaaaaaaaaa

SEQ ID NO: 15362 - DNA, 416 bp, Homo sapiens
atttttcaaccctactgccgtagagcaggcggagtccctcttttcgcgccttaagacagaaacacaaaatgatcctctgacaagtgatgaagaagaatgggaagatgtgaaaatccaagcaagaagaacttaggggaagcaactcaacatctaagaagaaatgaatagggatcagttccaagaagagataaaggggaaatacccaagaactgggatgcttcgtctttggtttcttctggatcctccctaaattttggctaagaaatctgagtctccatttaagagtgttcccagaaatgatgacatccacatccaggaacctcctccttccttcatttgaactctcttgcttctggggagccaggacctatggagtaaaaatcaagttcatttggtgacacaaaaaaaaaaaaaaa

SEQ ID NO: 15363 - DNA, 433 bp, Homo sapiens
cataaattgtgaaatttaaagtacatttgaatagaccttgctgtgagtgatcatgtgctatttttggggggtggattattagtggattggttatccatgacttttcttctcaatacatttcataaaaatgtaagaacggcggggcgcagtggctcacgcctgtaatcccagcactttgggaggctgagacgggcagatcacgaggtcaagagattgagaccatcctggccaacatggtgaaaccttgtctctgctgaaaatgcaaaaattcgctgggcatggtagcacatgcctgtagtcccaggtactcgggaggctgaggcaggagaatcacttgaacacaggaggtggaggttgcagtgagccaagatcgcgccactgcactccagcttgggtgacagagcaagactctgtctcaaaaaaaaaaaaaaaa

SEQ ID NO: 15364 - DNA, 414 bp, Homo sapiens
atttttcaaccctactgccgtagagcaggcggagtccctcttttcgcgccttaagacagaaacacaaaatgatcctctgacaagtgatgaagaagaatgggaagatgtgaaaatccaagcaagaagaacttaggggaagcaactcaacatctaagaagaaatgaatagggatcagttccaagaagagataaaggggaaatacccaagaactgggatgcttcgtctttggtttcttctggatcctccctaaattttggctaagaaatctgagtctccatttaagagtgttcccagaaatgatgacatccacatccaggaacctcctccttccttcatttgaactctcttgcttctggggagccaggacctatggagtaaaaatcaagttcatttggtgacacaaaaaaaaaaaaa

SEQ ID NO: 15365 - DNA, 454 bp, Homo sapiens
atttttcaaccctactgccgtagagcaggcggagtccctcttttcgcgccttaagacagaaacacaaaatgatcctctgacaagtgatgaagaagaatgggaagatgtgaaaatccaagcaagaagaacttaggggaagcaactcaacatctaagaagaaatgaatagggatcagttccaagaagagataaaggggaaatacccaagaactgggatgcttcgtctttggtttcttctggatcctccctaaattttggctaagaaatctgagtctccatttaagagtgttcccagaaatgatgacatccacatccaggaacctcctccttccttcatttgaactctcttgcttctggggagccaggacctatggagtaaaaatcaagttcatttggtgacacaaaaaaaaaaaaaaaaaaaaaaaaaaaaaaagaaaaaaaaaaaaaaatgcgaa

SEQ ID NO: 15366 - DNA, 425 bp, Homo sapiens
atttttcaaccctactgccgtagagcaggcggagtccctcttttcgcgccttaagacagaaacacaaaatgatcctctgacaagtgatgaagaagaatgggaagatgtgaaaatccaagcaagaagaacttaggggaagcaactcaaacatctaagaagaaatgaatagggatcagttccaagaagagataaaggggaaatacccaagaactgggatgcttcgtctttggtttcttctggatcctccctaaattttggctaagaaatctgagtctccatttaagagtgttcccagaaatgatgacatccacatccaggaacctcctccttccttcatttgaactctcttgcttctggggagccaggacctatggagtaaaaatcaagttcatttggtgacacaaaaaaaaaaaaaaaaaaaaaar

SEQ ID NO: 15367 - DNA, 413 bp, Homo sapiens
atttttcaaccctactgccgtagagcaggcggagtccctcttttcgcgccttaagacagaaacacaaaatgatcctctgacaagtgatgaagaagaatgggaagatgtgaaaatccaagcaagaagaacttaggggaagcaactcaacatctaagaagaaatgaatagggatcagttccaagaagagataaaggggaaatacccaagaactgggatgcttcgtctttggtttcttctggatcctccctaaattttggctaagaaatctgagtctccatttaagagtgttcccagaaatgatgacatccacatccaggaacctcctccttccttcatttgaactctcttgcttctggggagccaggacctatggagtaaaaatcaagttcatttggtgacacaaaaaaaaaaaw

SEQ ID NO: 15368 - DNA, 442 bp, Homo sapiens
aaaccctgagcggtctctgaggacctggtgagcagtcttgctctgttgcccaggctggagtacaatggcacgatctcagctcactgcaacctctgccttctgggctcaagcgattctcctgcttcagccttctgagtagctgtggactacagattgttgcaccattagaagctaggttgatccacagacagatggctgaaagtggaaaagaaaaaataaaatggacaaccaccattattattagctcatctcttaagagttatgaagttgcaactgccctagaaaatcgaagccacaaagttcgatattcagattcagtggaaaatggatcaattatattttctctttctggagttgcatttttattaatggatactaaggaatgtcttctgtcaactgaagaaatatttctagccaaaattgagaaatttattaacattca

SEQ ID NO: 15369 - DNA, 549 bp, Homo sapiens
gcagtattttgtctttccattatgagttagccatttgcaaaactgtggactatggaaagggcacacccgtagagtcatgtcttgctcttttcagtgcactttgactctcttttcccagacacctgctctttttctctcctcagtagcaccagtgtgtcatagtcccttttgtttaataaaggaaaaaattctgaatacattcacactaaaatatgatgtgagttagtatttatttcttttccacgcttgcttaggaaggctaaggcatagctgaaagtcagaaatgtttactgagtgctggatttgaggcacagtggcacttgagaatgtcattctacagtcacagttttgcagccctccacaatgggacacaactgtgtatttctgaaggcactatctgttagagaaatgtgttgaaaaatcaagttcctggcaaaggagaaagctgtgtctattaagcaatgattcccagcaaacctttctccaggctgataagtaggtttggctctttgaaagccttctcgtagtccattaagcagcatgagcatc

SEQ ID NO: 15370 - DNA, 487 bp, Homo sapiens
  misc_feature 405,417: n=a, g, c or t
agaacgtatattttggtggtggtagccttgtgcctccctttgtgcctgttataattgtgttgctctttgttcttagtctacgtctatctttctttgtagaggttgcgtgctcgcatttgaccttcaaatctaatagtttttcctccaattggagacgctttaggattctaagagaaagcaagctgcaaggggtttcccctttaatctagaaatgtggagtctcagcccacttaattttgctcactcttaaaagcatttcaaccaaagccattcattagggatttgatttggaggcaggagggattcctatactgttttaagtgtgtattaattctttcaatttatcgaatatttagtgagtacctgctatgcactaggcactattctcggttgtgggtacagcanggaacatcacanaccaaaatctttgccttcactgagcttatgggatagtgctggtggtggaagtgcamatattggtcaagta

SEQ ID NO: 15371 - DNA, 501 bp, Homo sapiens
tattctcaattcctcttcttttgtgtatgtatatgtgttagccattttttatttccacccttaagttaccaattatataaatggaaaacgtgcttttccttataaaattaatattttaatataggaggctttcaaggttcctgaccttgaaagaggttttcttttccgacttctactttaaatcaaatatgtcttttcctataggatacaagtggcttcacttagaagattctgaattactttgaggttccacttttttattttatttttaaatctactttttttcagtgtaaagccagagattcttaaaaatcaataagcaaattctacataggtggggataatctgtagaacttagtgcatttcgtaagtgtactaacaaaaagattaatactgacttccatacacataagaagcattaaaggaagcctggttatcttttgagacgaagctcgcctctgtcacccaggctggagtgcagtggcgcatcttggctcaccg

SEQ ID NO: 15372 - DNA, 495 bp, Homo sapiens
tagaatagatgtttggtttcttttgggggtgtctgagtgtatatgtgtgtgtatatacacacaagaacacacatatttatatactatacacacacattttaatgtatataaatatttgctacattctgtgtgttatataatgtggtacccagtcctctgctgggacatggatgtacataatgaaacatggaggtccagacgtatgataactctcctgtttcccttccctcattgcctacaggggcaatagtttcatatcttgggttttttattgtttaatttttttttatggggaggggttctttgggtgggtaatagtcagggggaaaggacagtgtctatactttttaaagatgtatataaatgtttcatgttattggttttgtacctagtcctttgcatggatatataggtacctaatgaaaatcgaggatcagtgtatgacaaatctcccatcctcccctttccttattgcctgtgtcggcaataggaagt

SEQ ID NO: 15373 - DNA, 506 bp, Homo sapiens
tagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagattttcgtgtacccattctgtttcaggagctcttctaggtaaagctgagatcacaggaacagcaggtgacaggcctagctatagttaggaatacacaagccgtaaaatcgagtccttacagccataccacaaggtacgtccatttggactacaagaagagcttcctttaaagttcctatttcagcataaagaggctgtcctttttttttgaggaatagtttggaccttgtgcctcctgtgggaggctgaggactgcaagaggagagctagcagatatgcctgttcacccctctctggtacttgtggcttgctagtatgtttttatgataatctc

SEQ ID NO: 15374 - DNA, 420 bp, Homo sapiens
gattcataggagcatataatataatctttgtaaagtagagggacaattcagtattttgtacaatatgtagaataacatgttctcttagtaggcataggatatactacattaagaaatctgggctaagcgtggtggttcatgcctgtaatcccagcactttgggaggccgaggcgggcggatcacttggggtcaggagttcgggaccggcctggccgacatggtgaagccccgtctttactagaaatacaaaagttggccgggcgtggtggtgggcgcctgtggtctcagctactcggggggctgaggcgggagagtcacttgaacccgggaggcggaggttgcagtgagccgagatcacgccactgcactccagcctggatgacagagtgagactctgtctcaaaaaaaaaaaaaaaaaa

SEQ ID NO: 15375 - DNA, 526 bp, Homo sapiens
acaatacgaggccgagggaggaattctgtcgtctgggaacggctggtttcgcggtcagacgccgagggccctcgaagtccctagcaacggctgcggagggagattccacctaggtccgtgcaggttacaaatggcaaccagaacagggactccaagcacgcccaactagcagcatccaaacatgggacttcaaggacgtgaatgaagaaggtctgctggagcagaggaactgaaattgacaaggcgaaaggggaccctgggaagagtctgccggcagcagatataagtctgtaaaatcggatggaccgccaattggagaatgagagcctcccagcccagccttacattctttcaattaatacataaacagaaagggggatatgcagggagccaaaggcctgtgggacgtgaccaactcagcattctgctggaggctatatgatcaaacagcaaactgtttatcatgaatacaggatgtgagcaaactcaggactgctcctgccaacataaggtttgctggaggcaa

SEQ ID NO: 15376 - DNA, 496 bp, Homo sapiens
gtaaatcgcttgagacctgtatttggttgttttgttggttttgccaagtaaggtcacttgaggatttcttggctcgaggtcccaggttgcgcagactctgactgcatcgagttgagaattttggtcagaatgttaaagtggaaacctaccccaggctgtcatgagatggggtcccactatattgaccaggctggtctgtaactccgggcctcaagggatcttcccaactccacctctcaaagtgctggattacagcctgagccactggacctggctactgtccattctttgatgaagacaaagtttaccctgaaatcctgttcaggggcaagagaaatttcaaaagcgaggatctacccttatacggttcacagatgaattaaggagtgcagatgtgcccagggcagctagagaacaagcaaaatcggtcctcaagcattttcttgcttttctcaaatatgtgggaagacctctaagcaggaagagacacaggtac

SEQ ID NO: 15377 - DNA, 569 bp, Homo sapiens
gtattccaaaaacgagtttatattttcaaacggtttttacagcttagactttgtacttactgccctgcctgtgacagttgtatgccttcattttgtatccaacagcaaagtctacaataaaactttaaaacaatcatgactgaatgtcaaaatcgtgtattgggcagatgctttttaaactgtcgtgtgagaaacttttatattaggccatttggattttattaagtgctaaggaaagagggcttacaaaatgtttcgtaaatattttatactgtttaagtgttaaacaccaaccctgtctttcttttgggttgagcttttttagaaagtcgaagtgaatgttggccaggaaaatggaaaagccattgtataaatttttttttgaggcggagtcttgctctattggccaggctggagtgtagtggcaccatctccacttaccacaacttgtgcctcctgggttcaagcgattctgctgcctcagcctcccgagtagctgggattgcaggtacccatcagcccatgcccagctaattttgtatttttagtagagatggggtttcaccatg

SEQ ID NO: 15378 - DNA, 189 bp, Homo sapiens
gaggcgcgaaggtctggcctataaagtagtcgcggagacggggtgctggtttgcgtcgtagtctcctgcagcgtctggggtttccgttgcagtcctcggaaccaggacctcggcgtggcctagcgagttatggcgacgaaggccgtgtgcgtgctgaagggcgacggccaatgcagggcatcatcaatt

SEQ ID NO: 15379 - DNA, 125 bp, Homo sapiens
tcaaatgtcattctaaagaatgaggggtgggagggatttatagttagaaacgacagtgcaggaaggggtattttcttgttgtcagggctggaatgaatcactgctgctcaagtcaaaggttcttg

SEQ ID NO: 15380 - DNA, 506 bp, Homo sapiens
tctcatccatggatgtccactcaaattaggtttcaccctggaccagtcattctaaatacagtgtgtgctacatggaaccccttgtttctaccccactctcaactctccctaatgctgagagacgtcccaccaaagaatgcatcatgagctccagccaccactgaacatttgtggctaccaggccttgtggccacggtgccctctgatgccttcaatgcattttagggtgggtaaatcatgttctaaccatctttgccctctggtaatgaatagctaagggcacacgagggaggccaaatgtaaatgttactaagatgctaagactttctggcccggcacagtggttcatgcctgtaatcctagcactttggtaggccaaggcaggcagatcacttggggtcaggagttcaagactgccctgggcaacgtggtgaaacctgtctctactaaaaaatacaaaaattagccagacatagtggtgcgtgcttatagtcccagctactcag

SEQ ID NO: 15381 - DNA, 487 bp, Homo sapiens
acattctcatgggggatgcagtagcaggggcagaggcatcccaatgagaaggccagggaggctggcttgttcctaaatccacatgggacaccaccctcaggcacccattctctgagatgagaaaactgaggctcaaagagattaagtgactcggaagatgacacagcacagctggccttcaaatcaggtcctcctgactctagaacctgagcttttttgttgagacccattttgccttatgttgctttccagattagttttcattctcttcccacaagggattaataccaaatacggagtgtgatggctcttgagaaacccctgtcctccctgttggtcaaatgctaagaaaccaaacttaaggcagaaaagcatagaatctcacctcttcaccagacagggccacggtgttgagccaatagtaacaaagaatgccaatgattgatattttcaaaaagatgtttctaaacagaagagacaacattta

SEQ ID NO: 15382 - DNA, 413 bp, Homo sapiens
agcaaggggctcagatggagggggaggaggacctgaacaagtccagaagggaagagatttgtccctctatccaacagagtacccagtgagcagcacagagggcacagcaagggacatcacccggttcccccaaatgctcagagccacaagtgaagccaaaagtgaaagacaagatgcagaaaaccgccacgggcctttgagtaagggtaaaggcgaaasgaaagcaggaagtacagacgtgaagcctagcagaggactttttagctgctcactggccccgcttgtctggccgactcatccgcccgcgacccctaatcccctctgcctgccccaagatgctgaagccagccctggagccccgagggggsttctccttcgagaactgccaaagaaatgcatcattggaacgcgtc

SEQ ID NO: 15383 - DNA, 491 bp, Homo sapiens
gaccaagttgtaatttttccaatatagagtctttgcatcacactgaggcatcttgcacagctgcagttaaggtgagaaagaatgctctgtgtgaagacagtgtacacaatgggttccggtttccttgccaccttgtgcagtatcctttatttctgtgctgttctctcctgagcatkraaaaatgatcattatccaatttgtatttccttggtacatattttaaaaacaacacagtcattgactttacaattcagtaatgaagtttggcaaagcctattttgtaaacaagttaattttataatgtaaaaaaaaaaagttaatctaaccttgacttgttatttgcactttcatagkctatacttgatacattcccactttatatacagtaggattctacaaacgkgtagatgtttggccaaatgaatgctgttaakaatakgtaaaattcttkgattaaacatttattacttaaactaaaaaaaaaaaaaaaa

SEQ ID NO: 15384 - DNA, 201 bp, Homo sapiens
gtcttaacaagaagagaaggcttcaatggattctcttgtggtccttgtgctctgtctctcatgtttgcttctcctttcactctggagacagagctctgggagaggaaaactccctcctggccccactcctctcccagtgattggaaatatcctacagataggtattaaggacatcagcaaatccttaaccaatctctcaaa

SEQ ID NO: 15385 - DNA, 465 bp, Homo sapiens
  misc_feature 403: n=a, g, c or t
gtcttaacaagaagagaaggcttcaatggattctcttgtggtccttgtgctctgtctctcatgtttgcttctcctttcactctggagacagagctctgggagaggaaaactccctcctggscccactcctctcccagtgattggaaatatcctacagataggtattaaggacatcagcaaatccttaaccaatgtaagtatgctccttcagtggcttgcaaaagctctcaaaggtctatggccctgtgttcactctgtattttggcctgaaacccatagtggtgctgcatggatatgaagcagtgaaggaagccctgattgatcttggagaggagttttctggaagaggcattttcccactggctgaaagagctaacagaggatttggaattgttttcagcantggaaagaaatcgaaggagatccggcgtttctccctcatgacgctgcggaattttgggatgg

SEQ ID NO: 15386 - DNA, 172 bp, Homo sapiens
agtataaagggagcagggaaggcgggagacagcgcagtttgaatcgcggtgcgacgaaggagtaggtggtgggatctcaccgtgggtccgattagccttttctctgccttgcttgcttgagcttcagcggaattcgaaatggctggcgttacccaacttaatcgccttgcag

SEQ ID NO: 15387 - DNA, 274 bp, Homo sapiens
  misc_feature 96: n=a, g, c or t
aagtttgaatcgcgatgcgacgaaggagtaggtggtgggatctcaccgtgggtccgattagccttttctctgccttgcttgcttgagcttcagcgnaattcgaaatggctggcggtaaggctggaaaggactccggaaaggccaagacaaakgcggtttcccgctcgcagagagccggcttgcagttcccagtgggccgtattcatcgacacctaaaatctaggacgaccagtcatggacgtgtgggcgcgactgccgctgtgtacascascca

SEQ ID NO: 15388 - DNA, 543 bp, Homo sapiens
  misc_feature 344,373,497: n=a, g, c or t
agtataaagggagcagggaaggcgggagacagcgcagtttgaatcgcggtgcgacgaaggagtaggtggtgggatctcaccgtgggtccgattagccttttctctgccttgcttgcttgagcttcagcgaattcgaaatggctggcggtaaggctggaaaggactccggaaaggccaagacaaaggcggtttcccgctcgcagragccggcttgcagttcccagtgggccgtattcatcgacacctaaaatctaggacgaccagtcatggacgtgtgggcgcgactgccgctgtgtacascaccatcctggagtacctcaccgcagaggtacttgaactggcangaaatgcatcaaaagacttaaaggtaaancgtattacccctcgtcacttgcaacttgctattcgtggagatgaagaattggattctctcatcaaggctacaattgctgggtggtggtgtcattccacacatccacaaatctctgattgggaanaaagacaacagaagactgtctaaagatcctgattcttgttatctca

SEQ ID NO: 15389 - DNA, 313 bp, Homo sapiens
aagtataaagggagcagggaaggcgggagacagcgcagtttgaatcgcggtgsacgaaggagtaggtggtgggatctcaccgtgggtccgattagccttttctctgccttgcttgcttgagcttcagcggaattcgaaatggctggcggtaaggctggaaaggactccggaaaggccaagacaaaggcggtttcccgctcgcagaragccggcttgcagttcccagtggccgtattcatcgacacctaaaatctaggacgaccagtcatggacgtgtgggcgcgactgccgctgtgtacagcaccatcctgga

SEQ ID NO: 15390 - DNA, 417 bp, Homo sapiens
tactttgatgttgctgaaagaattattgtctgttcaaaaaggtagcattgttttttgctgttggatgtttctttcaaccttgtgttttgttactgctcctaaagaatcagttatgcggccaggcgcggtggctcacgcctataatcccagcactttgggaggccgaagtgggtggatcacctgagatcaggagatcaagaccagcctgaccaacatgtagaaaccccatctctactaaaattacaaaattagctgggcttggtggctcatgcctctaatcccagctacttgggaggctaaggcaggagaattgcttaaacctgggaggcggatgttgtggtgagttgagaccacgtcattacaccccagcctgggcaacaaaagtgaaactctgtctcaaaaaaaaaaaaaaaaagc

SEQ ID NO: 15391 - DNA, 442 bp, Homo sapiens
atctaatgaggagcgaggtgcggtgccccgaagcgctcgcttcccgcggtgcgatctagtcctgcagtaggcggcccggggcacaccgcggccgcccaagccagtgcaaggcccaggggctgacatcgctcccagcgctcgaggaccgaggcctgctgtggaggacaccgtgctccctcgggacctgctctggattccggcccggacgtccccttggagctctgcatctccaacctggaacccaacccagaagtctcaagtttgacgcatcacgtggcgtgcggatccaccgagggtccacagagaggggcgccatctcctgcgtctcagttatcctggtgttgggaattctgtgccctaaagaattccgactcagatccgaacggggatctggtggaatcgagggtgaaagaccagakggacaatgttctactatcccaac

SEQ ID NO: 15392 - DNA, 128 bp, Homo sapiens
caaagcatcatgttgacaggttgttagttgatggtgactgcagctagttggaaagtcagaagaatctagaacttgtccatttatactaaagaatttcatagtaagtgcagtattatgagtgtaatgtt

SEQ ID NO: 15393 - DNA, 224 bp, Homo sapiens
cttttcccaggtacttggtactggagcgagtggacgagcagcatcgccgaaagtatgcccggcgtcccgtctaaagttctgcagatccatggaaagcttcctgggaaacgtatgctagcagacttctccccgtgaatcatatttttaagatcccactcttagctggtaaatgaatttgaatcgrcatagtagccccataagcatcagccctgtagagtgaggag

SEQ ID NO: 15394 - DNA, 444 bp, Homo sapiens
attactgttaccatgaaaaagaaatgaacagcagcacgtctgataccatcagctgggcagatgcattaaggttaaatctaagtgtcaagaaaaccctatttctttataatatttatgcagctgttaacgtaacatggtggcagcttcacaacaagaaccgtgatcatgcatgcagtcatgtctccagtattctgtgaaaagccaggatacgttaggatgtgagtttagaaactgagtccattcggtgcatggaaatccaccgcggagtcacacaatgctcctcactgtagtccaggcgattggtgggccgccagcaccctgcgggcttcacagggacgcgtgcttgttctccaagccccgcaacccttactgtgcacacaacatcgcacacacctttgtttttgaaattaaaatgtttatagttaaaaaaaaaaaaaaaaaggc

SEQ ID NO: 15395 - DNA, 482 bp, Homo sapiens
ttccccacctcccacctctacaatatcttagtaacaatatgcgcttaacaaattatttgctgccttagtaagtgagaagcctgcttgctttcccgtcttgcatccgggcctcctactgtggaaggtgcatgttagtttgcggggcagcagagggtgctgttgcctagccgctgtttagaaaatctgaaaatggccagtggcttgcctcggaatgtttcctcattctccatcatgagtacagtccttctggtgtgtcacctagacagcagaagaccttttagtgcagattcatcasdmagaaactcttttaaaaaattggagtgaagatagggagtgtgaaattcaagaatgactatttctcaaagtgaagtcacgtttttactgcctttttacatggatctcaaatctctgcaagactgraaactttgagraataaaaattgaaggtgccggggcagcctacaacatgtgacacgggctttc

SEQ ID NO: 15396 - DNA, 472 bp, Homo sapiens
acctctacaatatcttagtaacaatatgcgcttaacaaattatttgctgccttagtaagtgagaagcctgcttgctttcccgtcttgcatccgggcctcctactgtggaaggtgcatgttagtttgcggggcagcagggggtgctgttgcctagccgctgtttagaaaatctgaaaatggccagtggcttgcctcggaatgtttcctcattctccatcatgagtacagtccttctggtgggtcacctagacagcagaagaccttttagtgcagattcatcagtcagaaactcttttaaaaaattggagtgaagatagggagtgtgaaattcaagaatgactatttctcaaagtgaagtcacgtttttactgcctttttacatggatctcaaatctctgcaagactgaaaactttgagaataaaaattgaaggtgccgggcagcctacaacattgtgacacagctttcaagct

SEQ ID NO: 15397 - DNA, 490 bp, Homo sapiens
atgattccatctatattgagttatgaagagactacttaaacaaacaaaaccagatcaccacctgtaacaacaccaaacaaacaaaaccaagaactaggaaaatgaggaaaaaatatctgactgaatgaaaattattacctgaagcaatacagaaggagtacttaatgttcaaataaagtcattgaccaaagtatggaacagaaaatataaatgcatatttttaaagcaaacattttcatctcctaaagacaagataagacatggaatgagaaggagaaataaattaatcccaccatccaacagtgaaagaaaaaacacagaacatgaggaggaccagaaagcaatgtgaaaaagagttgaaaggagtcactgctgagctattttagattctacaccctctatccagccatgaacctatcagcgatcatgcctaactattgcataccccattagacaacctaatgtgaatgtaggaagcctattcatctaa

SEQ ID NO: 15398 - DNA, 431 bp, Homo sapiens
  misc_feature 394,401: n=a, g, c or t
actccgctcccagggtagcttgcagttctaaaggctagtctcactcccaccgtggctccctcaacagcaccgagtctatttctaggcagctggtgaccagggctgagaatttgccccagaccatgagcctcccccgttgagaaagcaagcagactcacagtttttcagcatctcagggaaacttcaggggtgatccagtttcttcaaagggtctgtggatcctctcagctttccctatttgctccaagaactaccacaggaacataagttcatgattggaaagctcaccagagatcctaaagaatgaagatttttctagcagccgtgctattacattgtacaaagacaagcgtcaagaatctgtagaccagctgtctttgattttgtcttatgnrttccanatttctcagaagctctacattcctcgaagt

SEQ ID NO: 15399 - DNA, 486 bp, Homo sapiens
agtagcggctgtattgcagcssytgccgaactgacccgggtctggggactggcccctctggcgccgttcggtttctcttattgccttcactgaggatgagtccctttgtggctctatgtggaccctgcggaatccaccggcgcagtttcatctagcgactggtcacccttgcaattatggatatttaaaagggtcagacagtgtggagggggagttcccctcctcactcccccttggtgcttgactccaggaataatttataaactgtggaatttttttaaatgaagaacttgtatttgatatgaactttatagagctatttataatttttttgatttaagtgccaaaaaattgtataaagatatatagttttatactattgtcaggaggatttaaattatcctaaaaaggtaatttattctctgtaacttcctcaatagcacctttgtgtcctggctttttcattttttaaaattagttttcacg

SEQ ID NO: 15400 - DNA, 575 bp, Homo sapiens
gcccagctattaattgataatgaacatttttcactatttttttttctatctgaagcttagagatctagagctttggatctttcgggtatatgtcaatggaggtattattttataatactttgcattgacatgaagtgggttcatgggggaaaaccatgagctgtgaacattggtagcaaacaagcatatattcatttcaaaactttccttgcttttagcagagagaagcctgtatatgttacatgtgtgactttcagtaktttaaagagatgtttcaaaaaattgttgcatgtttttgatgcaatttgggaaattgtttacttcacaatgtagtcattcataaaaaaattcatgaaaatactgaacatatgtttgaggatttttcttttcctttttaaatttttttattttttctgagacggagatctgctcttacgcccaggctagagtgaagtggcgcgatcttggcttactgcaacctccaccccccaggttcaagcgattctcctgcctcagcctccggagtagcwgggattacaggcgcccgccaccacgtccggctaatttttgtattt

SEQ ID NO: 15401 - DNA, 490 bp, Homo sapiens
gtaataaacttaacccaagaggcagaagacgcctacactaaaatctataaaatgtttccaaaggaaattaaagaagacaccaataaatagcaatatatcttttgttaatgaatcaaaagatttaatgctgaagtgccagtactttgcacagagatctacagatttcatgcaatccctattaaaacatcaacaatattttttgaaggaatagaaaaagaaatccaaaagtttatgtggaatctcaagggattttgaatagcaaaaggagtcttgaaatagaacaaaattggaggactcacacttcccaatttcaaaacttactgcaaagctacagtgataaaaacagtgtggtactggcataaaaacagacatttagaccaatgcagagtctagacataaaccctcacatatatggtcaaatgattttcaataagaatgccaagatcattcaatagtaaaggtattctttttaatgaatggtgctcagaga

SEQ ID NO: 15402 - DNA, 483 bp, Homo sapiens
ttatgrtttcaaggattagaaagacattttgaaaatctatgggctagattataaagcatttgaaagtaaactgtagtttttgctttgccaactgattgtttttcagtttttaaaactctttgttttttttgtaacattattctcttctgggtctcctaattttctgatcacgattatagattttaatgtgtaatggctccaaattcggctgggtgcggtggctcacgcctgtatcccagcacttttggaggctgaggcaggtggatcatgaggtcgggagatcgagactttcctggctaacgcggtgaaaccgtctctactaaaaatacaaaaaattggccggcatggtggtgggcacctgtggtccaagctactcgggtggctgaggcaggagaatgatgtgaacctgggargcggasttccagtgagccaagatggtgccactgcactccagcctgggtgacagagcaagactccgtcgca

SEQ ID NO: 15403 - DNA, 486 bp, Homo sapiens
ccattttaaaccggtcttttggggctgcagtaaaaaataagaaatggagttttcttgctttttactctaaaattcaatgtaattaaatttcatatatatataatatattacatatwttcatagtgtaaaataaaatgtttcttggacaagaaatcccctgaaattcagctgttatagtgcttcactgtttttgcactgatttttctataccttaggtggtcagaagacaaccttgaatgcactcatagagaaaactgttactttctgacgtaatgtaattcaggaagacagacgctgcaatcacagattttaaaaaattgtttgcacttaaaaatagttgaatgctggtggaaagttactttgcagatgggtgtaaggactcatggccctctgaggtgcggcgtgaagatgccctttttacccgttgacgtttattttacgtaaaataaactgttgtttccaatgcaatcaactctgtattatatg

SEQ ID NO: 15404 - DNA, 275 bp, Homo sapiens
caggggcagaacttccggccagcgcgccattttggcttcctgaccttgggctacggctgaccgttttttgtggtgtactccgtgccatcatgtccgtcctgacgccgctgctgctgcggggcttgacagtgtcagcactcatctcctcctcccacatttctggagcttttttttttccttccccattgacctttgtggtcttctgtwatwatttatgctgcctcccaaggatagaattgaaataaaatgttttcaacttaaaaaaaaaaaaaaaa

SEQ ID NO: 15405 - DNA, 361 bp, Homo sapiens
caggggcagaacttccggccagcgcagccattttggcttcctgaccttgggctacggctgaccgttttttgtggtgtactccgtgccatcatgtccgtcctgacgccgctgctgctgcggggcttgacaggctcggcccggcggctcccagtgccgcgcgccaagatccattcgttgccgccggagggaagcttgggatcatggaattggccgttgggcttacctcctgcttcgtgaccttcctcctgccagcgggctggatcctgtcacacctggagacctacaggaggccagagtgaaggggtccgttctgtcccccttgtaacaataaaatctatttaaactttaaaaaaaaaaaaaa

SEQ ID NO: 15406 - DNA, 148 bp, Homo sapiens
caggggcagaacttccggccagcgcccattttggcttcctgaccttgggctacggctgaccgttttttgtggtgtactccgtgccatcatgtccgtcctgacgccgctgctgctgcggggcttgacaggctcggagtacaccacaaaa

SEQ ID NO: 15407 - DNA, 295 bp, Homo sapiens
caagattagatttggggatattattttttaagctaatattttggtggacaagttttagtcattcatgctcagcaaaacaacgttttaggatggtgagataagacaaagtaattgatagaagaatgtggacactacttcaaaataactgggaaattatgaggctgggcacagtggctcaggcttgtgatcccagcactttgggaggcggaggtgggaggactgtttgaactcgggagttcgggaccagcctgggcaacatggcgaaataccatctcttaaaaaaaaaaaaaaaaaa

SEQ ID NO: 15408 - DNA, 440 bp, Homo sapiens
agtatcagtgttcggtggctccactggaactacgcagagccagaccagcgggaccacagaatgggctgaggcggcggcggctgtttggataaagtcaacagcgggacgtggggcgtgacgcggtccggcatcctaagacgtgtggtttgagttgcgggcgagaccaggctttttttaggaccttgggcctgataagtgggcgactgcagtagtgcgggaactattatttgacaggaacatgacaggaagtgtagggaccccatgcttgatggatggtgacttatagtgtggtatctcagtgttgatgggcatgaccgagacagcaggagtacccctaagttctggtgagaggtggagcctcagaaggacaccttactcaagctgtctttagttcccaaagacaaaaaggctcagtggaaaagattccttttttttttttt

SEQ ID NO: 15409 - DNA, 166 bp, Homo sapiens
attttggmttcctgaccttgggctacggctgacmgttttttgtggtgtactccgtgccatcatgtccgtcctgasgccgctgctgctgcggggcttgacaggctcggcccggcggctcccartgccgcgcgccaagatccattcgttgccgccggaggggaagctt

SEQ ID NO: 15410 - DNA, 506 bp, Homo sapiens
  misc_feature 15,207: n=a, g, c or t
atcagcgatggcggnctgcgtcggggtcggttctgcagcgctgtatcgtgtcgccggcagggaggcatagcccctctctgatcttcctgcatggctcaggtggatttcaattttacgtcctggttttctacagctcgggaaacatcctcccctcggttaccccagtattgcccaagtggaggtgtcgccgggcccaaatagggccantgggtggctcccccgtcgccagcccaggctgtagatgcacgggcagcgcacctgcccccagcctcccccgttagtcttcctctttctatcgggcggtcactggtccaccaccctcgctttggggccttgtgtcccgccgctcagccagccctccatccccacaacacacctccccattcctcgccccaagtttaaacagagcaagttagtaaggtgattctggacaaggattaagaatgtggatcaagcaggttttaaatcaagatttaacattccaasacataaaaaattatttatcc

SEQ ID NO: 15411 - DNA, 57 bp, Homo sapiens
attttttcggtgatctggaccgccgccasccasacagcgctccagggcagaaaaggc

SEQ ID NO: 15412 - DNA, 348 bp, Homo sapiens
attttttcggtgatctggaccgccgccacccacacagcgctccagggcagaaaaggcgccccatgcccgcgcctgggccggcggggggcggasttgcgtgctgacgcataagagtcgagcgggggaacgtgcgtgtctcgagtcgcacggatggcaaccgtcgacgggcttagcgcctcaactgtcgttggtgtatttttctggtgtcacttctgtgccttccttcaaaggttctccaaatgtcaactgtcaaggagcagctaattgagaagctaattgaggatgatgaaaactcccagtgtaaaattactattgttggaactggtgccgtmgtggcctttgtgctat

SEQ ID NO: 15413 - DNA, 144 bp, Homo sapiens
taaataattacatatttatttacctgataaatatgtatctagttctacaaggtcacatttatgtggaagtccaaagtcaagtccttaggggataattttgctttggctcagttgttccctgcttcctttttttttttttttttt

SEQ ID NO: 15414 - DNA, 483 bp, Homo sapiens
attctcactgcgcccagcttccggcctggccacccgccagcaggtctcacccggttcgcatcagtcccgggcccccggcgcccctcagtagtagcaaattatcgcatccctgagcttaggatccccctttagtttcacatatgcccccacccccgtttccactttgatggcggcttccaaggagcatcccttagtaagaaccgtcgcaaatatcgtgatttggatccaccaaggcttggggcgagccgtcgaatgtgtgtggtaggggagcgggctgatgttagcacgtggtcttgttaggccttgaatgggggaataggaggcctgtgttcacgattagtttccaccacctaccaacttggaacctttacrtctctccaagcctgagtttccttatctgtgagacagctgcgaataccggtttccagagagtagttaagaacccttgtgaacaccttcttcagcttccttcgacgcaaaaca

SEQ ID NO: 15415 - DNA, 362 bp, Homo sapiens
cattcaacactgaggaggaaattcttggcttggtcaggaatggtgggacctgtgagttgggatttgtaaatggcccttgaggcgggcgcagtggctcacgcttgtaatcccagcactttgggaggccgaggcaggtggattacgaggtcaggagatcgagaccatcctggctaacacggtgaaaccctgtctctactaaaaatacaaaaattagccgggtgtggtggcaggcgcctgtagtcccagctactcaggaggctgaagtaggagaatggcgtgaacccaggaggcagagcttgcagtgagctgagatcgcaccactgcactccagcctgggccacagagtgagactctgtctcaaa

SEQ ID NO: 15416 - DNA, 221 bp, Homo sapiens
catacctaaattttctggaaggggacagtgaaaagaggagtgacaggagggaaagggggagacaaaactcctactctcaacctcacaccaacacctcccattatcactctctctgcccccattccttcaagacgagaccctttggggacaaggccgtttctttgtttctgagcataaagaagaaaataaatcttttactaagcaaaaaaaaaaaaaaaaag

SEQ ID NO: 15417 - DNA, 471 bp, Homo sapiens
accagtctagaatcaggatgtagcttccagtttgtgaagagtccttaggtcaaagaactggatggtggcaaaaagatccatgaaaaaaccccaggatgggccaggaccagtgagggcctgggacaccctccactcacctttgtgaggtccatatgtgtttctggagacacagtaacctgtggaaagccaaagatcatgaaagtctaactccatgaggtttttggaaaacttcgaaagacctaactcagaccatatgccgcttctgtacacaaccctccacggctcctagcatcctaagaattgagggaaaactcctcaccttggcactccaggagccgttcctgcgttttctgacgccctctccaccgcccctcggctgagaactgggtccagatgagccttggaccccgttgaagacgtctcctacctcatctcccacacctgctgggaccatctccaaccgccctcagg

SEQ ID NO: 15418 - DNA, 472 bp, Homo sapiens
agagagggagcccgagccaggccatctccaaccatgtccgacgaggcctcggccatcacttcctacgagaagtttctaacccccgaggagcccttcccactcctgggacctcctcgcggggtgggcacctgccgagcgaggagccgggctgcctggacatcagcgacttcggctgccagctgtcctcctgccatcgcaccgacccgctccaccgcttccacaccaacaggtggaacctaacttcttgtggaacaagtgttgccagctcagaaggcagtgaggagctgttttcatctgtctgttggagatcaagatgattgctattccctgttagatgatcaggacttcacttcttttgatttatttcctgaggggagtgtctgcagtgatgtctcttcttctattagcacttactgggattggtcagatagcgagtttgaatggcagttascaggmagtggamatttgcagg

SEQ ID NO: 15419 - DNA, 593 bp, Homo sapiens
aagaaagttgtctgcgtctcgaggcgagttggcggacgtgtgcgcgcggcgggggcgatggggggctcgggcagtcgcctgttccaaggagctgctggccgagtaccaggacttgacgttcctgacgaagcagggagatycctcctagcccacaggcggtttttgtgagctgcttyccccaggagcagcggabtgggggagtcgtcacttcgggcacaagtgcccttcgagcagattctcagcctttccagagctcaaggccaaccccttcaaggagcggaatctgcagggtcttctycaaatycccagccmaaagacagccttagctttgagggacttcctggatctcctcagtgtggttcagtgacacaggccacgccagacatcaagtccccattatgccttccgcatcttttgactttgatgatgacggaaccttgaacaggagaagacctgagccgggctggtgaactgccctcacgggatagggcgaaggacacacgggcttagtgcgtctgagatgaagcagctcatcgacaacatctggaggagtctgacattgacagggatggamcatcamctctctgagttcc

SEQ ID NO: 15420 - DNA, 391 bp, Homo sapiens
cttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtagagccactatgaggagggccctgggaagaatttgccattttcagtggaaaacaagtggtcgttactagctaagatgtgtttgtactttggatctgcatttgctacacccttccttgtaatatgaagagcattttaagaggtgcagcctctggaagtggatcaaactagaactcatatgccatactagatatgtttgtcaataaacttatgacgtcaaaaaaaaaaaaaaa

SEQ ID NO: 15421 - DNA, 515 bp, Homo sapiens
attctgagtcatgaagccctcatccccgctgtaccgcttcagacagtgaagaacgtggcaggtgttggataacaggaatgacgtcatctcaaagtcatcactgtgcttcttcaggactttcttaatgccgttggtggtggaggtcatcagggagtgcaccttgagatcatcgttggtttggtccgcgagccgaatgcacatgtagagcatgtaggcggagagacagggcactgtgtccaacagcatctggggcttcaagtctgtcaccaggttgaggatgaggagggcctcgcctctttrcggcactccaacatkccctggaaatccttttctttccactgaactgggacctgcctgttgaactcatggcgcttcctctcactctgggccaacgcctgggcagcttcttcatgtaaatcttcagttgcttttagagcttcctctcattcttttcctcttactttatttttcaccacagagcttcctatcaactagtatgttgaatattttgctta

SEQ ID NO: 15422 - DNA, 416 bp, Homo sapiens
atctggtacttccatccggggtcagggcagcggtgtcccgaagcctcactgttcctgtcgcgtggcccgctccgccgggcttggcaggactcggctctccccttctgccgttaccaggacgaccgtctccccgcagcccaggctgcccagactggcgccatgagctcccccgacaagtgcatccggctgcagagggaaattgaggaccttacacagcagctagcggccatgcagttcttcaacgacaagttccagggcctttgaagttggagccagcgtccggagctgcagccaagcgagtttccttcttatcctccttagccagggctttttctcttccgctgcatttgcccccttcccaacgcagttcaaagcagtgtgaaataaagtcgttctcatattcgaaaaaaaaaaaa

SEQ ID NO: 15423 - DNA, 479 bp, Homo sapiens
attcattgcctggggatgagagggagagacaacgtgtgtcttacacatctcccaacagccgacttagatgtgatccgttctcccagagggascaggtttctttgaacttttcctttttatgtacagcatagtgctgagcagatcactgcactgtgcaggagttttaacgacagtcaggccaacggcatggaaggaccgcgggagaatcaggatcctcctccgaggcctctggccgccacctgtctgatgcagaccgcctccgcaaagtcatccaggagcttgtggacacagagaagtcctacgtgaaggatttgagctgcctctttgaattatacttkggagccacttcagaatgagacctttcttacccaagatgagatggagtcactttttggaagtttgccagagatgcttgagtttcagaaggtgtttctggagaccctggaggatgggatttcagcatcatctgacttttttaa

SEQ ID NO: 15424 - DNA, 462 bp, Homo sapiens
ctttaatactgtcaacttcagctgtgtacattttgctcttcaactttcttttgaggctttaaattaggcaaatatatttttcttagaatttctgaaaactccttttcactggagcttattttaattatatggatgcattatcctcttaaacttctgtgaaaacaataattggagttttcatttgcattggctgtttcatgagaggtcaagctttttgcttatttattttgatgtttccttttcatgatatctgtgtcttgggatttggttgtatattcacatttttaattagctacttgatttaaataaagtatcagtagttactttcagggttcttggtgattataataattactcacctaccaggcttcttccttgcatgcagctcactacaggaatctgttgtgcctagaagatttcgggataagtggagaaaccccactccgttaactgcatacacag

SEQ ID NO: 15425 - DNA, 490 bp, Homo sapiens
tagatttatttatttatttagagacagggtctcactctagcccaggctggagtgctgtggcgtagtcttggctcactgcaacctccgcctcccgggcccaagtgatcctcccgtctcagcctcctgagtagctgggattacaggcgcacaccaccaatgcccagctagtttttgtgtttttcatagagacagggtctcaccatgtcattcaggttggtcttgaactcctgagctcaagcagtctgcctgccttggcttcccagtgctgggattacaggcgtgacaccgtgcccggctaaaaagtatttttaagttctgcatattgcttatttcacttaacactatattagagattgttttatatcaatacatatagatatgcttattcttgttgacagttgcataattttccattaaattgatgtatcatgggcagttaaccagttactcgttttactcttagcataactttakggaacaatgtgggatg

SEQ ID NO: 15426 - DNA, 801 bp, Homo sapiens
tattattcctgaaaataaaatgaggggagaatattccctaagcaactggcaatagtattcctgaaatacctagaaatttctatctgaatgagggagacacttatgaacaccttatccttacatatatttgcatacttatctcatattttgtgacataattatttaacccagaatactttctggcagacatacagaaagctctgtgtgatcaataagggagtgtctcatttttctacttccctctttctgtgggtgacatgatctgaggttctatttgattactaagcaaaatctgttacccctacagggtttagaacctaagtattagagaggaaggctatttaatggaagttagtgtaagctgataaaaacgtagctaccgtacacacacatcaatcactcaatttcctgtccttttaaattgcccaccctttaattttgaagcaatttcccaagtgtgtgtttgttttatatttgtcatccagtccattgcatttccataagaagacattttgactggctgggtgcggtggctcacgcttgtaatcccagcactttgggaggctgaggcaggcggatcacgaggtcaggagatggagaccatcctggctaacatggtgaaacccgtctctactaaaaatacaaaaaattagccaggcgtggtggcacgtgcctgtagtcccagctactccggagctgaggcaggagaatggcgtgaacccgggaggcggasttgcagtgagctgagatggcgccactgcactccagcctaggcaacagagcaagactccgtctctaaaa

SEQ ID NO: 15427 - DNA, 216 bp, Homo sapiens
tatattgctgcagattctgaaaaagtgcaagakkgcaatacaagaaggtattgcctctgcgacaatgtttgatggagccaaagacatggcttactgtgacactcagctccgtgtagcctttgatggggatgctgtcctcttctctgatgagtctgaacattttaccaaggagcatgggctcgacaaattcttccagtatgatacattatgtgaaag

SEQ ID NO: 15428 - DNA, 495 bp, Homo sapiens
ccctgttttatacaagagcctaggggagtgaggctttggggagcttctcctcctggcttctcctcatggctttcttcctcctgcccctcctccacgtccccagccccccatttctgccttccttgctgctccacttggcctagccatgacctctgtgtggtcgtcactgtcttgtgttcttgcttctgtcgtggccgccagagtgaccgcactgcagctttttaaagctctgaccttgtctttcgtcttctcagagcctgtctgaggctccccaaagacattgcccagcggcctggcattcaggaccccagctgggcagccctgccgaccttcggcctcctcagggacagctgctcccctcactctgccgggccttggactcgtctcccagaatagccaggcacactggcgccctaaccttccctggctcaagcttgtcctactgccgggaaggcctccccctcccctgcatttggcaaactcatgtgtaccttc

SEQ ID NO: 15429 - DNA, 291 bp, Homo sapiens
cacattaaggaaaccactacgggtctggcagtgcgtgtcccgtggggtgtgcattttaaaactcgattcatagacacaggtaccatgttccatttccgtcatggtgaagcaaatgaattggcctggctaccactgtggtcgcgtgctacaggtttgacaaaaagatatcatgtttcgatttttttgtgtgtggacaacaatatggaagctaaaattgacatatttttatgtaaagtttttctattctttgatttttaataaactttggaaaccataaaaaaaaaaaaaaaa

SEQ ID NO: 15430 - DNA, 508 bp, Homo sapiens
cttctcctggaacttacatcttcaagtcttggatgctctgatagccctcaactccaagatttatcttcctggtcccttgcgacttccaggagttctgattagctgtcactttctgcttggctttttcttggcttctcagcctgttggaacagctacctacaaattggcagatgtcttgacaggaatagaagggtagaatatcagcctcaccttaatgagttttccttctctctgggatcttggccctcaagtccaggctgccttcatagctctcctgtgtttttgaactgatattgcctgtattttatatcacttttctcctttcttggagatcaggatagagggcaggtaggaggcaatgctggcctcaacttggcagttacagtggaggtggtagcaataggtgggttgagagagatacagtcacagcgattaattagatgggagaggaggaaccaataatgaatgtagatggattgtctctctgagatgctgggcacatgctcac

SEQ ID NO: 15431 - DNA, 361 bp, Homo sapiens
ctgaacagggcgggagattcggtgtgccgcacgcaggcttcccatcccccagctggcctcccgtgctccttacstccccggtggtcgggcgcgaattactggaaattggcttttcccgttggggccgaagtaccttccctgcggcggcgactcagcggggtgtcgttcggccggcgtgacgcagccggatcggcgccagacggaaacctagcggtgactgtatctgaattttgcagctgcagaatgtgtagtaccttaaaaggttggcaacaatgagtaaaccagaattaaaggaagacaagatgctggaggttcactttgtgggagatgatgatgttcttaatcacattctagatagaga

SEQ ID NO: 15432 - DNA, 314 bp, Homo sapiens
atttacatagggtgtacaccaagtaaccaatgggaaaactctaattctgtactggggctcttggatcctattcttggacccgctcccaccctgcggagtgtacttttgttttttgttgcttcaaatttttttttttttttttttcttttttaagagggaktctcactctgtcgcccaggctggagtgcagtggcatgatctcasctgagtgcaagctctgcctcccgggttcacgtcattctcctgcctcagcctcccgagtagctgggactacattggcccgcmaccaggcccggcwaatttttttttttttt

SEQ ID NO: 15433 - DNA, 488 bp, Homo sapiens
tacagttcggcacgtaggacggagggtagtgcgtctagagacacatattcccaacggatttgacgatggtgttcggtcttgaatggaaatgtagtcttaggccagtcttaggtttttgaacaggatagtaggtatccggagtcgattgagggccacagcaggcactggggttcgcatcctgggcaaagtttcccacgttgagggtctcgaggacgcctagatctctttcccagggccatggcgaacccgaagctgctgggactggagctaagcgaggcggaggcgatcggtgctgattcggcgcgatttgaggagctgctgctgcaggtgcagtgaccggacccctggatccttgagtattcggggattttggcggggtgctcaaagatgggactgcagttcccagaatgcactaaggcgggaaccaggcctcggggaattgaggttaatgggcttcaagtttgctaagaawatgggagtgggggggc

SEQ ID NO: 15434 - DNA, 241 bp, Homo sapiens
aaaacttttcggtccaggcggcggcagggctgagccagcgacgccctccattcactctccgcgcccgttctccggctgtcttcccgttccgctgcccgccctgccaccatgacggaacaggcsatctccttcgccaaagacttcttggccggasatcgccgccgccatctccaagacggccgtggctccgatcgagcgggtcaagctgctgctgcaggtccagcacgchagcaagcagatc

SEQ ID NO: 15435 - DNA, 410 bp, Homo sapiens
tgcactatagaacaactggacctaatagatatttacagaacatttcatccaacagctgcagaatacatattcttctcctctgcacatggattattctcaaagatagaccatgtgttaggtaacaaaacaagtcataaaatatccaaaaattggaaataatgtcaagaatattctctgaccacagtgaaataaaactataaatcagtaacaagagaaattttggaaaacacatgtaaattaaacagtattctcccaaatgaccagtgtatcaatgtataaattaagaaggaaatggaaaaatttcttgaaacaaatgataatgtaaataccatataccaaaacctataggatacaatgaaagcagtaggagagaaattgtagcaatatgtgcctacatgaaataaaaacaa

SEQ ID NO: 15436 - DNA, 179 bp, Homo sapiens
  misc_feature 108: n=a, g, c or t
akatctgggcagatgaaccaaagggaaaakccacctccccagccctkcaccaagccctgtcctcctaaatgcccttcatcctgsccacatgcttgcscacctccctgncctcccccagaktgaggcactgtgggcactacccaaccccascaccactgscacctccaccatgtacaagc

SEQ ID NO: 15437 - DNA, 150 bp, Homo sapiens
aaacaggattctcactgaagacaggccagggtggtcggatatcacttgggggatggtggaggatgagatattgagggtccagccgtccattccggtggaggcagaggcagtcctggggctctggggctcaaaaaraaaaaaaaaaaaaar

SEQ ID NO: 15438 - DNA, 145 bp, Homo sapiens
aaacaggattctcactgaagacaggccagggtggtcggatatcacttgggggatggtggaggatgagatattgagggtccagccgtccattccggtggaggcagaggcagtcctggggctctggggctcaaaaaaaaaaaaaaaa

SEQ ID NO: 15439 - DNA, 164 bp, Homo sapiens
aaacaggattctcactgaagacaggccagggtggtcggatatcacttgggggatggtggaggatgagatattgagggtccagccgtccattccggtggaggcagaggcatcctggggctctggggctcaaaaaaaaaaaaaaaaaaaaaaaaaaabaaaaaaaa

SEQ ID NO: 15440 - DNA, 163 bp, Homo sapiens
aaacaggattctcactgaagacaggccagggtggtcggatatcacttgggggatggtggaggatgagatattgagggtccagccgtccattccggtggaggcagaggcagtcctggggctctggggctcaaaaaaaaaaaaaaaaaaaaaaaaaaaaaaaaaa

SEQ ID NO: 15441 - DNA, 126 bp, Homo sapiens
aaacaggattctcactgaagacaggccagggtggtcggatatcacttgggggatggtggaggatgagatattgagggtccagccgtccattccggtggaggcagaggcagtcctggggctctgggg

SEQ ID NO: 15442 - DNA, 384 bp, Homo sapiens
tgcagttctggtcggtctgaaacttttgcaaagcttcgtatttcctcagaccattttacaagcattatcttgtttcatctttcaacagccaagtgaagtaaataagccagacttagccccattttggcagataaggaaacaggattgaggtggcccagtgacttgttgaggccacacggctagctggagacttcgttggagctgcagtcagacctctgaactgggtacagagttcttacccagcatctgccacccttgtggcacctggggccagtcctagactcggatccaataaaaaagagtcaccctgggattcctcagagcaagtgctccggtcgcattccagatcatccactggcaaaagcatcacttcttacacgtggt

SEQ ID NO: 15443 - DNA, 200 bp, Homo sapiens; identical to SEQ ID NO: 11569

SEQ ID NO: 15444 - DNA, 498 bp, Homo sapiens
acagttgctcaatttagagcaaattaatttaacacctgccaaaaaaaggctgctgttggcttatcagttgtctttaaattcaaatgctcatgtgacttttatcacatcaaaaaatatttcattaatgattcacctttagctctgaaaattaccgcgtttagtaattatagtgggcttataaaaacatgcaactctttttgatagttatttgagaattttggtgaaaaatatttagctgagggcagtatagaacttataaaccaatatattgatatttttaaaacatttttacatataagtaaactgccatctttgagcataactacatttaaaaataaagctgcatatttttaaatcaagtgtttaacaagaatttatattttttattttttaaaattaaaaataatttatatttsctctgttgcatgaggattctcatctgtgcttataatggttagagattttatttgtgtggaatgaagtgaggcttgtagtcat

SEQ ID NO: 15445 - DNA, 568 bp, Homo sapiens
acaaggatgtccctcttaatcccctcctgttctttatgaaaggtgatcttgcaatcacccaatcaaacatggatcagggaatgaaaaagacctctagaaaaaaagagaagaaagccagcccttcttccattcagccacaatgacagacaatagtggggtactgctttctaacaagaatactcctaagatgcaccagctctagagatacytgtcaaggctgccatgttcacctcgcagtttagtaaggggaagaatggaaaatagtttagaatgtcttatgctataaaaacatcttcgattaatcatgatctgtaacaacagcacataaagattgatggtgttgctctcattttcagatgagaacaacagactcagaaaggttaagaaacttatccgaggtaaccaaactgcaagaaaaaaaggcttacagaagagtttggaaaaaaggcctcagtttcatctgttttcaatctctgtttaaggagatgctaaggatgtgtttcataataagaatccaagtgacaaggagtcaagtctgtaacaactgtgtttagctgtgagaaaaaat

SEQ ID NO: 15446 - DNA, 477 bp, Homo sapiens
  misc_feature 275,379,435,464: n=a, g, c or t
aatcaaacatggatcagggaatgaaaaagacctctagaaaaaaagagaagaaagccagcccttcttccattcagccacaatgacagacaatagtggggtactgctttctaacaagaatactcctaagatgcaccagctctagagatacttgtcaaggctgccatgttcacctcgcagtttagtaaggggaagaatggaaaatagtttagaatgtcttatgctataaaaacatcttcgattaatcatgatctgtaacaacagcacataaagcaagnaaaaaaggcttacagaagagtttggaaaadaggcctcagtttcatctgttttcaatctctgtttaaggagatgctaaggatgtgtttcataataagaatccaangtgacaaggagtcaagtctgtaaacaactgtgtttagctgtgagaaamaatccagnagaaatgcccatttcccattcttcagganattgtatgggagt

SEQ ID NO: 15447 - DNA, 148 bp, Homo sapiens
actgtccatcttgccttcaggataatgtgaaatatggcctaatttttgaagtttttttcttagaaattttactgaatccaaaataaaacaagaagatcatggtggatatagcttccaaatttattctgcaataaaacaggtttgaagc

SEQ ID NO: 15448 - DNA, 504 bp, Homo sapiens
atgtgatgtagcaagatgagcaacaaaagaagaatcccamgataatcacgtaattatgttaggagagattctcagttcaatctaatcctgtctaaacaggctgaaagaaattagtcactcagaattatataaaaggctctattgaggacacagaaagaagaggcccatctgtaaaccaggaaaaggaccctcatcaaactgagctctgccaacacactgatcttggacttcccagcctccagaattggaatgataccagcttgttgtgcaagccagaaatctgaatgtattctttgacatctaccactctttttcactctctccttatgtggaaagtactatgaatttattctccaatcatctttttaatctggacacctctggccatttctattgccacaaccatagttcaatttattgtcatctcctaactgaactactgtaatcgtttcctaatactcactcagatgatcttactttatgtaatatctacttcacatacgc

SEQ ID NO: 15449 - DNA, 402 bp, Homo sapiens
tttaaagtggaaaagccagaatattgagttatttcttaacaagtttcgagagagaagggagcaagacaagagcaagcaacggctattaaatgtcacaatcctttaattagaaaccatttattggccggacgcggtggctcacgcctgtaatcgcagcactttgggaggccgaggcgggcggctcacgacgtcaggagatccagaccatcttggctaacagggtgaaacccgtctctactaaaaatacaaaaaattagccgggcgtggtggcgggcgcctgtagtcccagctactctggaggctgaggcaggagaatcaattgaacccgggaggcggasttacagtgagctgagattgcgccactgtactcctgggcaacagcgagactccgtctcaaaaaaa

SEQ ID NO: 15450 - DNA, 519 bp, Homo sapiens
cctatagtcgcaggctcagtctcagtgattgtatgctgtggtcagctgtttttgtttttgtgacaccttgttttcttgtttactgtcctgggacagatgtctgtagtcacttgtttccttgggaggcaaatttcagtctctgtgggggaggtctcccatgttagctgtggtggtacttggcaggcagagctcagggatctaggcttccctgctttgtagattgctcaatggtccccaaggcctactggcttttaacaccacttgaaaaccttagtgtttttccgctgtccccagaatcacctcttacacagcctctttttttgtttgtttgactttttccctgagacagagtctcactgtatctggtggcatcttggttcaagtgatcctcctaccacagcctctggagtagcagaggcacgagtcaccacagccagctaatttctgttgtttttgttgttgtggtggttgttttgttttttaagagttgaagtttctccatgttgcccaggttggtct

SEQ ID NO: 15451 - DNA, 511 bp, Homo sapiens
atataggcgtggctgaatacgggcctcctgcgtacgtgcgtggtgtacgtacgtgcgtgattacgcgcacacgtacgttcctcatgaaagggacgacgggagctgcatgaaagccgaagttatggaccgctagcatctgtcactggccaccggtttccgggagtaagcggcactaccttacagccctgacacgagccgggtgctctctcttctcaccgcggcccacgtctcctcgctggctccggtggcctcgctgggtcgcgaggaggcggaggactgtactctgaggccaaaagccagagtcggccctgaacgcccacgactctcagggtccagaggccgtgagaccggccgcggctgaaaggtaaagaaaccaagtggaagagtgtttcctcctctggccgtaaagcaggtactctctgcagcaccagctgtccccgccctactccggaccgccccaaagactccatgggatggacctgagtcagccgaatcctagccccttcccttg

SEQ ID NO: 15452 - DNA, 377 bp, Homo sapiens
ttattctcttttcgttttgtgtatttgtggtagaaatttcattcactccgatgacttcacttattatctatacataatgctgatgactccagatccagaagccaggagtttgagaccagcctggtcaacatagtgacacgtctctacaaaaaaaaaaaagaaaaaaattagccaggtatggtggcatgtgcctgtagctccatacctgtataatcaacagctattaaatatctgctargcaaactaaactaagcwttttcaaaagtaaacttgtgaaacctgatggatttcagtagttgacatcagcatctacttttgctgaagtcagtagcctggacattatttatgacacttattttttttycccatctkgccct

SEQ ID NO: 15453 - DNA, 114 bp, Homo sapiens
agagctgagctgaagcggggacccggagcccgagcagccgccgccatggcaatcaaatttctgggaagtcatcaagcccttctgtgtcatcctgcaactaacatctgtgaagct

SEQ ID NO: 15454 - DNA, 411 bp, Homo sapiens
aggattggkgtggggttcatcccaccagaccacagagactgaaaataagaaaggggtgaggcctaagggacaatcaggatgtttttcagagagaagtgtggatgctggacaggaagaaccacagataccagatacggaaaaggaagaatcaacactttcagagatggagcctgttgagccacagtaccaactagtcaatgctgaatcgacttctccctttctacattgcctgagagaagtcattggggaatactctgtacacgaattttcactgttggggaaaacakagagtcaagggattggattgtggattgcattggtggttttcctcagtttcctcatcttctccacaagtttctrcatatcgaatgcagagcagcccttcttcaaaggacctcctacggaagctgc

SEQ ID NO: 15455 - DNA, 540 bp, Homo sapiens
tacagtggcgcaaggtcctcttgaaatgttaatgttaatgttcccaaaccagagaatgctttgaaaatgtatcattcagtgtaaattaattacatacatatttttctatatatttgtttcaaactgtaaaaataacataatatgtaatttgtgtattagtgagaggtgaagccagctggacttcctgggtcgagtggggccttggagaacttttctgtcttacaagaggattgtaaaatgcacccatcagtgctctgtaaaacacaccaatcagcgctctgtagctagcaataggtttgtaaaatgcacccatcagcactctgtaaaacgcaccaatcagcactctgtaaaatgcaccaatcagcaggattctaaaagtagacaatcacagggaggattgaaaaaaagggcactctgatagggcaaaaacggaacatgrgaggggacaaataagggaataaaatctggccaccccagccagcagcrgcaacctgttcaggtcgcctgcygctgtggaagctttgtccttttgctcttcat

SEQ ID NO: 15456 - DNA, 390 bp, Homo sapiens
agttttaggcgaatcccaggcgcgccaaggaaagtgctacaaaagccatccatcttgcaagcgttggtgccgaggcgcaacgctgagaacgcaaatactaaagggcgctgttctttcctcgtggagctcacagtccgctggggagaccgtgagatgacagcagagaaactagcgcgatcagtagtactcagcgcaaggacagcgagcagagaaggcaaacctagtgcttgctaaggaagacttcacagaggaggtagtgtcagggccgagactaggagaaggattctagttaagtgaccttcagttcactgaacacctttgaagaacaacttttcattacagcagacagccctgattgctattccaatgtcatcacaaacccccaggatg

SEQ ID NO: 15457 - DNA, 457 bp, Homo sapiens
acccccttgacctcttcctccaggagccgggaccaaaataaccgggcgggaggggacacctcgcagggctctgacaccaagtgagtcctctcgtttctctgtttttgctgagaagctggagtctcctaaggcttcagaatcactaagatggatctcgaactcctgggctcaagcgatcctttcaccttggcctctcaagtagctgggaccacatttgctcaccagctggcccaagaccagactgggcaacatgggtcatcctcctctaagattccaggaccatgatcatccctctattgctacttcttagatcagcttgtaatgtccatctcccccaccagactgcgtctccagcatctctgagtccccagggcctggcctggggcttgctacatggtgggtgctcagtaactgtgaggtaaataaatgaatgaattaaccaaaaaaaaaaaaaaaa

SEQ ID NO: 15458 - DNA, 449 bp, Homo sapiens
agacttgtgagtccctgctggagtcagaagttttaggcaatcccaggcgcgccaaggaaagtgctacaaaagccatccatcttgcaagcgttggtgccgaggcgcaacgctgagarcgcaaatactaaagggcgctgttctttcctcgtggagctcacagtccgctggggagaccgtgagatgacagcagagaaactagcgcgatcagtagtactcagcgcaaggacagcgagcagagaaggcaaacctagtgcttgctaaggaagacttcacagaggaggtagtgtcagggccgagactaggagaaggattctccaggcttcatacggtaaaactctctgggaaggaaaggaactcagagtcccatgcagaaaattgttcagctggaggggtatcagaaagatggatttccaaagccaactgtttcctgtagtgtgtggatctctgca

SEQ ID NO: 15459 - DNA, 492 bp, Homo sapiens
atctcagggctccaaccccaggctggactgggagcacactccagttgggatctgaggggcctacatcgctggcctgagcatgtgggcatcaggcttctattctggctctgccagctacccactgtgaccttagtctaacctctccctcctgggcctgttttcctatctgtcctgaagctccatttcatgagtaagcgtgagagccgctcagttttcctccagctctgctgaagsccagcacagaagtagcccaaactcttccctctgctgacagcaaattttaggcaaagtcttgagaaagaagaaattgggtccagaaagggaagtgaggagaatcagatcccagacctttggggagaaggagcaaccgcctctggcacagcccattagggagaaagagcaggttgagaagagtcctaagctaacagccccaaacaggtgggtgttgctcagctccctgaggcatgtggttgtaaggcagaacccacagac

SEQ ID NO: 15460 - DNA, 410 bp, Homo sapiens
aatagaatcatggagcccttgagttagagagaccagagagccagtccaacccagtccatcacctggaggctggagaaccacgaggctgttgcctgttcgtccccctcttctgagaggtccaggtcacctgctctgggagaagccagttgccatgtygtaaggacactcaagcagcccatggaatgactcacatgctgaagaactgagccctccctccttccaacagccagggaggaactagggcttcttgccaataaccatgtgaagaagcttggaaatggattctcccccaaatgagtcttcagattactttagactaacatcttgactgcaacctctasaaagaccctgagcyaggatcaccaagctcacagaagctaagagttaataaatgtttgaattaagctgca

SEQ ID NO: 15461 - DNA, 378 bp, Homo sapiens
agtccaacccagtccatcacctggaggctggagaaccacgaggstgttgctgttcgtccccctcttctgagaggtccaggtcacctgctctgggagaaccagttgccatgtcgtaaggacactcaagcagcccatggaatgactcacatgctgaagaactgagccctccctccttccaacagccagggaggaactagggcttcttgccaataaccatgtgaagaagcttggaaatggattctcccccaaatgagtcttcagattactttagactaacatcttgactgcaacctctagaaagaccctgagctaggatcaccaagctcacagaagctaagagttaataaatgtttgaattaaaaaaaaaaaaaaaaaaaa

SEQ ID NO: 15462 - DNA, 468 bp, Homo sapiens
tgtgtttgttcaactctcagtgactcttaggtactcagtgagtgcgtggtgcccttagagcaattctgatggaaccatttgcatttaatatgagtatctgacatgcattgcagtgcactgcagtgatgaacagctatagctcaggggtcttagaggcctagctttagagcctgaccttgctgtgtgaccttgggcaggttatttaatctctctgtgcatcagccttctttgaggcatctgtagaatggatgtaatagtacttgacttgatagagttgtggtaaggattaaatgaaatgatacctgtaaataggccagtgcctggtacatagtaaatgtccaatgctttccagtatattattatcaacttacagcagcattttgaagagagtgggctggtgtctctcaaacaggttgatgttactacgctgggaacaaaccagattcttcttttagaagtagctgctgg

SEQ ID NO: 15463 - DNA, 569 bp, Homo sapiens
attgaacctgttaatcctgattcctgcctaagtagtccagtgagatttctatgctcaggttgtttaaaagacttgtttacttcgaaggctgtcttcatcttaaaatgaaaacagagtaatcatttccagttgaaaagttaggtggcagtgagggtggagccaagatggccgaataggagcagctccagtctacagctcccagcgtgassaacggagaagacgggtgatttctgcatttccgactgaggtaccaggttcatctcactggggagtgtcagacagtgggtgcaggacagtgggtgcagtgcacgagtgtgagccaaaggagggtgaggcatcacctcacctgggaattgcagggggtcagggaattccctttcctagtcaaagaaaggggtgacagacggcacttgaaaaatcgggtcactcccaccctaatactgtgcttttgcaatggtcttagcaaatggcacaccaggagatatatccggtgcctggctcagagggtctagccacgagccttgctcattgctagcacagcagactgagatcaactgcargtggcagca

SEQ ID NO: 15464 - DNA, 410 bp, Homo sapiens
attttgagttgaaggcagctgagaaacagtagatgcaggagcagctctctgcttccttcctgcctcgaagccgggcgtgaattccctctgtgaaggtgtcctctcccctctccacaccaggaggagagactgcagattgaggctgcataaccaacctcactgaagttgctcttaccttcctagaagcccaaccccctcttcccccctctttttttgtttgagatggggtctcattctgtcacccagactgaagtgaaatgacgggacctcacctcaccacaacctccgtctcctgaggcgggagaattgcttgaacctggcaggcggaggttgcagtgagctgagattgtgccactgcactccagcctgggtgacagagcgagactccatctcaaaaaaaaaaaaaaaaa

SEQ ID NO: 15465 - DNA, 405 bp, Homo sapiens
agagtacaggtcgtgctgcagttagttcattgaaaactcatttgctcttggagcagtcaggcagtgactgccttcggctttttttctgctgactaagatctcctatagagagctacaacaatgcccaaaagaaagccaaagagaagatctgccaggttgtctgctatgcttgtgccagttacaccagaggtgaagcctaaaagaacatcaagttcaaggaaaatgaagacaaaaagtgatatgatggaagaaaacatagatacaagtgcccaagcagttgctgaaaccaagcaagaagcagttgttgaagaagactacaatgaaaatgctaaaaatggagaagccaaaattacagaggcaccagcttctgaaaaagaaattgtggaagcaaaaaaaaaaaaaaaa

SEQ ID NO: 15466 - DNA, 375 bp, Homo sapiens
acttttcagtccttgcgcaccggggaacaaggtcgtgaaaaaaaaggtcttggtgaggtgccgccatttcatctgtcctcattctctgcgcctttcgcagagcttccagcagcgaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctcttggaagtggatcaaactagaactcatatgccatactagatatgtttgtcaataaacttatgacgtcaaaaaaaaaaaaaaaaagg

SEQ ID NO: 15467 - DNA, 392 bp, Homo sapiens
agagtacaggtcgtgctgcagttagttcattgaaaactcatttgctcttggagcagtcaggcagtgactgccttcgggctttktttctgctgactaagatctcctatagagagctacaacaatgcccaaaagaaagccaaagagaagatctgccaggttgtctgctatgcttgtgccagttacaccagaggtgaagcctaaaagaacatcaagttcaaggaaaatgaagacaaaaagtgatatgatggaagaaaacatagatacaagtgcccaagcagttgctgaaaccaagcaagaagcagttgttgaagaagactacaatgaaaatgctaaaaatggagaagccaaaattacagaggcaccagcttctgaaaaagaaattgtggaagcaa

SEQ ID NO: 15468 - DNA, 393 bp, Homo sapiens
atagtacaggtcgtgctgcagttagttcattgawaactcatttgctcttggagcagtcaggcagtgactgccttcggctwtttttctgctgactaagatctcctatagagwgctacaacaatgcccaaaagawagccaaagagaagatctgccaggttgtctgctatgcwtgtgccagttacaccagaggtgaagcctaaaagaacatcaagttcaaggaaaatgaagacaaaaagtgatatgatggaagawaacatagatacaagtgcccaagcagttgctgaaaccaagcaagaagcagttgttgaagaagactacaatgaaaatgctaaaaatggagaagccaaaattacagaggcaccagcttctgaaaaagaaattgtggaagcaaaa

SEQ ID NO: 15469 - DNA, 406 bp, Homo sapiens
  misc_feature 273: n=a, g, c or t
agagtacaggtcgtgctgcagttagttcattgaaaactcatttgctcttggagcagtcaggcagtgactgccttcggctttttttsckgctgactaagatctcctatagagagctacaacaatgcccaaaagaaagccaaagagaagatctgccaggttgtctgctatgcttgtgccagttacaccagaggtgaagcctaaaagaacatcaagttcaaggaaaatgaagacaaaaagtgatatgatggaagaaaacatagatacaagtgcccnagcagttgctgaaaccaagcaagaagcagttgttgaagaagactacaatgaaaatgctaaaaatggagaagccaaaattacagaggcaccagcttctgaaaaagaaattgtggaagcaaaaaaaaaaaaaaaa

SEQ ID NO: 15470 - DNA, 405 bp, Homo sapiens; identical to SEQ ID NO: 15465

SEQ ID NO: 15471 - DNA, 376 bp, Homo sapiens
attccaatctcatgagagaagagcccctagttctcaggactttaaccctcttcctgccagcacccccaggccagtgctgaggctgacaagttgtctaaaagggcaggaggacttactcctgacatgcatctgccacccaaaccatcacaatagccttccgccttctcagtgggagtacgagtgaccctgcagcagaaggcagcaggaggtggtgacaagaatacacgtctggccctaaaacctgggtcagtcacatcctggctgccattcaccagctatatgattttaggaaagtggattcacctctgagctgcagattcctcatcaataaaatgaagacaagaacacccacccttagtatttgggtatttaaaaa

SEQ ID NO: 15472 - DNA, 446 bp, Homo sapiens
acggctagataggccgccggcagatgtggcgggggagagccggggctttgctccgggtgtgggggttttggccgacagggttcccagaaggagaccgctaagctgcgatgctccgtcgcaggcgggaagcaattatccccgctgttggaactgcggcggcccatggggcccgggcgggaggacaggttcttctgcccacagtgccgagcgctgcaggcacctgaccccactcgagactacttcagccttatgggactgcaaccgttccttcagagttgatacagcgaaskccagcacaggtaccagcaactgcagcgtcttgtccacccagatttcttcagccagaggtctcagactgaaaaggacttctcagagaagcattcgaccctggtgaatgatgcctataagacccttcctggcccccctgagcagagggactgtacctt

SEQ ID NO: 15473 - DNA, 461 bp, Homo sapiens
taacaaggaagactatatctaaaaagaaatttaatatatgtttttgattatatatgctcttttgtcctagctagcagtgtcatttatataattaataaatttgtttttaacagaggtgctcattaaggtgcttgtgatttgatttctaagaaagtaagttgagggccgggcgtggtggcttgcgcctgtagtccagcactttgggaggccgaggtgggtggatcacttggtcaggagttcgagaccagcctggccaacatgatgaaaaaccccatctctactaaaaatacaaaaaattggccgggtgtggtggtgtgcacctgtactcccacttacttgggaggctgaggcaggagaatcacttgaacccgggaggtggaggttgcggtgggccgagatcgcaccactgcactctagcctgggtgacatggctagactccatctcaaaaaaaaaaaaaaaa

SEQ ID NO: 15474 - DNA, 466 bp, Homo sapiens
ttggaaattttgtattttagttagagggcaaaataaaggcatttttaaatatgtgaggattcaaagtttactctttacccatcctgtatttatttttatttatatttttgatatatagtctcgctttgttgcccggggtggggtgcagtggtgcaatctctgctcgctgcagcctctgcctcccgggttcaagcaattctcatgcctgtaatttcagtactttgggaggccaaggcaggcagattgcttgagcccagtagtttgagaccagcatgggcaacataatgaaaccccatctctacaaaaaataaaaaaacattgaccgggtgtggtggcttgtgcctatggccccagctacttgggggtactgaggtgggaagattgcttgggcccagggggtcaaggctgcagtgagctatgatcctgccactgcactccaggctgggtgacggagtgaaaccctgtg

SEQ ID NO: 15475 - DNA, 447 bp, Homo sapiens
  misc_feature 420: n=a, g, c or t
acagccgagggcactatggtaagacgagcgcgctggccgggasgccggcgaggcgagaaaagccccccgcacggccccgggagtgaggccgccattttaacctgattttggcctccaaggcttctggagttacagtgaatgatgaagtcatcaaagtttttaatgatatgaaagtaaggaaatcttctacacaagaggagatcaaaaagagaaagaaagcagttctcttctgtttaagcgatgacaaaagacaaataattgtagaggaagcaaagcagatcttggggggtttctttcttctgataattctagarcctgttaccatagaaaggcatttcttcaatrgctggttgtagttagttcatgtttttcaatcaaatttgcaaatgtatttgttgctgtatagtgattgtwttgctnaataaaattgcttgtcacctaaaaaaa

SEQ ID NO: 15476 - DNA, 478 bp, Homo sapiens
actcggcagccgcctgtcgccgcgggagcagccgctatctctgtgtgtccgcgtgtgcgcccggtccccgcctgccgcaccatggagagctaccacaagcctgaccagcagaarccygyaaggccttgaaggacacggccaaccgcctacgtatcagctccatccaggsccaccactgcggcgggctctggccaccccacgtaatgctgcagcgccgcagagrtcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggastgctgaaacctgaggaagatcagctccgacttggacggggcaccggttcccgaaacaagctttcaccgacgtggccactggctccctgggccagggcctcggggcg

SEQ ID NO: 15477 - DNA, 403 bp, Homo sapiens
attagccaaagtttaatttcttacactgtggttgtcaagaatactgatttactataatgatatatacatgcaagatatttaacttaatatcttagacaagagttctgggtacaattttgggatctagttcccctggaaaagctgctgtatttttaatttttaatggaatgtagcttttaaaatcctgtcactggcatcaacaaaaggaattataccatgagaccttatagctgtacttaaaagccattcagttcagctattgggagttcatgatgaattagcatatgccagaaaggttgctaaccttaacatctgagagcagtaacactgattttatctgctgtatgagactttgtgcattttactttgaaataaagatttttttccacaaaaaaaaaaaaaa

SEQ ID NO: 15478 - DNA, 453 bp, Homo sapiens
attcgggccgcggcggcgctgggtgcagccgagcggtgtggagcggagagaatactcgaagggctctcctgatactaacagttttacgatttaaaacttcgccagaatttcgacagggtctcactgtattgcccrggttggtctcgaactcctggcttcrggcgattctcccrcctcrgcctcccaaggtgctgggattrcaggcgtgacaccacgcctggcctcactcaaacagtaaacgaggtaggttgggggtatatttttgttttgggataaaaagaaactgaatcttataaatattaaatgggttaagatgtgagtaaatttttgggtttagactttaaggtgagaagccgaattattttagggttcgaaatgtgagtgggaaatttgcctactagtgtaggcggcgattactccattcccaacatgcctaggttctcgacattcata

SEQ ID NO: 15479 - DNA, 478 bp, Homo sapiens
caagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaaaaaaaaaaaaaaaa

SEQ ID NO: 15480 - DNA, 297 bp, Homo sapiens
catcaaggccatcaacaacaactggcacccgggctgcttccgctgcgagctgtgtgatgtggagctggctgacctgggctttgtgaagaatgccggcagatctctgccggccttgccacaaccgtgagaaggccaagggctgggcaagtacatctgccagcggtgccacctggtcatcgacgagcagcccctcatgttcaggagcgacgcctaccaccctgaccacttcaactgcacccactgtgggaargagctgacagccgaggcccgcgagctgaagggtgagctctactgcct

SEQ ID NO: 15481 - DNA, 340 bp, Homo sapiens
atttttgcattttgcaatcaattttgtatttttctttttgtattgggggcattctctggtgactatttcctaagatgactttcaaagaggcttaacaaaggagctatggaaactcatctgattccaggtatgatgatggaagagggacaccaggaaaccctccccaaagaatggatcaaatcagtcatttgcccatggcttgtggacaaggaaggtaaatgtctactctaagaagcagacaactggacatacacattcatagcagaaggaaaccatcaagaagtggagggctgaccatgctggagtagtagatgaaaatatgtgtctaaacggggactta

SEQ ID NO: 15482 - DNA, 476 bp, Homo sapiens
ataaaaaatttaaattaaaaaaaaaaagtgaaagaggattcgggatgaccccaggtttttcggtccaagtaaaaagaacaatgagagttgccattagctgagatgagcagcttttgagggagagatgggaattccattttggacatgttaaggttgagatgtcttactggacatccaggtggtaatggcaagtgggtagttggtcgtatgagtctggaggtcagcagggaggtctaagttggagatacagtttgggcagttgtgagtatatagatggtaattaaaaccatgcaacttgtgaaatcaccaaggagagtgagtgcaggaaggaggaagggcacccggctctactcgtttgtagtctttatgtattgtacatttgagttgtgtgcacctcaaaactgatgtaccaccgggcgtggtggctcacgcctgtaatcccagcactctgcgaggccgaggtgggcggatcactt

SEQ ID NO: 15483 - DNA, 506 bp, Homo sapiens
tctttcagtttcatattactctaaatccattacaaatatgcttaacctctaaatatttcatcactgaagaaatcccagccctacaacgttggaacagtaaaatattagtccaaggatccagtgagagacacagaagtgctagaagccactcctcatgaactaaggagaaaaagaacagacaagggaacaccccagacatggtatcagagatccacatgacaggcccaatgtgcctcattgagaacactaatgggcgactgatggcgaatccagaagctctgaagatcctttctgccattacgcagcctgtggtggtggtggcgactgtgggccgctagcgcacaggaaaatcctacctgattaacaagctggctcagaagaaaaagggtgagtggcatgagcaaagctctgccaagtcccttctgtccatctacacagtcagsctccatcacgaggatgtgaagagagaaagagatgaggatgaatatggaaagctaactttccat

SEQ ID NO: 15484 - DNA, 500 bp, Homo sapiens
aaccatagaacctaaagaggtcaagcccgaaacaaaaccaccagaacccaagaaaacctttaacagtgtcagcaaaattgaccgactgtcaagaatagccttcccgctgctatttggaatctttaacttagtctactgggctacgtatttaaacagagagcctcagctaaaagcccccacaccacatcaatagatcttttactcacattctgttgttcagtcctctgcactgggaatttatttatgttctcaacgcagtaattcccatctgctttattgcctctgtcttaaagaatttgaaagtttccttattttcataattcatttaagaacaagagacccctgtctggcagtctggagcaaagcagactatgcagcttggagacaggattctgacagagcaagcgaaagagcaaagtcatgtcagaaggagacagaatgagagagaaaagagggggaagatggttcaaagatacaagaaaaagtagaaaaaaaaataa

SEQ ID NO: 15485 - DNA, 470 bp, Homo sapiens
atgcatggctgcatggagcccggccgcggcagcctctcctccgcgggatcctcgggcttccacttcaccatcggatctttgccactcagactgagggggagctcagagtgacccaaattctcaaagaaaagtttccacgagctacagctataaaagtcactgacatttcaggaggttgtggggcgatgtatgaaattaaaattgaatcagaagaatttaaggagaagagaactgtccagcagcaccagatggttaatcaggcactaaaagaagaaatcaaagagatgcatggattgcggatatttacctctgtccccaaacgctgaccacgccctggctgcatagatgctgctgcttaagaccttggatgaacttcactgacatcattcttccctaagcagtcaccaaaaaatttatatattttgctcatatacatttccatattataattatagaagatgtataatcta

SEQ ID NO: 15486 - DNA, 512 bp, Homo sapiens
aaaattcgctaacttccatcccgcaattccgctgaactcggcccgaaaagccccctcttgcctcaattccccgaagtaaatctgagctttgtgcagctccggagccagagcgtccagatgcggtccgggagattagcaaagtcggtggaagccaagctggagaaagcgcgggcgcagggagaaaagtagccccaagtgccctgcatttgctcttctaacaaagttctgtttgttgacggactgaccggcttaccgacacaaagatgggaagcaaatggagagacggatcaaggcccttcctcggcatctggaagcttgggcgagtgtcttggtcgccagagatggggtttcatgatgttgcccagttcttgaactcctgagctccagtgatcagtctgcctcggctgcccaaagtgctgcgattacaagtgtgagccaccgcgctggcctataatgtgttctttactcatgtatatgttttttaatttcsataataaattttttacaactaa

SEQ ID NO: 15487 - DNA, 444 bp, Homo sapiens
cttgaatttctatttcttatctgtgtcattctgcctctaccatgtctaatgtactgaatggtaaaatgtttgagaacagacatggtgtattagatttctttgtgttttccaactatctagcctcagatagggtaaacgtccaataaaaatttgaataatgtttgtgaaatacagtcactctttaggcatcagatttaaaaaatttcagccacgtacattggaagtctcttaaaaatgtctttcttgcctttttactttggaggtcatcattgtgaatattaattatttcagctaatcctagtacattaatgccttcaggggttgctgaaggcaacttagggtaggatggctggctgctctctgaaatgtccctagactgctgtgcgttaagtttcattttgtatgcttattatatcttctgcctcttccacatttagattactt

SEQ ID NO: 15488 - DNA, 355 bp, Homo sapiens
tattcaggaataactactgtaaatgatgaacgtgttaggagacctccaatatttgctacttgccaatcctaatttagttacaagaattggtaggcaatcctacttaattttggcaaaagccccgtcatctaaatggcagaataactcagagcatgtctttgaagatgctgggcgtctaccaccaccttatgtccccaccctacccaacaaaaataagtaaaaagaatatggtgtattctacaaatttgtggcatgctcaaagtttatgatcacataaaggcaagaggatacttcatgaataatacatttcaatgcaaataaacagatggttcacttccaaaaaaaaaaaaaaaag

SEQ ID NO: 15489 - DNA, 352 bp, Homo sapiens
acattctactaaaagccctataggcagcttacttgacagcaaatgctcaagagagcaaaatgtcctcctgctggatcctgactttccaaggctctcacttcaggtcttcctgagggatgccaaggatgccaacatgggcttatttctcacctcagatgcctctggccaattggcaaggggaaccacagtatccatgatctacacaccaggaattgttttctcctcctgatatcaggagtgctttactccttgattctgcacatgatgtaagttgtccctgtctgcctgagagtttctttcttatcttgcttatccaataaatatattttattggcacaaaaaaaaaaaaaat

SEQ ID NO: 15490 - DNA, 607 bp, Homo sapiens
attttttgtctaatcgcggcctgtgacgctcgaagggcggggagcagagggagatacagaaaccgacagggccaggcacccggtggctccgaagcggggaagtgggacaagatggtttacatctcgaacggacaagtgttggacagccggagtcagtctccatggagattatctttgataacagatttcttctggggaatagctgagtttgtggttttgtttttcaaaactctgcttcagcaagatgtgaaaaaaagaagaagctatggaaactcatctgattccagatatgatgatggaagagggccaccaggaaaccctccccgaagaatgggtagaatcaatcatctgcgtggccctagtccccctccaatggctggtggatgaggaaggtaaatgtctgctctaagaagcagacaaccggacatgcgcattcatagcagaaggaaaccatcaagaagtggaaggctgaccatgatgagcagtagatgaatgtgtatgtctaaacaaggactgctctgtgtcctcacagatgaatgaggtcatgctgggaattccctctgcagggaactggcctgactgacatgcagtycataaatgcagatgt

SEQ ID NO: 15491 - DNA, 553 bp, Homo sapiens
  misc_feature 48,85,93,115,124,143,149,160,193,195,204,208,234,276,293,304..305330,364: n=a, g, c or t
gttccgwsyysgggmmgrcggcmgssggscgcsgygkkcktygtyasnkgkysggggkgcgggrcgccsgcstsmmgggsccctnctctcssncmccgsgggtkctgratcgsgncacscrccnccgacttcgrawtcmggrnkgcggnrgggcggccgnamgmctsgyggktcgrgaaawkgwraaatccmngntascsgkynrcanccagaatcggracttkaggmamtkcnacawaaaccgaatcccgraagmwaaagaaaaagagsaccwgnagcmtcargcgawtwcnrrttaywgccnnkarccaggrryggagatyammrgrnccrtcgyggattakgtattyakytaagtgccarntrcagctmaaymkkwrrstscywksgsmwstrgsmrkctacragmmwwakwykytsmwrycttkggskryskkrrssarymkgargssaywykwwssakwkkskksyrsywysrskgakgrswrgkracctgwwggcattttttccagagtggtgcagtaccactgaggactgttgctgtatttgatta

SEQ ID NO: 15492 - DNA, 465 bp, Homo sapiens
cttaccttaaataatttacctttccttcttactttcagccagttaaatcatcatttgaatgttatatttaaatattactttatagaagagaagcatttaagactaaaaaatttcaggacagataacttgagctggtagcattaacatagaatacatctgcttcttatggttctgataatgttctaaactgtgataaatcctacagacacctaggtatataaacatatacattttcaggaatttggaattttgtagaaatttcaaaaagtctcaaggtgagagaaactgccaagtacagtcctcaactgaactatgcccacggggcccttgctttggatgaagaagatagaaccagagggcaagtgctccaattccttagcttcttaactactttagtttgagtataagaaaagaagctacttctctttttctgtttgtttttgttttgttttgttttgagacgga

SEQ ID NO: 15493 - DNA, 497 bp, Homo sapiens
ttatgagcctgtttctctttttcttttcttcttctcattattttaaagagatggagtctcagtatgttgcttaggctggtctcagactcctgggctgaagccattctcccgcctcagccttccaagtagctgggattacaggcaggagccaccaccccagacatgaacccacttctaatgcaaaacacatattgacctgacaacagggccctcagttgtggtggaaagagcagtgaccttggaattaaaagccctgttgtgactcgtggctttgcatgtttaaccaacsctacttttatktacctataatgtgcaggtatctgtctcactctttagggatgccaaaggtgaaatgaggtgtgctgtctatgtgacagtgccttgtgagcacttttctgacttctccctgaggaggtttgggtcaggcctagcagaaactgcagccatagagcatggagggaagtaggacttgactagcataaagtgagtctatgaga

SEQ ID NO: 15494 - DNA, 488 bp, Homo sapiens
ttatgttttgaaagcaataaaaatcacccagtttcaaaactgcacaaagggcttgaatagagatttttccagagaggacatacagatggccagtagcacatcaacatgattggtcattaggaaatgcaagtcaaaaccaaaataagataccacttcataccaggtatcttattttacctagtatggctataatagtttaaagaaaaaagggaaataactgttggcaaggatgtggagaaatgggaacattgctgatgaaaatgtaaagtggtgtagccactgtggaaaagggtttggcagttcctcccaaaggtgaacacagaaaccatatgatccagcaattccactcctacatatatatccaaaacaattgaaaacagggactgtggccaggtgcagtggctcatgcctgtaatcctagtactttgggaggcgggcagatcacctgaggtcagtagttcaggaccagcctggctaacatggcaaaa

SEQ ID NO: 15495 - DNA, 485 bp, Homo sapiens
  misc_feature 23: n=a, g, c or t
ctaaaaacagaaaccgacagggnccaggcgcccggtggctccgaagcggggaagtgggacaagatggtttacatctcgaacggacaagtgttggacagccggagtcagtctccatggagattatctttgataacagatttcttctggggaatagctgagtttgtggttttgtttttcaaaactctgcttcagcaagatgtgaaaaaaagaagaagctatggaaactcatctgattccagatatgatgatggaagagggccaccaggaaaccctccccgaagaatgggtagaatcaatcatctgcgtggccctagtccccctccaatggctggtggatgaggaaggtaaatgtctgctctaagaagcagacaaccggacatgcgcattcatagcagaaggaaaccatcaagaagtggaaggctgaccatgatgagcagtagatgaatgtgtatgtctaaacaaaggactgctctgtgtcctcacag

SEQ ID NO: 15496 - DNA, 352 bp, Homo sapiens
agtttctgtggcgttcgagttccatcggctcccatccgtgctatcctgccgccttagcgtgcttctccccaggatgcgggcagggggcctctctcccactccccacacaccgatttctgagtagcgataggggctggaggcttattttatggggtagggggccgctggtagrcgaagattgtccgagggagagggggaggatgaagccaktgcgtggcgaagacttgccagatgttgatgcctaagaagaaccggattgccatttatgaactcctttttaaggagggagtcatggtggccaagaaggatgtccacatgcctaagcacccggagctggcagacaagaatgtgc

SEQ ID NO: 15497 - DNA, 493 bp, Homo sapiens
aattcttatctgtaggacaagtgttggacagccggagtctccatggagattatctttgataacagatttcttctggggaatagctgagtttgtggttttgtttttcaaaactctgcttcagcaagatgtgaaaaaaagaagaagctatggaaactcatctgattccagatatgatgatggaagagggccaccaggaaaccctccccgaagaatgggtagaatcaatcatctgcgtggccctagtccccctccaatggctggtggatgaggaaggtaaatgtctgctctaagaagcagacaaccggacatgcgcattcatagcagaaggaaaccatcaagaagtggaaggctgaccatgatgagcagtagatgaatgtgtatgtctaaacaaggactgctctgtgtcctcacagatgaatgaggtcatgctgggaattccctctgcagggaactggcctgactgacatgcagttccataaatgcagatgtttgt

SEQ ID NO: 15498 - DNA, 489 bp, Homo sapiens
aataaaaaatttgggctgttccagtgcctttatttttccttataattcttagtatcagcttgtctttcttcaagaaccctttctgagaggttagctgtgatcacactgactgtagatgagttagatagtaatagccaatcttccagccccatcacaagaccagctctctctcagatcttctgtggtcttcctttgcaagatgttacagtccatggataggtcttgtacatctgttaacttattcctccgttttttaatatttttacgctgttgctgatggagcagcttttaaattttataattttgcattgcattttcggtggcgtgtaccctgacggacggacagttggtaaagtcgttaattttgcattgcattttcggtagcgcgtaccatgatggatggacagttggtaaagttgttcagcagatgtcttgattatgaggaggtctcatgcgaggtagctttgcttagccctctcatactcttta

SEQ ID NO: 15499 - DNA, 477 bp, Homo sapiens
tgaagggaatggagtcaagaagtttatttaagacaggagaaataagatttacatgctgaaggggaaaattcattagaaaaaatttgtcagtttcttatttaataaatagcatttgttatgtgccagcactattcgaaatgtcactgaaacacagactcagccactcaccacttgtagagtccgataacaatagtgaggtctggtataaagagagtgactttttattccaaagctagctttggggaagaaatacaggcctcctgccttaagggtaccacttcagctttggagcagaaagcagctgcttttaaaagggagcttggcatgaatggcacgcagtgagaaagcaaacaggtgagggtgctttatctgccgggcagttgaggtggcaatcactggcaccttcatgggcagaactaggttgtaaaagtggctgaggccaggcacagtggctcatgcctgtaatcccagcacttt

SEQ ID NO: 15500 - DNA, 436 bp, Homo sapiens
agttgcccgggtaaccgagcagagtcggcggggtgcgttccttagtctttcattcatcagcgtaaaaagaactgagtttaggtcgcaggtcccctccagggcaggcattatcgtgtgcgctgcagtaacctctcatcttgtggagtcctacacttagcgcatgttgctccggcgcgctgcgtaaagctgaggagcctgaggcccgaggtccgatgctcgcctggctggcctatggctgcgggagcggtgtgtgtcggaccgtagacggcctcacggctagagtttgaggactatgggggcggggacggtgcctgtgtctgtggcggtcaccgggcttcacgtggtcctcagcagggtgatggtggacagctcgcgcgagggcccgggagtcttggggacacttccccggcgcggtctgtggactgagcgctgggac

SEQ ID NO: 15501 - DNA, 432 bp, Homo sapiens
attcatcagcgtaaaaagaactgagtttaggtcgcaggtcccctccagggcaggcattatcgtgtgcgctgcagtaacctctcatcttgtggagtcctacacttagcgcatgttgctccggcgcgctgcgtaaagctgaggagcctgaggcccgaggtccgatgctcgcctggctggcctatggctgcgggagsgattgagaatttccacagaaattacagttttgtcctttttgaaaaaatagaactgtatttcagaaaaaagaaactacagttttagcatgcagaaaggaaaagggagaacaagccggatcagaagacgaaaactctgcggaagttctgaatcaagaggagtgaatgagagccacaagtctgaatttatagagctgaggaagtggctgaaastaggaagtttcaagattcaaacttagcg

SEQ ID NO: 15502 - DNA, 367 bp, Homo sapiens
agacccataataacaatgacaacactttcataacagttcatctgtgttaacatacaaattctcgcagcaacactccagaatgcaaaactctctgaggagctgagaatatgtctactgctaccaaaattgtaacccccatcatctagtaaagagttggtacacggtgaacatttgctgtgggaatgtattctgcttcattccagaggcctgccaattcttaatctcactataggctgaagagctgctcacatagaatacttgtagtgacttccattttcaccagtttagatcagtggacagagagatgctgaattactgctaagaagatagatccacatgccttcaacttcagaatcttaaattagag

SEQ ID NO: 15503 - DNA, 516 bp, Homo sapiens
atttttaaccaaagaccgaagaagggatagagtccacctcagtgtcccaagctcaaatcatgctcagaacatgttcagaccagttctaagtctgtttggccttctggatctgtggtccagaatacttgcagaattttccttatttctagccttttgtgccatatgtrggataattcrctgaayatcatcygwgccatggataactcatacaaaggcacaaacccaagccatgtgaatggcctatttgaaaacttttttttttactgaggcaactgggacagtagctgtkgaatgaactcctcttctaccaacgccagaatccagtgacgtttcaccagtatgaagatgggaascacatgctatacttatagactacagataaacttcatatccttcttatttttattgttaacattactgttttgattctatcattcactcctatttgctgagcatctattatgggcttagtattttgcagctataatgagaagaggaattattttttaaaaaacg

SEQ ID NO: 15504 - DNA, 208 bp, Homo sapiens
aaacagtattcgaatctgatgcaaaggacaacacaccctagagattgtaacagtgagatgaaccaagtgattggatggggttttgagttgctggaataatggagttacagtgtacaatgcataagcaacataataaattatatatctggtgaacaaatggaaaaaaaaaaaaraaaaaaaaaaaaaaaaaaaaaaaaaaaaaaaaaar

SEQ ID NO: 15505 - DNA, 165 bp, Homo sapiens
aaacagtattcgaatctgatgcaaaggacaacacaccctagagattgtaacagtgagatgaaccaagtgattggatggggttttgagttgctggaataatggagttacagtgtacaatgcataagcaacataataaattatatatctggtgaacaaatggaaaaa

SEQ ID NO: 15506 - DNA, 401 bp, Homo sapiens
  misc_feature 86,316,359,366: n=a, g, c or t
gctactacgatggcgatgagtttcgagtggccgtggcagtatcgcttcccacccttctttacgttacaaccgaatgtggacactsngcagaagcagctggccgcctggtgctcgctggtcctgtccttctgccgcstgcacaaacagtccagcatgacggtgatggaagctcaggagagcccgctcttcaacaacgtcaagctacagcgaaasttcctgtggagtcgatccagattgtattagaggaactgaggaagaaagggaacctcgagtggttggataagagcaagtccagcttcctgatcatgtggcggangccaaagaatgggggaaactcatctatcagtgggtttccagantkgccanaacaactccgtctttaccctgtatgaactkactaa

SEQ ID NO: 15507 - DNA, 417 bp, Homo sapiens
  misc_feature 261,327,360: n=a, g, c or t
gctactacgatggcgatgagtttcgagtggccgtggcagtatcgcttcccacccttctttacgttacaaccgaatgtggacactcggcagaagcagctggccgcctggtgctcgctggtcctgtccttctgccgcctgcacaaacagtccagcatgacggtgatggaagctcaggagagcccgctcttcaacaacgtcaagctacagcgaaasttcctgtggagtcgatccagattgtattagaggaactgaggaagaaanggaacctcgagtggttggataagagcaagtccagcttcctgatcatgtggcggaggcataagaatnggggaaactcatctatcagtgggtttccaggantggccagaacaactccgtctttacsctgtatgaactgactaatggggaagacacaga

SEQ ID NO: 15508 - DNA, 383 bp, Homo sapiens
  misc_feature 183..184: n=a, g, c or t
agcttccgggtttcctgggctactacgatggcgatgagtttcgagtggccgtggcagtatcgcttcccacccttctttamgktaacaacsgaatgtggacactcggcagaagcagctggccgcctggtgctcgctggtcctgtccttctgccgcctgcacaaacagtccagcatgacggtvhnngaagctcaggagagcccgctcttcaacaacgtcaagctacagcgaaasttcctgtggagtcgatccagattgtattagaggaactgaggaagaaagagaacctcgagtggttggataagagcaagtccagcttcctgatcatgtggcggaggcagaagaatgggggaaactcatctatcagtgggtttccaggagtggc

SEQ ID NO: 15509 - DNA, 360 bp, Homo sapiens
cttagccgrttagcttccgggtttcctgggctactacgatggcgatgagtttcgagtggccgtggcagtatcgcttcccacccttctttacgttacaaccgaatgtggacactcggcakmagsagctggccgcctggtgctcgctggtcctgtccttctgccgcctkcacaaacagtccagcatgacggtgatggaagctcaggagagcccgctcttcaacaacgtcaagctacagcgaaasttcctgtggagtcgatccagattgtattaraggaactgaggaasaaagggaacctcgartggytggataagagcaagtccagcttcctgatcatgtggcggargcagaagaatggggg

SEQ ID NO: 15510 - DNA, 261 bp, Homo sapiens
  misc_feature 104,114,203: n=a, g, c or t
cttagccggtagcttccgggtttcctgggctactacgatggcgatgagtttcgagtggccgtggcagtatcgcttcccacccttctttacgttacaaccgaatntggacactsngcagaagcagctggccscctggtgctcgctggtcctgtccttctgccgcctgcacaaaacagtccagcatgacggtgatggaagctcangarascccgctcttcaacaacgtcaagctacagcgaaasttcctgtggagtcgatcca

SEQ ID NO: 15511 - DNA, 400 bp, Homo sapiens
  misc_feature 284: n=a, g, c or t
actacgatggcgatgagtttcgagtggccgtggcagtatcgcttcccacccttctttacgttacaaccgaatgtggacactcggcagaagcagctggccgcctggtgctcgctggtcctgtccttctgccgcctgcacaaacagtccagcatgacggtgatggaagctcaggagagcccgctcttcaacaacgtcaagctacagcgaaagcttcctgtggagtcgatccagattgtattagaggaactgaggaagaaagcgaacctcgagtggttggataagancaagtccagcttcctgatcatgtggcggaggcagaagaatgggggaaactcatctatcagtgggtttccaggagtggccagaacaactccgtctttaccctgtatgaactgactaa

SEQ ID NO: 15512 - DNA, 416 bp, Homo sapiens
agtaactagcacgtggctcccgcccccagactgcttctttattcattcctaacctttaccttggcagatgaaatataagattcatcaaccacatttgacagcccatggcaggtttcctgttttccatcgtccctctgcaggtcacagacacacagagcccagccgtggcaggctcagccggggtccggggctgctaacaacggctacattcctcccccagggccaagggaaatcctgagcgcaggccagggttgtttggttttgaggtgtgctgggatgaaaggcaccctggaagtggaagtgactgccacaaaggcatcagatattcaccaccttctcggctgcctcagcacagcaagctttattctgggacctgagatcctgttctgagctggctttcccttctccaggctcgc

SEQ ID NO: 15513 - DNA, 444 bp, Homo sapiens
attcattttttctgctaccgtgactaagatggaagcgtttttggggtcgcggtccggactttgggcggggggtccggccccaggacagttttaccgcattccatccactcccgattccttcatggatccggcgtctgcactttacagaggtccaatcaccggacccagattgatgaggagcttctgggagatggacacagctatagtcctagagctattcattcatggctgaccagggccatgtacagccggcgctcgaagatgaaccctttgtggaacaccatggtcatcggaggctatgctgatggagagagcttcctcggttatgtggacatgcttggtgtagcctatgaagccccttcgctggccactggttaatggtgcatacttggctcagctctgctgcgagaagttctsgagaagcagccagtgctaagccagacc

SEQ ID NO: 15514 - DNA, 93 bp, Homo sapiens
tttttttctgctaccgtgactaagatggaagcstttttggggtctggggccggaccccccgcccaaagtccggaccgcgaccccaaaaaaaaa

SEQ ID NO: 15515 - DNA, 479 bp, Homo sapiens
gaaggcggtgcgacasrgctggagggcagaggaggcggcgcggggtgtcctgtccttgccatgaggccgcagcaggcgccggtgtccggaaaggtgttcattcagcgagactacagcagtggcacacgctgccagttccagaccaagttccctgcggastggagaaccggattgataggcagcagtttgaagaaacagttcgaactctaaataacctttatgcagaagcagagaagctcggcggccagtcatatctcgaaggttgtttggcttgtttaacagcatataccatcttcctatgcatggaaactcattatgagaaggttctgaagaaagtctccaaatacattcaagagcagaatgagaagatctatgctccacggcctcctcctgacagaccctattgagcgaggactgcgagttattgaaattaccatttatgaagacagaggcatgagcagtggaagataaaccgaaga

SEQ ID NO: 15516 - DNA, 343 bp, Homo sapiens
taaaaaacacaagtaagctactaaaacagtactccaaaagcaagtgtgagagatgcctatctagagattattgttgcacaggttagatwagggttttcatgctggtgggaagttcagagatgggctagctcttgaaactttggattaggttcaggaacaacatagtgctctgcagtggcccaattctacagatgatacacacttggaattatattttgaacagctgggaatacacagaaaatttttaaaggaaaaaaaacaaacatagagcatcgtaaatgagaccttatgatgcaggtgtgcatatattggcagcatgcaaattcacaaagtcaggtatttg

SEQ ID NO: 15517 - DNA, 180 bp, Homo sapiens
aacaatggctgaggaatgccccagagcgtgcgcggasctgtggcgcccaaggccacggccccgccggagaggaccagcgactactaccgcgtgasccggacctgccgggcaggttcaacaacccggggtggttccggggctacaggacccagaaggctgtctccgtgtacaggaccaggc

SEQ ID NO: 15518 - DNA, 198 bp, Homo sapiens
caagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatatacaaaaaaaaaaaaaaaaa

SEQ ID NO: 15519 - DNA, 457 bp, Homo sapiens
  misc_feature 197: n=a, g, c or t
aactgcaggaatcgacgctaggtcggcttccctggagcgccctccccagccctgtccagcctctcgatctttgtcctaacctcagacggcgatgggcggggcaagacgctggtccttcaggcccgagttgatgggcacctcgggctcatcaccgtgaagtcccctgcggccgaaggcggtggatttttagggtctcnmccgcccacccctaatgccagtccccaccactgcgtactctgttgcggatcacaccatccaatacaaactttattggtaatggaagccagcttcaatctggtttcctgttagaaacttgaaagagtttaatttaccgatttatttttaacaaccctagaaacctattaamcccartcacacagatttagcttttggttataacatggcctggcacgctttctgatattgtcgagtgtaaacataggtcttctttctccaa

SEQ ID NO: 15520 - DNA, 463 bp, Homo sapiens
aaggtcgtgaaaaaaattttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggagttcacaacctctgtggtccgtagagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtraaaaaaaaaaaaaaaaaaa

SEQ ID NO: 15521 - DNA, 442 bp, Homo sapiens
agaaccacgcgaggcagggtgaggggcgccaccgaggaagcgcccaccgggctcccggggctgccaggccccaaattgaggaagttgactgccagatcacactctgttggcccacgcagatagattccattcatcctttctaatgtctacaccatattttggataacatgccatcatctcacattgtgttgaaagaagaaaccagaatgttggggttgatgtatgccatatggatgaatttaaacagtttcggccttgcaataattggtatacttctaattgcatgtgaaattatactctttttaacgaaagatgaaactattcagtggccacatgcacttcgccctcggaaatctcactgtcggaatccttggaaatcacaccacgcacaacttctatttcttcataatttgcaaagaaccagtgtgactccagtcaagaa

SEQ ID NO: 15522 - DNA, 415 bp, Homo sapiens
gacgccaccgaggaagagaccccaccggctcccgaggctgccaggcccccgctcaggcgctgcctgcagaaccacgcccccctgtccctgtgctaagagggtgacgcgaktgcccgaagccctggcctggttaccattcgcgactccctcgtcctgggttctcccattgccaggaatgttttactagtaaccatggtatagttgagacgatccactcttgtcctacgcatttcggcacaatacaggcgtctaggaggcttacctggcattgcctgagagaatcttccatccatttaagtacccagtaacagagggagcaaagcaaatcttatcctcaaagaactgcagctgcttgttagatctacctggtggttccatagagaaactgctcagagaacctgcctttaactcgcct

SEQ ID NO: 15523 - DNA, 497 bp, Homo sapiens
tggtctcaccgtggcctcctctcttccttgaccacaccagcatccggaggggtttccaggtatataagcaggtgtgcgcctcctgccacagcatggacttcgtggcctaccgccacctggtgggcgtgtgctacacggaggatgaagctaaggagctggctgcggaggtggagagttcaagacggccccaatgaagatggggagatgttcatgcggccagggaagctgttcgactatttcccaaaaccataccccaacagtgaggctgctcgagctgccaacaacggagcattgccccctgaacctcagctacatcgtgcgagctaggcatggtggtgaggactacgtcttctccctgctcacgggctactgcgagccacccaccggggtgtcactgcgggaaggtctctacttcaacccctactttcctgggccaggcccattgccatggcccctcccatctacacagatgtcttagagtttgacgatggcacccc

SEQ ID NO: 15524 - DNA, 510 bp, Homo sapiens
attagcagagcttaggccggcagcagtcagaaatgtctgctggagaagacactgcaaagtgtcagtgagggcgtttgagaattaattttaccctagagtagctgckcaggtctgtttagcactcacctctacagttttgaacattcgataacaccagaatcagtctgatgccttgaacactttacatgaagggtttttcaaaatctagccacaaacagatatgaccagatttcaaaaaattttgagaaactaggaggaatctattttgacaaagccaagccacacataggatagaggcagacatgcgtgccctggaaagaagaaagtagaaggatcaactaaaagagctctcccactaaatggctgtgggctcctctaagaaactgaaacatggaagaaggaaggaccagccagccagaacagcagtgggtatcaaggaatgatataaaagcaagctcaagacagtcaagattcaaggagctatataccttgmttcctttcagagcttga

SEQ ID NO: 15525 - DNA, 542 bp, Homo sapiens
ataggaattgtgaaggcctttataaacctccattagcagagcttaggccggcagcagtcagaaatgtctgctggagaagacactgcaaagtgymagtgagggcgtttgagaattaattttaccctagagtagctgcgcaggtctgtttagcactcacctctacagttttgaacattcgataacaccagaatcagtctgatgccttgaacactttacatgaagggtttttcaaaatctagccacaaacagatatgaccagatttcaaaaaattttgagaaactaggaggaatctattttgacaaagccaagccacacataggatagaggcagacatgcgtgccctggaaagaagaaagtagaaggatcaactaaaagagctctcccactaaatggctgtgggctcctctaagaaactgaaacatggaagaaggaaggaccagccagccagaacagcagtgggtatcaaggaatgatataaaagcaagctcaagacagtcaagattcaaaggagctatataccttgcttcctttccagagctga

SEQ ID NO: 15526 - DNA, 287 bp, Homo sapiens
attcatctaacagtgattggatatggggagctgtctataggaagcgggggtgatcttgggtgagaatgctctcttctgctgagaacaactgccagaggactcaactgagcacctttaaccattagctgaggcttcttagcagtctgccatagcaactcaagtaatgcaactttactcagcatggaccgtcactttctccagacttctaagagatgccatagcagaaaatttatgcctttccctgcagtccttgtcaagtgttaaatcccatggccttatatcctgag

SEQ ID NO: 15527 - DNA, 406 bp, Homo sapiens
agacctttcttcctattcatctaacagtgattggatatggggagctgtctataggaagcgggggtgatcttgggtgagaatgctctcttctgctgagaacaactgccagaggactcaactgagcacctttaaccattagctgaggcttcttagcagctcctccggcattcggattgatctcttttactgaggaagagttgcctgagaatggttagtgggatgcaacacagcaccgtctctgcaattggtctcaagactggaactgactgtttacgcttatctggatgtaagaatgaaaattgacttagtggaaacacttgcatatgtgtaaagacctaaatggtggttcattcaagaaaattaatctgtgtaataaatggattaaaacagccataagtttttttta

SEQ ID NO: 15528 - DNA, 434 bp, Homo sapiens
tgtggcttgtgcttaacttactgaggggacacctagatttgttagccatttttttatggcagagtacaaaagaggccatataacatatctcagtatttggtaacattaaatggatttcactgatataatcaaatttctaaacatgaagccgggaaatcatgtcacatgaggaatggttgaaacaaccatgagtactgaacctgaagaagcaaggactactgggtagactctacacctgtcttgaaagatacagggaagcaaatttcagcttaactttaccatcaagcagtggaaactctgctggggactagtgtgtgaacaccactgcatgaggtgaccctgaatgatgctggtctttcaagaaaagttctacatgggaaaccttcatattctgtgggcatacactaaaagtgtactatcagctttgcacttcc

SEQ ID NO: 15529 - DNA, 447 bp, Homo sapiens
atttcctgagtgagggcaacaagaccagaggagccactttatcgatctgggtggtgccaactgatccatcaagtgccaggtctgcaaaatatctcagacactgatcttaggttttacaatagtgatgttatcaccaggagtaatttgaagaggtttagaatctcgcaggcagcctccagctgcatgactcctaaaccacaatttttaatcttgtggataatttgttagtcctgcaaagctgttattgtctttgtttcaaactataaactaaattcctcccaaagttaatttggcctacacccaggagtgaacaagaacagcttggggattacaagcaagatggagttggttaagtcagatctttttcactgtaataattttctcatttataattttgaatggagtttcaaccttgtctcaraaataattttttttaactaaatttga

SEQ ID NO: 15530 - DNA, 454 bp, Homo sapiens
  misc_feature 432: n=a, g, c or t
atttttcctgagtgagggcaacaagaccagaggagccactttatcgatctgggtggtgccaactgatccatcaagtgccagcctacacattagcataatgtggattttccaagctacttttatacatgaaataatataagctgtaatgagtgaaagtaagcacggatttttcagcagtactttccagaaattttgatggaagatcagctttttgtagctggagaagttggattaaaaaatgaccacagagaaactgaaagatgtccagtagaaggtctgtagacttcattccaattcagcatatccatgaggtcaccaagaaattaagtcaccaagaagttaatttcctcaagaaaggacccttgaagaaagttsctattattaagtcgattagggtgtagtggcaggaaaaaagtaaggctgatttctaangaacataaaaatgaaacattaa

SEQ ID NO: 15531 - DNA, 290 bp, Homo sapiens
tttacgatggcaacaagtatggcggctgctagtggtagatttgaaagtgcgaagagtatcgaagagcggaaagaacagacccggaatgccagggccgaggtgttgcgccaggctaaagccaattttgaaaaagaagaaaggcgtaaagaacttaagcgacttcggggtgaggatacatggatgctacctgatgtgaatgagagaattgaacatttctcacaggaacactctgtgaagaaaaagaagaaaaaagacaagcattcaaaaaaagctaaaaaaaaaaaaaaaaa

SEQ ID NO: 15532 - DNA, 507 bp, Homo sapiens
gtttgttttcagctgtggttctgaattagatggacttctaggaatactgtggtaacaatgaaacataactctggcctaaacccaactgaacatgttctttcataataggtattggggggtaaggggtgaatcttaactttagtgatgactttggtgaaatgaacttgattaataattggaatttgatcacttcctggcttgaatgaagctggtaaattaatctgaggccaagcaataaatggcccagattattcatcagcatggctacctgctaatgaatcattgtggcaggccacaactgttccatctaaccatcgaaataaccatatcaggagacacagtatagcttctgacagtggagacactggcattggaacttcctgttctgatagcgtggaagatcattcaacttcaagtggcacattatcttttaagcctagtcaatcattgattactcttcctactgcccatgtgatgccgkctaattccagcgcttcaatttccaac

SEQ ID NO: 15533 - DNA, 395 bp, Homo sapiens
agatggacttctaggaatactgtggtaacaatgaaacataactctggcctaaacccaactgaacatgttctttcataatagctggtaaattaatctgaggccaagcaataaatggcccagattattcatcagcatggctacctgctaatgaatcattgtggcaggccacaactgttccatctaaccatcgaaataaccatatcaggagacacagtatagcttctgacagtggagacactggcattggaacttcctgttctgatagcgtggaagatcattcaacttcaagtggcacattatcttttaagcctagtcaatcattgattactcttcctactgcccatgtgatgccgtctaattccagcgcttcaatttccaaacttagggaatcattg

SEQ ID NO: 15534 - DNA, 463 bp, Homo sapiens
cccacacaattcttatcaaaatctcagctgtctttgttgttgttgcagaaattagcaagctggtcctaaaaataatatggaaatgtaaagaacccagaatacctcagataatcttgaaaaagaaaagcaaacctggaagacttacacttttcaatttcaaaacttaaaactacaaaagtggccaggtgcggtggctcacacctgtaatcccagcactttgagaggccgaggcagacagatcacttgaggtcaggagttcaggaccagcgtggccaacatggtgaaacccatctctactaaaaatacaaaaattagccgggtgtggtggcgcacgctgtgatcccagctgctcaggaggctgaggcaggagagttgctggaacccaggagagaggttgcagtgagctgagattgcaccactgccctccagcctgggcgacagagcaagactctctccaaaaaaa

SEQ ID NO: 15535 - DNA, 435 bp, Homo sapiens
tgtggcttgtgcttaacttactgaggggacacctagatttgttagccatttttttatggcagagtacaaaagaggccatataacatatctcagtatttggtaacattaaatggatttcactgatataatcaaatttctaaacatgaagccgggaaatcatgtcacatgaggaatggttgaaacaaccatgagtactgaacctgaagaagcaaggactactgggtagactctacacctgtcttgaaagatacagggaagcaaatttcagcttaactttaccatcaagcagtggaaactctgctggggactagtgtgtgaacaccactgcatgaggtgaccctgaatgatgctggtctttcaagaaaagttctacatgggaaaccttcatattctgtgggcatacactaaaagtgtactatcagctttgccacttcc

SEQ ID NO: 15536 - DNA, 585 bp, Homo sapiens
aaacttcattttctagaggtaaaagaaatgatgagccttactcttcctcaaactcaggagtaacttaagtagtatttgtatcaagaaaaaatttttattttgtgctaaaagtccaataaggaataatacagtgtaatacaaaaaagactgcccctgagttgcctgctcctcatcttacacaaattcttcacctctctagaccttccccctctttgctgtaaaatgagtgctgcagtatcagtgttaccagggaataactggaataatacattcatgtagatcacatgccccaaaatgctaaatgaatgtcaagaagatgtgctttaattggaattgtatcaactgagaggaaataatcgactccaaatgttaatatttagttggtagattagccctttcaaacatggtagtcctgaaatttatatttccagttctaagagccttgaatgttaagagtcaacatgtgttgatactcagttaaccatgtctttgggcaaatgktttcacctmtctaagcctattacttcatctaccacttcagagaagtttgagaattaaacccagatatatgtgaaaatgcatgct

SEQ ID NO: 15537 - DNA, 515 bp, Homo sapiens
acaaagggtacaaaatctccgacaggaagaatccattttataatttttttgaggtctgttgcacagtgtggtgaatatagttagtagagtattatacatttcaaaattgctaagagtaaatttcaaatgttctcactacaaaatgctaagtatttgaagtgatggatatgttaactagctcgatttaattattctacattgtatccacagattatgacatcattttgtaacccataaatttatacaattataaattgtcatttacagtaagaaataatttgtgcatctttttagaaaaataaaataattttttacatctgtgtagttcaggtaaaaaaaaatttttttttaattttaataaaataaaatttaaaataaaataaaaatggtggcacatgcctgtagtcccagctacttgggaggctgaggcaggaggatcacttgagcctggaaggtggaggctgcagtgagccgtgattgtgccactgctctccagcctgggtgacagcgagatc

SEQ ID NO: 15538 - DNA, 50 bp, Homo sapiens
gacttggggctagctgcggcggggstgggtaagaaaatattgttagaact

SEQ ID NO: 15539 - DNA, 424 bp, Homo sapiens
agaacccaaggaagccctgccttctgatagccacactcaatgcaaggctgcgtatttcaccctggaggtctctataacaggggaggccaccccctcaatagccagcttttttacccttttgcttatgttgtcaaccaatttctaaccacagcaaaataacctaagtatacctctccttgaaaacatcaaaatattttctcagcagcttttattttcttgaagacaatttcagtaaaaacaattcttgtggcttttcctaaatgaatttttttttaacttctagtgattcttactcttcgtttttaggaactctccaggttttcacttcctacattctttcaagagtatagtgactaaaactggagaataatcatttaagtctgactaataaatttagcctcatgttgtaaaaaaaaaaaaaaat

SEQ ID NO: 15540 - DNA, 499 bp, Homo sapiens
aaaatctcggctgtactgccaggatttaagacactttgaaaatgggcaaagcctcatttttcctaggtcaaaaggagttcaagattggggaaatctgaggattcagaaggatgataaatgttagaacatggaatcaggatgtcaccagcactaacacctgtcctagttccagctctggtgaactccagcagacctgctcaagtggacagcattagggaccttgtcagttttgcagtgctttttgcctgaagccacctcaggtccctcatgctgcagaatgtgaaggagcaagtctctcaattggctaattgaatcaagctctgcaatttccttcttccctggagcctgatcctgcaggacaaggatctattttcaagtcaattacaattcctaagggatataattacctacaaaatcagcaaaggaaccctatttctcttatggtaatgtaatagtaatttttaaaataactacaatacatatgatagaaatggaaaaa

SEQ ID NO: 15541 - DNA, 72 bp, Homo sapiens
tttgtcagttagagcaacaagatggccgcggtggcagctccgcacctcagcgcgacggccccgggagccgta

SEQ ID NO: 15542 - DNA, 188 bp, Homo sapiens
atttacaatctcatttgggaatgtccttttcttcttcactgagctgaccaagttccattgtctcctgcagttcaaggcctaatgagtatcacctttttatgaagacacttgcatttttctagacaaaatctctcccactctcattatacttctatagttggttgtgtaaaaaaaaaaaaaaatgcgaa

SEQ ID NO: 15543 - DNA, 184 bp, Homo sapiens
atttammawtcyycatttgggaatgtccttttcttcttcactgagctgaccaagttccattgtctcctgcagttcaaggcctaatgagtatcacctttttatgaagacacttgcatttttctagacaaaatctctcccactctcattatacttctatagttggttgtgtaaaaaaaaaaaaaaa

SEQ ID NO: 15544 - DNA, 499 bp, Homo sapiens
tgttttacttattgttgggtgggatcaacgttctcttatggctttctggattcttaacagaagtaaaactctgattggtctttaagaataaaccttagtgaaaaaaatgagaactataatgacatatataatagcatttaagtaaattaaaatatcttcacattatacaatttgcattttctaaaagaatttcaaataaaattaaatacattataattgttgcctgaggaagaagcaaaggaaagtgatatatattaacataaatgaatgaattaaagataaatgaataaagcaagaaaggaaactttcattaaacaaagttgattatgtgcaatagacagtatgataaactctgtcctttgtacttgaaatccaaaaggtattgataaacaaacaaccaaacacaaaagattggatatatgacattatctttttccacttgtattgcaatgctgtgcatatatatcatcttggatccctcaatatgctgctcataagc

SEQ ID NO: 15545 - DNA, 476 bp, Homo sapiens
agactaggcgcarcacacgggagctactgggtctgtggactacttggtggtcatttcccagtccctgaatatgtaattagaattattctacttagtggtaggtgcaactctactttacgcatgtatttgccactacctgacataagatgttagaagttgagagacagatactaggaggtggaatccagccacctaaattccagaggagctgaaagaaagcaaggatctgcaatttggtgggtgcagatctaaacataccaacagagataccctctgcagttgatgaatatgaaactgaggatgcaatgatattattcaaatatacaggttcagcccaccttcatggagaaggaaatatacagagtatatactgatggttagatatctaccacctcacaggctcagaatcacatcatccctgagaaaagagtgaatttacatctttaggcttggattggaattccattttgatcttc

SEQ ID NO: 15546 - DNA, 358 bp, Homo sapiens
actgcggcgcacttccgtagaggtggacatggcgtgcggctttcgccggctattgcttgccagctttccagagtgttgaatcttccaccagaaaacttgatcacatcaatatctgcagttccaatttcccaaaaagaagaagtagctgattttcagctttctgtggattctttattggaaaaagacaatgaccattcaagaccagatattcaagttcaagccaagagactagcagagaagctaagatgtgatacagtggtgagtgaaatcagtactggtcaaaggactgtaaatttcaaaataaacagagagctcttaacaaagacagtgctacaacaagtaattgaagatggctcaa

SEQ ID NO: 15547 - DNA, 501 bp, Homo sapiens
ggaaggggtggggctgagggtggagagaggaagggaaggaagaaaaggggagccttcctggccagggtaaccggcactaagaggcctcactccaagcccccgaggagcctgtggtggggctggagacccggctcaggcccctccaccacccttaaagtcctcagaaggtgggaactgaactggcacaggctgggaaccggctgtgcgctggccacttgattttgccagctgccctgtaattcagctggtgaggaaactgaggcacagactgaggtagaatgattcgccagtcactcagcaagtcagcagacggggaggactgaatcccagcctgagagcaccgaagcttgtatccctgcaataccgagccccaagcctgcgagccccggtgcccatctctgagttaggccgtcttggaagggttcccttcctcctacaagatggtgtgtgaggagccttcaatacgacccggggtgtaaagtgtccaactctagtaggggc

SEQ ID NO: 15548 - DNA, 490 bp, Homo sapiens
taaactttaacttttcctatgaactcttctctaaagcaggtcacagggaaaaaaagggtttaaagagaaataacttctccgggcaaaaactgaggttagcgggcctatcagctgtttcttctcactccaccactgctgctgactggaggagcagcctggaaasgcagccgccctcccgcaaacagcagaatgacgcatcatccataaaaaatgtgaatgtgaggacggtgggaccatcctggcacactgagcagcagggacctccgagccctcagatgtcatccagccaggtgtgtgggggccactcgccatgcacagcttctctcagcagaggctgaccagaatggtggtgatatgaamgagttggggaattcgacttgaatacaaaacataacactgctctcacttaaaaaggttggtgaaccatactccaacagaaaggggacataagactggctctgctgggagtgaggaagctgactgagggaag

SEQ ID NO: 15549 - DNA, 469 bp, Homo sapiens
  misc_feature 123: n=a, g, c or t
taaactttaacttttcctatgaactcttctctaaagcaggtcacagggaaaaaaaggrtttaaagagaaataacttctccgggcaaaaactgaggttagcgggcctatcagctgtttcttctnactccaccactgctgctgactggaggagcagcctggaaagcagccgccctcccgcaaacagcagaatgacgcatcatccataaaaaatgtgaatgtgaggacggtgggaccatcctggcacactgagcagcagggacctccgagccctcagatgtcatccagccaggtgtgtgggggccactcgccatgcacagcttctctcagcagaggctgaccagaatggtggtgatatgaagagttggggaattcgacttgaatacaaaacataacactgctttcacttaaaaaggttggtgaaccatactccaacagaaaggggacataagactggctctgctggagtgag

SEQ ID NO: 15550 - DNA, 508 bp, Homo sapiens
aagatttgaaggaataaaatgtctctacatattgtacaaatgtaaacatggattggttactaaatgatacgaaataatttattgttcatatgttaggcatgactatggcattatgggtatatgtgtgtgagtccttaagtgttagagattcatactgaggtatttaaggctgaaatgttatgcctgtgatttacttttaaatacttaaaaacaaaaggtgggagggatagatgaaacaagattagcaaaatgttggtaaatgtttaatctggatcattaggtacacagggttcattgtgccgttcttactatctttacatatattttaaattttccataataaagttttttaaagtagaaaatcaagtttgggccaggcgtggtggctcatgcctgtaatcgcagtactttgggaggccaaggtgggtggatcatttgaggccaggagatcaagaccatcctggccaacatggtgaaactctgtcttctactaaaaatacaaaaattt

SEQ ID NO: 15551 - DNA, 427 bp, Homo sapiens
gatatccgccgctgctgggcgcgggcgggttccgggggcttgcggtggggggagcagtgatatcgagcagctggtggagccgcatcccagcagggcgttsctggcagagggttctaagtgggcaagggcgcagagtcccttttccttcacttcccacatctgattrmgctccatcaatgammcggagcatccactgamgctagaggagttgaacgtagtagagcaggtgcggttcaggttagcgaccccgagagtacagtggctgtggctttcacaccaaccattccgcactgcagcatggccacccttattggtctgtccatcaaggtcaagcttctgcgctcccttcctcagcgtttcaagatggacgtgcacattactccggggacccatgcctcagagcatgcagtgaacaagcaacttgcag

SEQ ID NO: 15552 - DNA, 456 bp, Homo sapiens
acgtggacgcgtctgggctgctggakgcasaggccgccgccgtcggtgtcgccgccaccaccaccatcggagtcacgagtcccgcgtctgtccgaagtcgccgctctcgggctgctcacgtctcttcggagagcgcgcacatggcgactcaggcgcactccctcagctacgcagggtgcaacttcttgtgccaacgtctggtcctgtctaccctgagcgggcgccccgtcaaaatccgaaagattcggggccagagacgacaacccgggcctccgagattttgaagccagcttcataaggctattggacaaaataacgaatggttctcgaattgaaataaascaaacagggacaaccttatattatcagcctggcctcctgtaatggtggatctgtggaacatgactgtagcgtccttcgtggcattgggtattacctggagagtcttctttgctt

SEQ ID NO: 15553 - DNA, 162 bp, Homo sapiens
atttccagcctcagtcgtcaaactggggatgccacggctttgatttctaaaactctggagatatgacttttaaataacttcatcatatcagtaagcctgacctaaatatttatggtctaaagggaccatctaggttttattttttattctgtaaattaagct

SEQ ID NO: 15554 - DNA, 242 bp, Homo sapiens
taaacatagtgctgtcggccatgtcccttcagccacagcactgccaacactgactggtgttgagaggagagctgaagcgagatgagtggactagggtgggctgttggaactgactggacagcttacaagccccgtagattaggtgatacatcactggtgagcaagctgagcactgagtggagccacctttgacatggctgactcctggatgcattttttttttttttgasgtcccccttctc

SEQ ID NO: 15555 - DNA, 406 bp, Homo sapiens
aattctgaacagcaatgctcatcacatgaacatgaagtttcctccaaaaggaatgatgactaatgctttgaggaaacaggagacgtcagacagcaagcccagaaaaacctgccagcaccaagagggtgtcctcaacaggcgcctgggggacatattattctaactaaagagaccagagcttccccaggaagggaagaggagagaaatgaagaacgtctgtgttcatgtttgccaaaaacaaaagtctgagaaatctctgagagactctacatgggaggtgaaatttaccttttctaagaccattgttgattttccttttacccttgaagtggactgaaatatcactaatggtgagaggaaagctcagaggttctattaaagaatgtgaaataggttaaaaaaaaaa

SEQ ID NO: 15556 - DNA, 418 bp, Homo sapiens
taagtttcttaaattgtaaagtaaggtgggtacagtttcttctagttcttagatggtgctgtcacgggccagcataattgctaaaacatccatacgtatggtagaccttaagtcatgtgctaatcatgaaagctgggctcaccctgaataccggcagttgcctggtctttataatgattactgaatgcataaccagttacgcttgcatgtgttcatcatcataacttattttctaaatatcttaattttcagaggttggaggtttgcaatgtccactcaagttgcaatgcaaaactctggctcatattcaatttctcagtttcaatccagaatgatcaggtaaatcaactgttttctttttatacttcgttaaaaggaaagtggggaggggggtggtaatttttacaggtttaatgta

SEQ ID NO: 15557 - DNA, 583 bp, Homo sapiens
gtagcaacctcttcattccagagctggcccagggaccggggtgggacaatgggtttatgcgtgtccacagtacaccctccctctcccagcctccaccccagggtctgcaggtcctccggcatgtagtatttatctagcaaggcggggtggtggaggcagcaccctggcaaagcagctcacacactgcagccacactcatcagctgtggtgaggcggctggagcaaagtcaaagtcatgcagcaaaatgaaaactctgggactcttcggcaaaatcctcattaagccgagcagctttggccaagtaatttttgcctccttccctcgcgtggcctgagtttaggagcaagggtggccagagtcccttacccacagataagcctcccctcatgaaatgccactcaccccgggctaccattgacatcagggctgcatttccagccagcctggaagtaaaatttgagaggaagacaatattaatctgtgtccccacctagtgagctgtggacaggtttaagttgggtctccttcttcttcaccacaaaaacaggctctaagaaatcatgttactaaaaaatcagtgta

SEQ ID NO: 15558 - DNA, 276 bp, Homo sapiens
ttctttaggcgtgcgaggagggggcatggcggatactgtgttgtttgagtttcttcacacggagatggtggctgagctgtgggctcacgaccccgaccccggrrgktggagcgccgggctccgtggggaggaagcgggggccaccaaggctgccccgggagacgctggccttcagggaggagctggatgtcctcaagttcttgtgcaaagacctgtgggtggcggtgttccagaagcagatggacagcctgcgcaccaatcaccaggggacctacg

SEQ ID NO: 15559 - DNA, 109 bp, Homo sapiens
ttctttaggcgtgcgaggagggggcatggcggatactgtgttgtttgagtttcttcacacggagatggtggctgagctgtgggcttacgaccccgaccccggagctaga

SEQ ID NO: 15560 - DNA, 501 bp, Homo sapiens
gatcagatcgatctaagatggcgactgtcgaaccggaaaccacccctactcctaatcccccgactacagaagaggagaaaacggaatctaatcaggaggttgctaacccagaacactatattaaacatcccctacagaacaggtaagctttctaacacctaggttttctgagttaggccacaaggtaaattgtgaatggggcaagtttgaagggaaagttagattatgagactagttttagatatgctaaggttgagggttctgttttcacttggatgacccatgaccagcagacagttttatgtgtgagtcttgagttcaaaaggagctatgtgagagattagtttgaaaagtattggtcataatggaagccacattagtaaataagttcccttaaggagaagtgaacttgactcaggacaaagaccggggatactagcatcatataggaggcttttgttgaagaagaatgcctatgaaggatggacatacaaagacagt

SEQ ID NO: 15561 - DNA, 420 bp, Homo sapiens
tcgttacaccgctttgtcctgagccaagcgaaagacgaactttaggaacacagttggaggtcacctctcctgcccagctcccgcaccctgcgtttaggagttcagtcccacagaggccactgggttcccagtgtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatcc

SEQ ID NO: 15562 - DNA, 387 bp, Homo sapiens
tttattttgccttctatgtcatcttggagcttaatgtgcatgcaagatatgggaaatactaaagcaagactactctatgaagccaatcttccagagaactttcgaagaccacagacagatcaagcagtggaawtttttcatcagagataaatatgaaaagaagaaatactacgaaaaaatgccatagctattacaaatatttcctcctctgatgctcctcttcagccttttggtatcctctccttctctgcaagctgctgttgacaaaaataaattggagaaagaaaaggaaaaaaaaaaggaagagaaaaaggagagaaaagggagccagaaaasgccgggcaaaaccacttacaggctgaaaasstgcaggaaggaaaggatcag

SEQ ID NO: 15563 - DNA, 476 bp, Homo sapiens
cttttccaggggagaaatggagaatgatggagggtggcccaggcggtgctgattggagtagacagccatcctcccgaagttggcactgagggtgatagagacctacctgcctggccaagctactccgccctgcctaagcatccccttccagagctccaggctggtggggttttattaagggaggcggtgctccttacacaggcctcttcctgctccccgtaaccctgtcgctggaggtgtctgtgggaaaggccaccgacatctacgctgtcaatggcacggagatcctgctgccctgcaccttctccagctgctttggcttcgaggacctccacttccggtggacctacaacagcagtgacgcattcaagattctcatagaggggactgtgaagaatgagaagtctgaccccaaggtgacgttgaaagacgatgaccgcatcactctggtaggctctactaaggagaagatgaac

SEQ ID NO: 15564 - DNA, 408 bp, Homo sapiens
ataaggaagaaactcccaacattataaggaatgaactccggacacaccgcctttaagaactgtaacactcaccgccagagtccacgtcttcgtcttcatttttgaagtcagtgagaccaagaacccaccacttccggacatcgtatagcctgaaaatagaaaaaaatcataaaaaattactttgtttaaactaatgagaccaaagtacaataaagctaaggaaactttttctcataaaaaataaaataatcactataatactaatattgtatttgtgaagcactgtgtaaaatctcttcggccaacgaagcacaggattaggattaaagagattaaataccatgcataaagactgctggtgttaggtacaaataaacgcaagactcctaatttaaaaaaaaaaaaaaa

SEQ ID NO: 15565 - DNA, 406 bp, Homo sapiens
  misc_feature 149: n=a, g, c or t
acttcctgtcactccaggaaaaccgagcggcggacgsggctcggcccggcttccagcccagagcccaagcgccttagccccgtcccagcgctttctgaaagacgggccacctcgcgcggagcgsamcaaggactccagggtccgcagtnaagctggtcaaatctgccccgcacacggtcaacgctcggtctgtgtcccggaagctttcggaccggacctgtctaaatagcgactttcagtcgtgggttttttgttcttgtgggtttgttttgttttttgttgttgttgttgctctacaaaagatttgtcccgcagtggacgggagcctcctcacggccgcccgcccgtctccgcagttctcctcagtgaccggagctgccgcgcgccccgttctccagagaaacaa

SEQ ID NO: 15566 - DNA, 96 bp, Homo sapiens
aatttttataaacttttgttctttcttgtaactttttatcagtcagctattccaatgaagcaaaatctgataatatattgcttttatactaaaaaa

SEQ ID NO: 15567 - DNA, 476 bp, Homo sapiens
aagatctgagttcatgtagctggtgttggcttagggtctgggaggaaggcttttgggaagatgtaaataagaacaaaatctgcagccacctgggaagcctggcctcagtgtggaagagaaggcagcaggattattacagaaccttgtgaagccaacgcgggcagccgccaggagctgcagaccgagaggatctcgtcctttcttgcggcccagggagaccaggcctttcattctgggctcgagaccaacaattcgaattccgaactccccctgcgtgtgggactcaaggtgggtttgcagtttgcaggcagctgaagtttgtctcttctccaggagggccggggcttcttcccttcctctctgtcccatttcttttttcttgagacagagtctcaactttgtcacccaggctggagtgcaatggtgtgatcgtggctcactacagcccccgcctcccgggttcaagcctcagcctc

SEQ ID NO: 15568 - DNA, 217 bp, Homo sapiens
agttgcagtctggtagttgtcgctggccgtgtgacggctcgctgttgccctgaaggcaggcgagccagctgcccaggaaaggtggaaagtggtagaagctgacccctgagccctggcaggtctttaagtgcgtttgtgcagccgatttcaaggctaagagagaaagactgcctctgatccctgaaggaagaaaaaaaaaaaaaaaacgggaaaaaaa

SEQ ID NO: 15569 - DNA, 407 bp, Homo sapiens
aaagaggagaggagaatggcggcggaaggctggatttggcgttggggctggggccggcggtgcctgggaaggcctgggcttctcggccccggccctggccccactacacctctctttcttcttttgttgttggggtctgtgactgcggatataactgacggcaacaktgaacatctcaagcgggagcattcgctcattaagccctaccaaggggtcggttccagctccccctctgggacttccagggcagcactatgctccagccagtacgtacgtctgacccctgacgagcgcasaaagagggctctatctggaaccaccagccgtgcttcctcaaagactgggaaatgcacgtccacttcaaagtccacggcacagggaagaagaacctccatggagacggcatc

SEQ ID NO: 15570 - DNA, 524 bp, Homo sapiens
aatccgggccgaggctcctggtaagggagcagagcgmgaagctgatcccccacggattcttagggggccgacttcccctgtgttgaagattcatcaaagactgattcgagtctgtgttcagcatgtgtgttttagattagaacagtgttgagaatttttatatggggcccagttttagcaggacatcatttaggatctttacaaacgagttcagggtacttcgttttatctgttgtctttgagccactgagtgaattagtaaatgtttgcaaatgtgattgcatcagtgaagaagaacatwtaccaccagttaaaataaatttcccgtgctgctgaaaaatcagtgccgccatcctctgaccctgctcctcccacgcgccctgcaggctgtctccctctgggtcgagagagcttcacagaccatttgggaaagagccaagcaaacacactctgcaagccatttgcataagtagacataatccatacgggaatgatgcactgttcggttgtagtttcattcgtca

SEQ ID NO: 15571 - DNA, 420 bp, Homo sapiens
aagccgccttgcgccttgggactgggcctgagaagggaggagttattcaggcctccgccagcttctaggccctggggatggtctttcacctccctctttctgatctctttttcatgctcctccttgctccaaagaaaagccggatggaaaagagcccagaacctattggaactgacaaaatcaagtcacggcgcctacaaagatgaggggcagattctggctgccttttaatttcgtccttcacctgatatctgtgccagagaatgataaaaatcataataaaggaaataatggaagaggagacttatgttactggggacatctaacataattattttcctgattcagtggcatggttcagtcttccaggagttctgctacagagaagagagtaacccccatccatcatggccaaagcac

SEQ ID NO: 15572 - DNA, 577 bp, Homo sapiens
gttaagatttcaacatatgaatttgatcagtttggagctattattcagatgtgactttaatgtcacattcagcggtttatgcacagaactgtgggccccagtctcactgtcttgccctatctcttcattcgctctccctcccagatgtggaagctgaatttatactggtgcctccaagctggcactctgagtgcaaataagcagtggctattgcattatttattggacctgaaagaaacctccaatatgatctagttcagccaccaatttatgcgtgagaaaacaaaggaccagaaaggtaaatcaagttacctaatactgcacagctgacctggaggctcaccagaattgaaagccattcttcggattcttcatccactgcccttccagtatagcatagaatctgctctgtattctagaacagaggcttggaatctagtctcatcaggcaattctatctgttaagtcttttaagcagatatccctaatatatgtattattttaaaaatcatacacatgtacaattgttaatctagtcattaaatgttaatgaagcataatatctttattttttgta

SEQ ID NO: 15573 - DNA, 580 bp, Homo sapiens
actttcttttcttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggagttcacaacctctgtggtccgtagagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtgaatgcttaatgcctcttttttgaaatagggaatgtaataattggccatttgcctactttattatttgggtaacattccagtattactctctgtgatttagcttatttaatggtgttaaactgaggttatattaatttttga

SEQ ID NO: 15574 - DNA, 484 bp, Homo sapiens
gctcttgttctgactgcggcaggctacagggcctcctcatgctcccagtcagtcgctgtctgtactggctctgttcctgaggcccgagcttgaactcagctgtgatgtggcctctcagatcacactgtcctatgcttgtccagcctggggtcaaacatacccctgattcatcccctgggtctctctggtgttaacattctgcctccacacattcttttccaggcccgaggccaagtgcccctcttggtgtcttcttacaggccattctgcccttccactgcagtgccatcctggctacagccctggacacagtcactgttccttatcgcctgtgttcctctccagtttccatggttcatctggctgacatgctgagcttctgtgggaaaaagtggtgacagcaggagcaatcatccctttccccttggctccaggccagtcccttcctgattccctgatgcagtttggaggagcacccatggac

SEQ ID NO: 15575 - DNA, 433 bp, Homo sapiens
tacgagaccctggtgatccagcagcgcgtggtgcgaatctacgatggcgaggagaagataaaatttgatgctgggactctccttcttagtacacaccgactgatttggagagatcagaaaaatcatgagtgttgtatggccattctcctttcccaaattgtgttcattgaagaacaggcggctggaattgggaagagtgccaaaatagtggttcatcttcacccagctcctcctaacaaagaacctggcccattccagagtagtaagaactcctacatcaaactctccttcaaagaacatggccagattgagttttacaggcgtttatcagacgaaatgacacaaagaagatgggagaatatgccagtttcccagtcattacaaacaaatagaggaccccagccaggaagaataagggctgtaggaattgtag

SEQ ID NO: 15576 - DNA, 465 bp, Homo sapiens
aaaaagaagaggggcaggactcgttcccgggaaccgaacctggaatccccggcggcagtgggtctgttgctgttgctgtggctgtcgctgcccgtcagctgccttcttttgtcgtttcccagcgctgcgcaggacttctcctggcggcgctgcggatccagggggtcggctgccaggtacaggacttgcaattgtgaccaaatatattacaaagggctggaaagaagttcatgaattgtataaagaaaaagcactctctgtggagactgaaaaattattaaagtatctggaggctgtagagaaagtgaagcgcacaagagatgagctagaagtcattcatctaatagaagaacatagattagttagagaacatcttttaacaaatcacttaaagtctaaagaggtatggaaggctttgttacaaagaaatgccgcttactgcattactaaggatctaggaaagat

SEQ ID NO: 15577 - DNA, 504 bp, Homo sapiens
aatagaagtatattaatttctaggttccagttccttagaatcctaagcctcaataccacaaagaaaagggaaacaaaaaagtgctgaaatcagctcctttggaagtgcagcaggaattgacactggcaggcatggttcaacagtactatatatcgttgccacttttctagagaagaaagattaccaactgaaaaagaaaagagtagctatgtgaagttgtaaattggtcattcttataaaaatccaacctcaagtggcagaatttctgagataagtgataagataagatagagaaatttctagaggagggcagctatctgtcttccatggaagcttcaaaggtggggcaagatcaccttgttctgacctacatcttcatagacccagagacctaattttaccagcaaatcaaaagcaagaatgaatgacatagctccattctgcctggtaataagtgttattatgaaaaawaatctgaggccaacctgatctttccccctttaa

SEQ ID NO: 15578 - DNA, 821 bp, Homo sapiens
accaccacgcagatgtctaagagaaagaaagaacggctccgtgcagatccaggccactgcaactgaatgcatttcagatctcggccaccccatctttcaattcccatggcccccccactcgcccagccacagctacagcggtggtggccagtcaggtctggtggggtgctgtgatcctgcccttgctggaggccaagaaggcctggctagaagacctgtgcctttaccaccagatcacccgagaagtcatctgtggaaaaatccagaattggagacaatggcgcacatgttaatgtgggggtctgtttccacacaagcaagtcctgttagagggacacatgtcaaaatgctagctcccactccaagttcaagttcccaaagttaacatcacaggaaattacaccaccaactgatttgccccaatgtcggctcctctgtctggaagtcgagtctgagaaggccattggtttagttcagctttggccaaaggaagggaccagctcagacaggaatgagtgaaagtgctggcctgattttttttctttttaaactaacattttccccaaaagttatcttgccattacccaagagtcataagtgaaaagacagccaaataccaaaaagccactgaggccctcaacagtgcctgctcatttcaaagccatttcacggacagccagggggtgcctgggccaccgcagaccacccctcactccaagagcactcctgctccccagagctccatgttccatgtaaagttccacggcatgtgcacaccacttcctaagaatgatgtcagcaaaaaaaaaaaaaaatgcgaa

SEQ ID NO: 15579 - DNA, 446 bp, Homo sapiens
gggtcttttgcggctgcagcgggcttgtaggtgtccggctttgctggcccagcaagcctgataagcatgaagctcttatctttggtggctgtggtcgggtgtttgctggtgcccccagctgaagccaacaagagttctgaagatatccggtgcaaatgcatctgtccaccttatagaaacatcagtgggcacatttacaaccagaatgtatcccagaaggactgcaactgcctgcacgtggtggagcccatgccagtgcctggccatgacgtggaggcctactgcctgctgtgcgagtgcaggtacgaggagcgcasaccaccaccatcaaggtcatcattgtcatctacctgtccgtggtgggtgccctgttgctctacatggccttcctgatgctggtggaccctctgatccgaaagccggatgcatacactgagcaactgcac

SEQ ID NO: 15580 - DNA, 488 bp, Homo sapiens
tgtttgatgtaacccgctttcaagttagactcaaaacagattcacttataagttaccactattatttttcgtcctatcaaagaagaaattcccttttgcttctctgaattgcttgttgcctagttagcacttttaaaatctggtctaatcgaatatgaaccttcaaaagatatacttgaagggccatctgctgaccccagctcttgtccatgtgagcaacttgtaatggtggctctgatggccatgtatgtggagtgagaaacagcagatggttgtaaagatttaaaatcttcaacaagtggccgagagtcatctctactttggagttagtcaagatgctggccacatgtggttagtatgttatgaagggtttcacatattctgctcatttcgggtttttttcccctccttgctgttctaacctcttctcttttgttttaagagctagcattctgtctgctgtagattataagaatctgtaaccaagt

SEQ ID NO: 15581 - DNA, 389 bp, Homo sapiens
acaactgaaaggtctggggagaaggcgccgtgtccgggtgtggagaggggcgtcgtggacakcgagaagagtggcycgtccctctcctccccctttccctctttcggaaagtggtttctgcggggcccgggagcctcggagtaccgaacctcgatctccggggcggggtccttggtggggactgarcgccccctcccggggacggkcggtctggccgcggagtcccctgcgggarcgtgattrrctggaaacggtcccgaacccccaggggagcccgatccctgggggactctggcttcggactccagtatctgwcgtcgcagggtccctgccctagtkgcctatgtcccttgctcggggccatggagacactgcggycagtacggcgg

SEQ ID NO: 15582 - DNA, 389 bp, Homo sapiens
agtgtgaggtaacccactgagataggtcgggcctgcggasctggcgagcagcggccctctccctggggcttcccttcaatctccgggacatttccccgacctggagctcctccgcctcaccgccagcctctctgcagattgcaagttcacctgccactaccgctgccgcgcgctcgtctgcctggactgttgcgggccccgggacctgggctgggaaccgcggtggagcgggacacgaacgtgacgagcctgtggagtgggagacacctgacctttctcaagctgagattgagcagaagatcaaggagtacaatgcccagatcaacagcaacctcttcatgagcttgaacaaggacggttcttacacaggcttcatcaaggttcagctg

SEQ ID NO: 15583 - DNA, 519 bp, Homo sapiens
tgatatgtttataggcaaacaaataaaacagcaaacttttttgccacatgtttgctagaaaatgattatactttattggagtgacatgaagtttgaacactaaacagtaatgtatgagaattactacagatacatgtatcttttagttttttttgtttgaactttctggagctgttttatagaagatgatggtttgttgtcggtgagtgttggatgaaatacttccttgcaccattgtaataaaagctgttagaatatttgtaaatatctttctgctgtagtgtggtggtctgttggttttctccctgtcgctgtgcctcctttaaagaatattgacattgttttacatcattggagaatttgattaatactcagcttgtgggaggaaatgtcttttcgcgaatggtgtgggctgcctgccccgcagtgaccactccatcgctgggggtatcgtgggtctggataacccgtcagagatggtttttgaatctggggtatagtgggaaggagtgctaatga

SEQ ID NO: 15584 - DNA, 331 bp, Homo sapiens
taagaaaaaaagttgccaatggctgaaagaagagcagattgatcctttacaaaattaactaatatactgcgtttgctgatttaattttttaaaactctgatgttttaaagaagcttgtttgtatagtggttgattgccttaactgtaacagtagcagtcttactgttgtkttkttgtkttgttttggttttggttttkgttttttaaagagacgggtggctaggtgcggtggctcatgcctgtrrtcccagcgctttgggaggccgaggcgggtggatcacgaggtcaggagattaagaccatcctggctagcttggtgaaaccctgtctc

SEQ ID NO: 15585 - DNA, 399 bp, Homo sapiens
atcagagggatcagcagctccagggaaggcctggctgccccgcttctaaatgccactccccccccatcagcgttcgtgctgtcagccttgcagccttctcctactcattccagctcsaatacccagcggctgccagaccgagtgaccggcgtggacacagaccctcacttcatcatccacgtgccccagaaagaggacaccctgtgcttcaacatcaatgaggagcctggtgttatcctgagcctggtacagaccccaacacaggcttctcagtgaatggacagctcattggcaacaaggccaggagccctgggcagsatgacggcacgtasttcgggsggctgggaatcgcaaaccctgcsacggactttcagttggaagtgamtcctcagaacatta

SEQ ID NO: 15586 - DNA, 561 bp, Homo sapiens
aattacatcttgggcacaatacccactgacaggaggaccctggaaagagtcacatcacctaggtatgaaagtcaacacctgtattttgggtctaagtacatgagacacaatggtggacaatctatactgagagcctcaattcttcctgtagacagtgtctcctcagtggagtaaaagcctcacggtgtgttgaatcttggtctgagagtcgccaacccactggtggaccggatccacttacaagagtcaatgttcaaactttcaactgtctccagctgtgagattcagaacctcaacaaatgctgctgtctccatcaataaagtccatgttagccacctagaggataaaataccacgaggaggagtagcaaggtgcccctgttgacagatcttgaagcacaagctcactcccagaagcacagctgcctagtcaacaaacagctgacaatacatgtctgaaggagctcagctgggaacagaagaatggccccactgagcctagcctaaatggcggacatctcaattatgagctaataagttttggatgatttgttatgctgc

SEQ ID NO: 15587 - DNA, 195 bp, Homo sapiens
aggaagaaaaggagcatcacatcatctaggtgataaaccctgagatatctcacaatgacccctttgtgcagagatcacaaagaagaatcatataacctgtgtgctggatccagtgacagtgtctcctcagtggagtaaaagcctcacggtgtgttgaatcttggtctgagagtcgccaacccactggtggaccgg

SEQ ID NO: 15588 - DNA, 311 bp, Homo sapiens
ctctttcatcttcccatcatggccgccgcctgtgcgcctctgctgagtcaccctgcactcattggatcagctgactacctagaccagtaacctggctcaatcagttctgccattccacccaggaacaaaacagcaagaaaacctcactttgactccctgtgattccgtcttcaacctgaccaatcagcactccccgcttcccaagctcctactcgccaaattatctttaagaactctgatcctcaaatgctcagggagactaatttgtgtaataataaaactctggtctcccaaaaaaaaaaaaaaaaaag

SEQ ID NO: 15589 - DNA, 405 bp, Homo sapiens
  misc_feature 45: n=a, g, c or t
aactcccatttctggtgccgtcacgggacagagcagtcggtgacnggacagagcagtcggtgacgggacacagtggttggtgacgggacagagcggtcggtgacagcctcaagggcttcagcaccgcgcccatggcagagccagacccctctcaccctctggagacccaggcagggaaggtgacaggaggctcaggactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgca

SEQ ID NO: 15590 - DNA, 513 bp, Homo sapiens
  misc_feature 476: n=a, g, c or t
agaaacactctgctacagaacaagtgtcttggttcacagcaaagaggacaaagaaaacagcaagttttagggggttgaatcctggattcccctggcaaacaccattctactttccgtctctacgaatttgactactcgaagtacctcatgtgaaatgttggtgccaaatgaacttttctggttcttctgaatatgccactgttgctggagaaatgtcactgctagagaacagaagactattattccaaagggtatttgagactgactgaatcaggtctggaacattattgaaatgagacccacaaaagaagagatactgagtaattcagcatttccagtgacatccttctggctgtgcttcaaagggaagatgacgctagagctggcagcatgaccagcactgtgtaaatcacccagacagacaacaacacaacatccatgaatagatggcagagttagcaagaaaaaatagcttngaggatggaaaaacccccaaggtgtgaaatctctggc

SEQ ID NO: 15591 - DNA, 569 bp, Homo sapiens
ttttaatgtaccagtaaccttccttctgagccacactgttccagatcctaaagacttcatctctaagctgagaacaacttgatgcagtgggaagagtaatgagcaggagaccaaggttgtagacctggttctgctgcttatctgtgtgttttgtacagtcacttaagcctgctgagcctgaatttcttttaaagttaaatgccagtgatactctaatgttgcaaggtagagtgatttagacagcagcaatgacaatgcagatgtaacgccgtattattttaccaagtttccaatcttggaggctcacaccataaaaccatcaacattgataccttggattgggcccagtagctcttgcctgtaatcccagtgctttggaaggctgaagtgagaggattgcttgatgccaggagttcaagaccagcctgggcaatttagcaagaccccatcttgccaaaaaatttaaaaattagccaggagtggtggcttgtgctgtagtcctacctacctgggaggcagaaggatcacttgagcccaggatttgacgctgaagtaagcaatgatcacac

SEQ ID NO: 15592 - DNA, 368 bp, Homo sapiens
aggtcgcggtacacggcgagaacgggcggggcggtctcggctgcgtccgggcgatccagtgcttagttccgtcatatccctctccacgacctcggtcgagcatgttcaccagggcccaggtgagacggattctgcagcgggtgcccgggaagcagcgatttggcatctaccggttcctgcccttcttttttgtcctgggaggaacgatggagtggatcatgattaaagtgcgcgtgggccaggagaccttctatgatgtctaccgtagaaaagcctcagaaagacagtatcagagaaggctggaagatgaatgagactgaacttcagcagtcaataaagtcaatatgaatttttaaaaaaaaaaaaaa

SEQ ID NO: 15593 - DNA, 393 bp, Homo sapiens
  misc_feature 352,370: n=a, g, c or t
atcttttcccagtctcggttcgacgactccattttcctcggtgggggcttagcgcactggaggagcggcgggcttcagacaggcgatgggaagaaagagaacacagctatctttccaagctgtgtgcacatggagcaccagctgcccttgagacagaagaaagctgttgttttcatcaggagacattcaactccttgaaaatgaacaatccggccaggcgcggtggctcacgcctgtaaatcccagcactttgggaggccgaggcgggcagatcgcctgaggtcaggagttcaagaccagcctgaccaacatggagaaaccccctctctactaaaaatgcaaaattagccancatggtggtgcatgcctntaatcccagctactcgggaggct

SEQ ID NO: 15594 - DNA, 493 bp, Homo sapiens
actttgctttaggcagtgcgtgtaacggagaggaaggcaagcatgggaaaagccagttttgaggatttctcatacattgcaaaaacaactgtgtccatcaggacccttttgctgcaagtaacagaaaccctcacaaaagctgggttttaaaaaaaaggggatttattcagagataaagcagtcttcatggttagtcaggcatggtgcctcatgcctttgtaatcccagtgctttgggaggaagaggaaggtgcatcacttgaggccaagagttctagaccagccttggcaacatagcaagaccctgtctctacaaaaatatttaaaaattagcccagtgtggtggcatgaacctatagtcctagctacttgggaagctgaggaggaaagatcatttgagcccagaagtgggaggctgcagtgagatataatctcaccactgcactccagcctaggtgacagagcaagaccctgtctcttaaaaaaaaaaaaaa

SEQ ID NO: 15595 - DNA, 436 bp, Homo sapiens
acttccgaagagagaaccgccatgaagagagaagggggtgccgcccacctctgctccgacagcctcccggagtcccagcagcaagacggcaaccacgcacccaacttctccagccacggctcatgccgccgtcgccagcggsccgacatgacaargcgstgcatgcccgctarggsccaggttttcccctcatccccagccccggggtcgtcgcccccgcgctgccatctgagacccggtagtaccgcccatgctgcagcgggaaagagaacagagagtcctggggacaggaagcagtcaattatagatttcttcaaaccagcttcaaaacaagacagacacatgttggattcaccacaaaaatcaaacatcaaatatggaggaagtagattgtctatcactgggacagagcagtttgaaaggaaactatcctcac

SEQ ID NO: 15596 - DNA, 443 bp, Homo sapiens
acttccgaagagagaaccgccatgaagagagaagggggtgccgcccacctctgctccgacagcctcccggagtcccagcagcaagacggcaaccacgcacccaacttctccagccacggctcatgccgccgtcgccagcggccgacatgacaaggcgctgcatgcccgctagccaggtttcccctcatccccagccccggggtcgtcgcccccgcgctgccatctgagacccggtagtaccgcccatgctgcagcgggaaagagaacagagagtcctggggacaggtaccgtgcagagggcttgagaaggggccgggtcgcgggggcaagggtatgaggggagggctgcagaccgccgctcttccagttcccgccatcctccgcgagctcaggcgttggcatttcggggcctggcaaatccccgccccgsctccgcgcagggg

SEQ ID NO: 15597 - DNA, 504 bp, Homo sapiens
gcacacacaataaagggaaagtgagcrgacaccaccactccagtccactcatagaggaccctctgcgcattagcactccgatgagtggcttgctatgggcaggtcccccagacgcctctcccccagtaagctggccacactgctcctccagggatctcagagagatggcagcttgtcaagttcctgagtcgctgggtatgtactgggaatttcagatttaatccctaattacatccagctcatcacctttgtaataggagccataatcatcttttcattgttgtctttgagtcactggggctgtgtggaacmtatatccatattcatgcatgtgttttctattttgctactacatcctcttccttagacttcaaaatgaagggggattttcttttctcctgcaaaagcctttatgaaagaaggtgtttgcttaacactttcaagcttccccattgacatcctttgttctttctctacacattcatggattaactactttgggtc

SEQ ID NO: 15598 - DNA, 410 bp, Homo sapiens
aagctggcccgcttgaggcgtagggggtggcgctctccgttcggcggcgctcccatggcgcacattaccattaaccagtacctgcagcaggtgtacgaagccatcgacagcagagatggagcatcttgtgcagagttggtgtcttttaaacatcctcatgttgcaaacccacgacttcaaatggcctctccagaggagaagtgtcaacaagtcttggaacccccttatgatgaaatgtttgcagctcatttaaggtgcacttatgcagtggggaatcatgacttcatagaggcatacaagtgccagaccgtgatagtccaatcattcttgcgagcattccaggcccacaaagaagaaaactgggctctgcctgtcatgtatgcagtagcgcttgaccttcgagtgtttgc

SEQ ID NO: 15599 - DNA, 362 bp, Homo sapiens
atatccggaagcaactgtcatggctgctgtcagtgagggcccgtaatggagatcgagtcaagggttgcccagggacacttaagagccttcdgcttcaaggaggcctctcaaaggacaaaggatgagactgcctggmggcagagtgccccccacaatcgtaggaactgtgtcgccgcgcttcccgttaacttgccgctaagtttttctagaaaagtmgcccttcttgccaggggtgtcctatagactttgtcatggagtgaaacagaaacaaatgaaaccactgccaagaacgatgttataaaggctttcctccacgttctcatctaggagttttatagtttcagcctcgtgaagtgccagct

SEQ ID NO: 15600 - DNA, 446 bp, Homo sapiens
ctgaatcccatcatgggtgaggctcctgatggcaccaggcaagtcccctggcccaacacaggccacagtcaggaagacttggaggtagccccttcaccccagtatggggacctccttgaaccccaggaatactcagttcccagtgtctgagtgagccggtgggtaccaagcattccctttarttcagtgggtaacggtttacaaagcacttttaaagccattttctgctgcaagcttcacaacagccaatgaagtaggtgggcccattggcccatttttacagtggggaaaagcgaggcccaggaaggccgagtgcaaacccagggtgcagcagctggtgcacagccgagctgacccccagcccagcattcctgccttcacagaggcccctcccttagctaaaagggatgtccaccaaaggcacttcckgtgtgcaggaaaatggc

SEQ ID NO: 15601 - DNA, 346 bp, Homo sapiens
  misc_feature 176: n=a, g, c or t
gagtgcttgggagtctggttctccataagccaggggaagctggaagatgggacagagtttgacagcagcctgccccagaaccagccctttgtcttctcccttggcacaggccaggtcatcaagggctgggaccaggggctgctggggatgtgtgagggggaaaagcgcaagctggntgatcccatccgagctagggtatggagagcggggagctcccccaaagattccaggcggtgcaaccctggtgttcgaggtggagctgctcaaaatagagcgacgaactgagctgtaaccagactggggaggggcagggggagaggcccccatcagggaccagactgttcca

SEQ ID NO: 15602 - DNA, 405 bp, Homo sapiens
  misc_feature 176: n=a, g, c or t
gagtgcttgggagtctggttctccataagccaggggaagctggaagatgggacagagtttgacagcagcctgccccagaaccagccctttgtcttctcccttggcacaggccaggtcatcaagggctgggaccaggggctgctggggatgtgtgagggggaaaagcgcaagctggntgatcccatccgagctagggtatggagagcggggagctcccccaaagattccaggcggtgcaaccctggtgttcgaggtggagctgctcaaaatagagcgacgaactgagctgtaaccagactggggaggggcagggggagaggcccccatcagggaccagactgttccaaaaaaaaaacaaaaaacaaaaacaaacaaaaaaacacttaaaagccaaaaaaaaaaaaa

SEQ ID NO: 15603 - DNA, 544 bp, Homo sapiens
aagtttacagaatttaagcatctgtggggccaggcgtggtggctcacacctataatcacagtactttgggaggctgaggtaggaggatcacttgagtccaggaggctggggctgtagtgagctatgattgtgccactgcactccagcctgagagacagaacaagaccctgtctccaaaagaaaaagaccataagcatctggagcacctgcaagagcctgtgcatgggctcggcgtgactgagagtcctccgccttgcccgagcatcaggcaggccctcccaagacccctcaagatgctagaatgggactttctgcaaagtttaaacatctgtacaggatttagcttctttggtggcgaacttggattgtgatgccctcaggaagtctggtttcactctttctgtcactgtacgtcagcattcatgaaggacttgtattttctctgccttgtgaggtttggagacttgaaggaggacaaagtgacgcgtcatgatggagccagctcagacgggcacctggcacacatcttcagacatgcggccaa

SEQ ID NO: 15604 - DNA, 489 bp, Homo sapiens
agaggtcagttagctgctttcgggcggccttaggcgacaggagactcctggacccagcacctgcccactgtgcctgtccacctgtggctacagcagctgagaccccagtgggctaagattggacaggggccaccagggacccagcaagtccttcagctctatttttgaaacatgaatccttcactcctcctggctgcctttttcctgggaattgcctcagctgctctaacacgtgaccacagtttagacgcacaatggaccaagtggaaggcaaagcacaagagattatatggcatggttggtggcatctgaaactgtccaggggaatcccagagagatgggcattgctattgggatcatatggccagagagtggcttctagaggctggctcctaccaataacctaacgcaataacttaatagcactgattatgagcacgatatgggcatacacccttgttgtgtctcagcttggaaacatctcctaga

SEQ ID NO: 15605 - DNA, 422 bp, Homo sapiens
aattagctgctttcgggcggccttaggcgacaggagactcctggacccagcacctgcccactgtgcctgtccacctgtggctacagcagctgagaccccagtgggctaagattggacaggggccaccagggacccagcaagtccttcagctctatttttgaaacatgaatccttcactcctcctggctgcctttttcctgggaattgcctcagctgctctaacacgtgaccacagtctagacgcacaatggaccaagtggaaggcaaagcacaagagattatatgacatgaatgaagaaggatggaggagagcagtgtgagagaacatgaagatgactgagcagcacaatcaggaatacagccaagggagatcacagcaacctaaataaaccagataccttttaaaaaaaaaaaaaaaaagg

SEQ ID NO: 15606 - DNA, 487 bp, Homo sapiens
tttattgccccatctgtgaattatttgcaaggttggataaatgtaatatatttaagcagctcaactctgtacatcatcaagggctttttaaaaagaagatgtaagttatctttgcagtaatcttgaacttaggggagggtctatattttaaaactttaaatagaccctggagcaattgtatgaatcactctgagggttttcatcaattatttgggtaattcatgtattggtagacatgtatttgatatattaaaactggtccttggagtgaggatgtattgatttagaaaactgaaaacaattttatttattgcttactatgacattgatactacgtgaagtactaggaataaaaagatttattagatgttgcctttcttcaggtagctcagagtctattgggttatttttacaagtcctctattccatatttcatacacagtcatacactgtataactatgttttggtcaatgacaaaccacatct

SEQ ID NO: 15607 - DNA, 406 bp, Homo sapiens
acttttcaggggacattcagaggcatcagccccttcctcctcaccagctcccagagttcccatctccatccccaatcctaaagaaggaaatcgatgccacggtcctcaaggagccctggggacccaggcgccctactcgaagatgtggcccacaatcccagaccccggagattgcccagcgaggccggaacaccagcaggatggcagaggacacctccccaaacatgaatgacaacatcctgttgcctgtccgcaacaatgaccaagccctaggcctgactcagtgcatgctgggatgtgtgtcctggttcacctgttttgcctgctccctgagaactcaggcccagcaggttctgtttaacacgtgcagagacagagtttcaccatgttgcccaggctggtctca

SEQ ID NO: 15608 - DNA, 500 bp, Homo sapiens
  misc_feature 485: n=a, g, c or t
caaaggacatcttggttatttcaagttttggctattatcaatacagctgctatgaacattcatgtacaggtttttgtgtaaatataacttctcatttctctgggtaaatgctgtggtttgaatgtctcctctaaaactcttattgaaacttaatccccaatggcagtattgagaagtggggcctttaagaggtgattggaaggccgggcgctgtggctcacgcctgtaatcccaacactttgggaggctgaggcgggtggatcacctgaggtcaggagttcaagaacagcctggccaaaatggcgaaaccccatctctactaaaaatacaaaaattagccaggtgtgttggcatgtgcctgtaatctcagctacttgggaggttgaggcaggagaatcgcatgaacccaggaagcagaggttgcagtgagcttagatcgcaccactgcactcaagcctgggtgacagagcaagactctgtctcanaaaaaaaaaaaaatg

SEQ ID NO: 15609 - DNA, 383 bp, Homo sapiens
  misc_feature 35: n=a, g, c or t
agtctgcttgcaggcggtcgcagcgctccagcggncggctgtcggctttccaattccgccagctcggctgaggctgggctagcctgggtgccagtggctgctagcggcaggcgtcccctgagcaacaggagcccagagaaaaagaagcagccctgagagagcgccggggaaggagaggcccgcgccctctcctggagccagattctgcaggtgcactgggtggggatgatcggcgggctaggttgcaagcctcttatgtgaggagctgaagaggaattaaaatatacaggatgaaaagatggcaatgttgcctcccccaggacctcagagctttgtccatttcacaaaacagtctcttgccctcattgaacaacgcattgctg

SEQ ID NO: 15610 - DNA, 601 bp, Homo sapiens
ttcagtccagggcttagtcagcggggcccggagtggcttccctggctggcatctggacttaggctatttccgtgcacgtaaaagcggaatattggaacggttgcacagaacttccaaataatttttaccgccacgcaagatttagccctgaggtcttaatctcaggatttgggacagtaaaagctgtcgtccctccccctcgtccagccggtggcaagcgggtactgcgggcggttccgtccgtcccctttcgcagaaatggcaacgaatgaccaccagcattagctgagccaggggacgtgggagggttgattgcctaaacgactctgcatcgccgcctctttttgaaactaagagaaaatggtgggagatcaaaagaaaactaaataaacacacaggcaacttgtcctgggacctcaactaagcaaatgaagccttattgtgtgtgctgagcctgcagttcccaaccttccggggaagatgggagggcgacaaagggcacagtaggcttgcctggcagtaagtgtgaccgcagctatccaggcggaagagcagaggactgaaaccaccctccagcaagcgagtgtccgccgcgttgagg

SEQ ID NO: 15611 - DNA, 368 bp, Homo sapiens
actaaaaagaagcgggagaatctgggcgtcgctctagagccactgcagtagcctccgtggggcagggcaggcagaagcaccaagtgtggctgaagacggtctccgctctggagcaggctgtgcacagggctcaggggaacctcccactttcctgagacaagggctaggagcagatcgatgggctagaggagaagctgtcccagtgtcggagagacctggaggccgtgaactccagactccacagccgggagctgagcccagaggccaggaggtccctggagaaggagaaaaacagcctaatgaacaaagcctccaactacgagaaggaactgaagtttcttcggcaagagaaccggaagaacatgctg

SEQ ID NO: 15612 - DNA, 481 bp, Homo sapiens
acatatttccaattaagaggaaagagagaagcaaaagacagagaaatgaagtctgaggcaataacagaatgttgcagtggcacatggtagatgctcaaataatgtttctaaaataaatcacctatttctgcaatttgaaaaatccagtttgtggagtcctgggttctgctgagacacttcagttgcagctgaaggaagaggaggaaggcagaaaagtgaaacagggttctggccgagttttgagccttccattgattcaactggaacatttttgcatttgtttatgcaatggcttccactacatcaaattaagaagaataccacaagcacattctgcacaaagcagatttgaaacgatgtttatgtctggaaaactcaatttatggggagccaaaactctttcagctctaagaaaatatatgtaatgtgcaaatatggaaaattgtctccaatagaactgttcataaagactgtaataaat

SEQ ID NO: 15613 - DNA, 220 bp, Homo sapiens
ccacatttcaaagtgcttgacagtcmacaggtgactaaatggctctcctatgggttatagcccagctcttgactctttgatccacaaggataagaaccacatccacttccacatctcsaggtatgaggcagataaatagcagagagtgattaccacaaaactcttctcamccacggattccggcatttgtgggcagctgcaggaagagtaggtgggagga

SEQ ID NO: 15614 - DNA, 485 bp, Homo sapiens
  misc_feature 430: n=a, g, c or t
atttttttcccatctttcttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtagagccactatgaggagggccctgggaaggttagtgtgtaaggggcacggcttcgttgggggagggggcgcttggctgtgactcgcgcacctgcaagccgcctccgggctgtggcgtgggagatgatagccagaaaccaggctgagacgcagactagcattccacttagcccaaggaccagtgaggaagctgggcatcctagcgcgtascgctaaaggaatgggcaggtagatccggaagccctgcctccatnggccacctgacgccccctcccccgccccgcagaaagccctgagatggctcgggga

SEQ ID NO: 15615 - DNA, 450 bp, Homo sapiens
aatagtgatgtgaatatcctaccagcactcaaccacagggggaacactaatatatccctggctcagtattcagctgatgagactctcctgcctggttctactcacagtgtcttctgcagttacattgccttcactgrtcatgagaggaggggctgtggtagggccttgaaggacgcctgtggagccagaggccattggattgcaggcagccaagagctacctcgcccctgctatctgctgtggccctcgccgggatgcgatgccctgacatgggttgcctggagctgtgcgcaatgagcaaggggacggctgatggccctcccagatctgcatggcmtggaaaccataaaactcttgggaactatcacatcttccccagctacaggaagaatagaagtagkgttggagaagtcaaggggtcagaagtactgggggcgttccaggttcagc

SEQ ID NO: 15616 - DNA, 324 bp, Homo sapiens
  misc_feature 76: n=a, g, c or t
ttttttaagcttctcggtctgtggcagcagcgttggcccggccccgggagcggagagcgaggggaggcggagacgnaggaaggtctgaggagcagcttcagtccccgccgagccgccaccgcagtcgaggacggtcggactcccgcggcgggaggagcctgttcccctgagggtatttgaagtataccatacaactgttttgaaaatccagcgtggacaatggctactcaagctgatttgatggagttggacatggccatggaaccagacagaaaagcggctgttagtcactggcagcaacagtcttacctggactctggaatc

SEQ ID NO: 15617 - DNA, 372 bp, Homo sapiens
aaaccattattagaaacatgccaggttggttgtcttggtatcgtttagtaagaaacaaagattgaaaatgagtcctggtgggccgggcacggtggctcacgcctgtaatcccagcactttgggaggccgaagcgggtggatcacaaggtcaggagattaagaccatcctggctaacatggtgaaacccgtctctactaaaatacaaaaaaactagctgggcgtggtggtgcacacctgtagtcccagctacttgagaggctgaggcaggggaatcgcttgaacccgggagttggaggttgcagtgagccaagatcatcccgctgcactccagcctggtgacagcgagactctcttaaaaaaaaaaaaaaaaa

SEQ ID NO: 15618 - DNA, 456 bp, Homo sapiens
aattaaatacgatgtgtaactgatagatacatttctaaacttgtatgtttgttagactacaggttatactgtcctcttaaaactctttcaggtgctatctcctctgaagaaataattaagtatgcacataggatcagtgcaagtaatgctgtatgtgctccactgacctgggttccaggtaaacatactcgtcttattatactagatatatgtggttttgaagattcttaggtgactatgtacagacatagatttaatttaaaatgtatttatccttagaaacctctgccacatattttcacatctttaatggtttataagtaatgatataggccatgggttttataaatttggttttctgtgaagccattgttgctagggactgtgtttctttcgtcttttgaaataataaattgataattttttaaagtacgagataataatgtgatgcttcta

SEQ ID NO: 15619 - DNA, 597 bp, Homo sapiens
caaaacttttttcatgtacgaaattatttaaaatactgtataaacttacctttaggctatgcataaggtatatatgatgaataaataaattttgtgtttagacttgggtcccatccccaggttttctcattatgtatgtgcaaacattctaaaacctgaaaatatccaaaattctaaaaacatctggtctgaaacatttcagataagggatccacagcctgtgcatagatcctgttacagtggcaaagtcaggtctattgctttttcaaagaacggcacagcctctttcccttacatttgtgctgaacatcttgaaggaagtagaatcttctctgccttctgctagcccatttcccagtactttaaaactctttgatattgctgaatgagataaatcatttcagatattttttcagatataccaaattctatcttgccagtgcccctctgtcctgtgagccttgcagtgaccttccttgtttctgacaaggaccatgatgaatcactagcttggggtatcttgtgtctcttcacactattgattttaggaaaatactttctgcagcttgcaaagccgtaatgtcatttttctttaga

SEQ ID NO: 15620 - DNA, 162 bp, Homo sapiens
atctatagcttggcacagagagattcacgcaccctcaagagtgtgggtgagacatatacagcctgttagacctgaaggcagatggctcttcttaaggccaataaggatctcatttccgcagattgaaggagttcagcgttctgctgaatcagcagggtcttc

SEQ ID NO: 15621 - DNA, 462 bp, Homo sapiens
acaggaaacatataaaaaggagagcagggaaaggagccagtgagacaggaaaaacctagtaacgtggtgtgatgaagctaggggaggaaggaaggaaggaagggcggcgtggaacgtgctgatgggtggtggcggggaaaatgaacgagtatccaccagcaacgagaggggcctccatggtcttggtgggagcatttctttggagaggtggaatcagaagccccagatgtcagagggttaaggaataatttggaggaaaagcgtaaaggcagtggaggtgaggagagaattttcaaaatgtttggcagtgattgcaatgaaagaaaaaaatggagggagcagagtatatgcagttgaggaacttttttagtttggagtgtgttaacacgattgttaggaagaagcatcaagtgaaggagaaaggtgaaaatgctggaaggtggggcttagtgatgaaacaaa

SEQ ID NO: 15622 - DNA, 566 bp, Homo sapiens
attccagaggtgggcactcctagccccaggcaggatgttgtttgggtcctataaatctagggctctcccagccttacgtccctggcactgggcttgccagatgtaagggaactggatgggtggtttatttccatctaatatgagaaaaagaagggtacataccgttttgaggaagaaaacttgaacctgaaggatcacagaatcctgcacctccgctagctgtgaaacactgcacaagttaccttgcttccctgaaccccagcagcttcatctgtaaaatggttgtaacaaaggaatctcttaggttttgtgtctcttgtggctcagagcataatttggcaataattgatgattttcaactgttgaaccattgtacctttataatatgtatggcagaacatctaaccttggcatgaaaccatcaagcaatttcatgtggagtgtgttactcttggggctggaatgagcatggcatgtgcggagatggcactgaagccaacgtctgggccccaaagccggtgcaggctctgctgtcatcgtcaggactcttgtgggctgtggggctg

SEQ ID NO: 15623 - DNA, 504 bp, Homo sapiens
cttctgatgacgcattagtcggctgcaatggcgccggtgagsggtccgcgaagtggcggcctggtggtattgaggcgcgtggtgaaggggtttccactgtcgggtacaggaataagaatgtgagacagaagacatggcggcctaaccacccgcaagccttcgtggggagcgttcgcgagggacaaggctttgcttttcgaagaaaactgaaaatacagcaaagttacaagaaattgctacggaaggaaaagaaggctcaaacgtcactggaatctcaattcacagatcgatacccagataatctgaaacatctctatttagctgaagaggaaagacataggaagcaagcaagaaaagtcgaccatcctttgtcagaacaagttcaccagccgttgcttgaagaacagtgtagcattgacgagcctttatttgaagatcagtgtagctttgaccagcctcagccagaagaacaatgtattaaaacagtaaactccttttacaatt

SEQ ID NO: 15624 - DNA, 336 bp, Homo sapiens
aattattcacagatagtaccctagtaagaaaaagaaggtggagcaggtaggaaactatgtgaaagaatctcctgrtgtcataatttccgggtgtcaccggaacatttgatcatcattcctttggcaattccagccttctgtggaaaggccagtagaaagcattgatttattcacctctacaggaatcagactcagcctcttttggttttcagtgaagtatgccttttcaatttggaacccagccaaggaggtttccagtggaaggaggagattcttcaattgagctggaacctgggctgagctccagtgctgcctgtaatgggaaggagatgtcac

SEQ ID NO: 15625 - DNA, 183 bp, Homo sapiens
gtcaacatcttcgagcatcggcagctccggagccggggtaactggcagcaggtaggaaactatgtgaaagaatctcctgatgtcataatttccgggtgtcaccggaacatttgatcatcattcctttggcaattccagccttctgtggaaaggccagtagaaagcattgatttatttcacctc

SEQ ID NO: 15626 - DNA, 348 bp, Homo sapiens
attattcacagatagtaccctagtaagaaaaagaaggtggagcaggtaggaaactatgtgaaagaatctcctgatgtcataatttccgggtgtcaccggaacatttgatcatcattcctttggcaattccagccttctgtggaaaggccagtagaaagcattgatttattcacctctacaggaatcagactcagcctcttttggttttcagtgaagtatgccttttcaatttggaacccagccaaggaggtttccagtggaaggaggagattcttcaattgagctggaacctgggctgagctccagtgctgcctgtaatgggaaggagatgtcaccaaccaggcaact

SEQ ID NO: 15627 - DNA, 576 bp, Homo sapiens
caaatgaagatggcttttgtacttcctgtggacatgtagtaatgtctatattggctcataaaactaacctgaaaaacaaataaatgctttggaaatgtttcagttgctttagaaacattagtgcctgcctggatccccttagttttgaaatatttgccattgttgtttaaatacctatcactgtggtagagcttgcattgatcttttccacaagtattaaactgccaaaatgtgaatatgcaaagcctttctgaatctataataatggtacttctactggggagagtgtaatattttggactgctgttttccattaatgaggagagcaacaggcccctgattatacagttccaaagtaataagatgttaattgtaattcagccagaaagtacatgtctcccattgggaggatttggtgttaaataccaaactgctagccctagtattatggagatgaacatgatgatgtaacttgtaatagcagaatagttaatgaatgaaactagttcttataatttatctttatttaaaagcttagcctgccttaaaactagagatcaactttctcagctgcaa

SEQ ID NO: 15628 - DNA, 476 bp, Homo sapiens
caatgtgaaaataaaacataaaaactgttcttggaattatttctaaacagaactaacatcagagtcatctgaatcatcagaatcatctattttggaaaaatcggattcatcaaaggaatcttcggccagcaactgggaacgatgttaacaccacgtgtgggaacgctgtgtcttctgggatctgacgttttcagcaactgagaattcctatattttgtaaatggaaataccagtactaaaaacagaatgccataaatagaacgaggtcttttgtttccaaagtcgatatactcgagcaatgcagaagtcatcatgaaaacgagagatttcatggcaaacttatctcggggtaaacgctgcagctgcaacactgccggtgagtgttctcagggcaaacaggaaaagggctaaaaacaaatggatgaaaaaaggtataccatgttaatacaaaccgagagaaagctggagtggcgaca

SEQ ID NO: 15629 - DNA, 381 bp, Homo sapiens
aaacacacagatcgtccccaggctgctgttcgagaatgagtattcctatacgacccagatagactacaaccccaaggaccgcctgctctatgcctgggacaatggccaccaggtcacttaccatgtcatctttgcctactgacacccttgtccccacaagcagaagcacagaggggtcactagcaccttgtgtgtatgtgtgtgcgcgcacgtgtgtgtaggtgggaggcaggcaacaccaggagcagaaatgaaagaggcaagaaataagtgctatgtggcgagaaaaaaagttttaatgtattggagaagttttaaaaaacccagaaaaacgctttttttttttaataaagaagaaatttaaaatcaaaaaaaaaaaaa

SEQ ID NO: 15630 - DNA, 520 bp, Homo sapiens
  misc_feature 73: n=a, g, c or t
ttgattgtattgtatactatattaaatgtgaatttgtaccccttcattttaaaaggtcattgtgttctactgnctattttagattactttggggttggggaagggtgttttggtaagcaggattttaagtcctctctctctcgattggttttatgaagatataaggttatgctcttactaccaagctcaggattcttgattttaaaggtacaaggatagttgtgggagttttatttttggttatatttgaactgtatgaatggtaggtctgaatattgagaatttccatggtcttatgtggaggtaaaatatacagataactgatcagtttgagtgactgcaacatgttctggttgcacaacagttaggcatgctatggtttatatttgtgaagtttggatgcctgtgaagaatgattaaatacatgtttctaatattttagtgttttgtatttaggttatttattctttgtatctaaaactgaacagctactgtgctatattgattttattggtagtat

SEQ ID NO: 15631 - DNA, 503 bp, Homo sapiens
gtggaaatgactggtaatcaaaggaaaagaggaggaaatagtagaatgctctagttcttacctaaaaacagataagggaagacaccagggaattgtccttttccttgcacctccatcatctaccccgagacgccaccctgacagcttgcttgtccatggcactgtgggtgtgtatggtgagtggcctcttctgcactggtggctccttgagagccggagcatgtctggctcctcttagtgtccccaacacgtgggatggcaggttcctgctgcagagcaggtgcttggcaagcatttgaaaaacaaatgggaataaaggagtgagtgactgagggagagctgttctgcagcacaggacaggcacagagtcggggccctcgctgtactctcaacgccccactctttcctggggacatttgtagattgctcacttctgtcagtcctcttcatctgagagatgagagtgtcatctctgccctcctcaatttagtggtttagaagac

SEQ ID NO: 15632 - DNA, 63 bp, Homo sapiens
aacaaggtctggattacagacctgcagggtaagggatctttcttcttgggtgcaacactaagg

SEQ ID NO: 15633 - DNA, 396 bp, Homo sapiens
ctcctgccccagcctcccaagtagctgggattacaggcatgcgccaccacgcatggctaattttygtattttttagtagagacggggtttcaccatgttggccaggctggccatgaactcctggcctcaagtgatccaaacgcctgggcctcccaaagtgctgggattacaggcgtgacacccgggcctggccgaacaatgtcttttgtatcccttccctcacactaacaatcctctggagatcatgccctgctagactgcaggtcagtgagaatcctggaatcaacacgcattggctcaaggtgcctcccggctgtttatgtgtctgtggtgtgcacccacgaacttctgcagcctaacatggctcctttcgtcctctaggcatcgtgcctccct

SEQ ID NO: 15634 - DNA, 403 bp, Homo sapiens
aacactcaataaagctcttctttgtcttgttcaccttccacttgtctgcataggcaggatttggcaccactggcagtgacactgtaacattttgggggctcatctgggatctgcaaaagggtgaagaaagagaggattaatgagaaaaacaaattagacggcatagcctggatgcagaaagtctaactccaaaattcatgaaccttccaaaatttaccatgttgtccctcttcacttggaactctagtgacacacaaagatgtatgttttttcatttgtacttcctctgctaagatctctaagtgaggggaaaggactaagccgttgtctattatctgtttccgtgttctttcaaagctctagaaaatacgtgagcataattcaagtaaaaatgttggaagct

SEQ ID NO: 15635 - DNA, 507 bp, Homo sapiens
tcagagcacccacgaaatgagctctcaaagttcaaaggcatgccagaatattttctggaactccagctagtaacatattcaaacattacagggatcatttagtctgtttttcttaaaactgaactaaaagatggaggctataaaatcatacactccaaataagatatgcatatttcattgatatcttgagtctaaaaaaaaataaaaacaaaaacaaaacacattcaggatacaaatattgccttgttaaaaaatactgtctcaaaggtggctgaactttcttttctagacctttcccctccccttcttacagtatcccctctttatccttctctaaacagctgttctaacatactacttaaataaaaacacttgaaaaccagcagatataaaacaaagtcattttgaccttcctactgttttttttttaaagcaaagattaaaatcccatgtaaaaccttcctccctatacaaaaaagaatagcagcatttttatcttcaatgaca

SEQ ID NO: 15636 - DNA, 508 bp, Homo sapiens
aagtaagccatacgtattttcttagaagtatagatgtatgtgcgtgtatacacacacacacacacacagagataaacacaatattccttatttcaaattagtatgattcctatttaaagtgatttatatttgagtaaaaagttcaattcttttttgctttttaaaaaatctgatgcttcataattttcattatattattccacatatttttccttgaagttcttagcataatgtatccattacttagtatatatctaggcaacaacacttagaagtttatcagtgtttaaactaaaaaaataaagattcctgtgtactggtttacatttgtgtgagtggcatactcaagtctgctgtgcctgtcgtcgtgactgtcagtattctcgctattttatagtcgtgccatgttgttactcacagcgctctgacatactttcatgtggtaggttctttctcaggaactcagtttaactattatttattgatatatcattacctttgaaaagct

SEQ ID NO: 15637 - DNA, 372 bp, Homo sapiens
  misc_feature 315: n=a, g, c or t
acagagaagcggctcccgtcggaggccgagtcgtcgccacgatcgcccccttggtggactcgcaggccgagcggcttccccgcagagctcgaggagggcagacggcggcgggggcgcatgagtcagaggcaggtgctgcaagtgttcgagcaataccagaaggccaggacccagttcgtgcagatggtggcggastggcgactagaccccaaaacatcgagacgctgcagaacgcgggtgtaatgtctttgctgagaactcttcttctggacgtggtccaacaattcaacagactgctgctttggctcttggganactggccaattataatsatgacctagcagaagctgttgtgaagtgcgacattcttcc

SEQ ID NO: 15638 - DNA, 462 bp, Homo sapiens
ctatggtttcttctaattcttattgcttaaagtatgagtatgtcacttacccgtgcttctgtttactgtgtaattaaaatgggtagtactgtttacctaactacctcatggatgtgttaagccatattgagttaaatctcatataatgtttctcaatcttgttaaaagctcaaaattttgggcctatttgtaatgccagtgtgacactaagcattttgttcacaccacgctttgataactaaactggaaaacaaaggtgttaagtacctctgttctggatctgggcagtcagcactctttttagatctttgtgtggctcctatttttatagaagtggagggatgcactatttcacaaggtccaagatttgttttcagatatttttgatgactgtattgtaaatactacagggatagcactatagtattgtagtcatgagacttaaagtggaataagactatt

SEQ ID NO: 15639 - DNA, 505 bp, Homo sapiens
amaymssryrtsskskryggkysmyssrwsmkyyawgrgkygtsggrcggsrgwmcskwgyrysywgykwkswskkmkkysgkmgtskstrkyrtytskcrkttckyrgwwswkwrmwkrrkmyyyrmkcyscasysysyrrcrkytgmtrgwygckkrmcksstrymtrytrywkmtgacygskgmsckgsrskyygswkwyygkytmctskyksskmsykkssmcytymmcyytywwctctykksyytcrksyytyrtstskkgwgtkksrwsytwsmksytwgcskkwkrmywsagawyammsmwcarmmcamagmrsawwkcsrakkymymakscmycakmscsarsakcgrscctttkyykmtttkcycwkyrccmwscwscaycytgywcyytktwgtcwtkaactytgtyksctkmwymwttctcwtwtwygttrattgagrrgtarragactaaaasamtgttcactctttgaatttcctggatwvkagaagttctg

SEQ ID NO: 15640 - DNA, 224 bp, Homo sapiens
ttagataaagtaagcctaggtgttgtcagcaggcaggctggggaggccagtgttgtgggcttcctgctgggactgagaaggctaacgaagggcatccgcaatgttggtttcactgagagctgcctcctggtctcttcaccactgtagttctctcatttccaaaccatcagctgcttttaaaataagatctctttgtagccatcctgttaaatttgtaaacaagc

SEQ ID NO: 15641 - DNA, 510 bp, Homo sapiens
atctctaggctttgtgcacacattccaagctgttttcttacttcaacaattctataagctacccattgtttcacattttctcaaccaggtgtataaataagagaaaacaggtgttggaatacttggtcccattttatactctgtcttctgatccttgaaccttgaaacatggagtacctctgcctgattaaagaggaagataaaaggctaaagaggaaaagatgcagttgataatgtcgtgttgccagaagaaaggcacagggcaagtgaactatagtgattcagtattcagctggatacacagcacacaggaaaattttcaccatactttaaaggtcagttagcattactgttcagctcactgaagctgtttatgataaggaaaaacaacacatttttactgtgcccaagtcctttcatctcccctaaataattataatcatttcttcttggataatatagactagaaggaaacatattcacacatttagttctcagcaaatctttaaa

SEQ ID NO: 15642 - DNA, 324 bp, Homo sapiens
tagattataactcactaccagccctgtagctcccctgccccttgtacaaggtgggggcacagagaggggcgggaagagtgaatgccaagaggatggcttattagtctgtgtctgctttcctgagctttcctctctaaggcttctgtgccaccctgattttaaactgctgacaaagacatctaggctgttgctgccaatttctgtggctaaggggcaatcaagggggagggaaaggcaaaatcttaaagagcttttagcatatctctcttttaagtcctacctctgcttccctttgctttcaggctccaggttaccagtttcctt

SEQ ID NO: 15643 - DNA, 418 bp, Homo sapiens
atatatgctctaccattataagtacagtcacctgggggacagactggatcctgtgaacaattgagctctctgggtctttgggaactaaagaagagaacagaagggcaaatagtataggacaccagaaggtgtctatatgtttggagtgggggtgtcttgtcttctgccatctactacctatgtgacattaatttaatagtttgcttagcctcacgaagcctcagttcccatatctgcttaaaaaacaaacacgggctgggcgtggtggctcatgcctgtaatcctagcactttgggaggctgaaacgggaggatcacttcagctcaggagtgcgagagcagcctggacaacatagtgagacytcctcctatttaaaataataataactattattcaaaggaaaaaaaaaaaaaaaaag

SEQ ID NO: 15644 - DNA, 422 bp, Homo sapiens
  misc_feature 322: n=a, g, c or t
cttttcctgtggcagcagccgggctgagaggagcgtggctgtctcctctctccgccatggcgtgtgctcgcccactgatatcggtgtactccgaaaagggggagtcatctggcaaaaatgtcactttgcctgctgtattcaaggctcctattcgaccagatattgtgaactttgttcmascaacttgcgcaaaaacaacagacagccctatgctgtcagtgaattagcaggtcatcagactagtgctgagtcttggggtactggcagagctgtggctcgaattcccagagttcgaggtggtgggactcaccgctctggccanggtgcttttggaaacatgtgtcgtggaggccgaatgtttgcaccaaccaaaacctggcgccgttggcatcgtagagtgaacacaacccaaaaaccgatac

SEQ ID NO: 15645 - DNA, 322 bp, Homo sapiens
agagaaaggcttcaccccgagcctgaaggtgatcatccttatggacccctttgatgatgacctgaagcaaagaggggagaagagtggaattgagatcttatccctatatgatgctgagaacctaggcaaagagcacttcagaaaacctgtgcctcctagcccagaagacctgagcgtcatctgcttcaccagtgggaccacaggtctgtrcccatgaaactgaacctaagacccctggtcagccaagaacatggcttcaattcttggccactggtaggctgcatgcttatgagcccactcctgatgatgtggccatatccta

SEQ ID NO: 15646 - DNA, 316 bp, Homo sapiens
acagaaggagaaagcagcttaagggaaacagcctaaaaatcctttcaagacaagtgaagaggcctttcagttgcatttcagaaaatcgccttgattaagagagtggcagaaaagacaaacccacatttttcatccgcatttgaattaacagcccccaggaagacagagcaaaagtgtttgctgctatattatcaaatggcattgccaggggacccttggaaaaaggagactccagttctttgtactcctgagaccagtaataacctggaaccccactcagcaataaaacctctttccaaaaaaaaaaaaaaaaagg

SEQ ID NO: 15647 - DNA, 525 bp, Homo sapiens
taaggtaaagtatctttattgattgaaatctttagtattaaattaaattacatgtgcttacaaaaagaagtacatttttgatgattactatgactttatgccttcccaacagtatgcagtatagttgggcacataataggcatatggaccagtggtagcaaacaaatattaataatagtcctcaaggagtctctgaatcatttatatcctagacaaaggttgcaacatactcctgaatactgggaaggtgtggcctactctgcctatcaatagtatatcttcacacattcaaatcacaaatatttaactacttctcttttaattataaataaaataaattttatttttgccagttgtccttcaatttaagattaggaattagcaatataattataaaatcaaaagtgatttttatgtcctcatgttataaaggaaatagccacagaatcaactagagtatttgttttaagtgtaaaatgtgaggggaggatgattttttaaattgatacaaaataatttatacat

SEQ ID NO: 15648 - DNA, 411 bp, Homo sapiens
ataatagccagtggattttgtacttgcttaccctggactgagtgtcttggtgtcctgtttgatttagttggggtagttgtaaagcaaacagtgtaggtattggaagccgttcacacctcctttccgagtatctgcatgccttgctggcccagagcacaagacccccattgtgctcccccggctcagaatccaaggaaagaaaggaagcgaagcctctgcattgagttctaggacagctgagacacttggattggacttaatcttaaacctctggagttcaagaccttttaaaaagggctaaataaacaatctctacatgtaaaaggccactgactcctacttcctctgtatagagcaactgttgaactcagctgcctgtagggcgtgattctcagtcaccagactcagctt

SEQ ID NO: 15649 - DNA, 466 bp, Homo sapiens
tcaaggtagtgcctggtggtgtggaaaatcattttgaaatttctgacatctaaaatcttaggcgtttcagaccacattcgcctgagtgatcttatagcagccagaatcttaaggtatacagattttgatactttaatatacacctgtgctacsgaatttgacttcatggaaaaagcggtatgaatgtttcctttttccttctttactaatatgagtttttgctctaggtttttttaaaatctgaaactcaaaatttttgcacagaaacagtcaacttattttattttttttactgtaacttttgctaatctaccttcctcacttgtttttttgtctgttaaaaaaaaaaatagcctctatcttatagagttattgatgatggttaaatgrgataatcggagaagagtgtttaacatactatatgacccataataattactattattacaaatcaattacttttaat

SEQ ID NO: 15650 - DNA, 526 bp, Homo sapiens
ttgtgtatgagtgtgaaacaatgcagactttggagtatctcattagaaggactgtatgaatttatagaaaattgaatctaatttcagaagagcgcactgtcttctcagtcaacaaggttgcccagccacagagggtcagagaaaatgtcctttacccctccccactccttttcatagaatcctctctcaggcctaactgagctgtcatatccaattcagactgacacagagtgaggggcgctgagagtctctatgtatataaagatataggaagaaaataaggatcatcacaggaatctgttgggcttctccccatgactgtgatcttacccatgtttgaatcacaaactttaaatttataataattatgattcttgcagttttcaagtaatttgttaaatgcctattcaacacagacagatttttattttcagctgtggcttgtaaatgcctacaaactgattcatgttggtggtcgttatgacactttctgtgaattrgtgaataaatatgattttmgaatttc

SEQ ID NO: 15651 - DNA, 425 bp, Homo sapiens
tttctgcttccgcgaccccggcggtgcagggcgggtggagtcgcggagtagtcctcatggccgccccgccggagcccggtgagcccgaggagaggaaggtagaattagaagatcatgtgatgttggagtaggagggtttatcttggtgactttgggatgctggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatcttgagcataaaaagaagtcaatgtaaacgaagttaagatcaaccacataaaacatttcatgtgcaataagctctcaatcaagtaaataaagtttaagttgyarwmwaaaaaaaaaaaaaaa

SEQ ID NO: 15652 - DNA, 373 bp, Homo sapiens
agtcgcggagtagtcctcatggccgccccgccggagcccggtgagcccgaggagaggaagaattagaagatcatgtgatgttggagtaggagggtttatcttggtgactttgggatgctggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatcttgagcatagaaaagaagtcaatgtaaacgaagttaagatcaaccacataaaacatttcatgtgcaataagctctcaatcaagtaaataaagtttaagttgtagtctaaaa

SEQ ID NO: 15653 - DNA, 399 bp, Homo sapiens
agggcgggtggagtcgcggagtagtcctcatggccgccccgccggagcccggtgagcccgaggagaggaaggtagaattagaagatcatgtgatgttggagtaggagggtttatcttggtgactttgggatgctggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatcttgagcatagaagtcaatgtaaacgaagttaagatcaaccacataaaacatttcatgtgcaataagctctcaatcaagtaaataaagtttaagttgtagtcatttttttcccacacttgtgt

SEQ ID NO: 15654 - DNA, 371 bp, Homo sapiens
agtcgcggagtagtcctcatggccgccccgccggagcccggtgagcccgaggagaggaagaattagaagatcatgtgatgttggagtaggagggtttatcttggtgactttgggatgctggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatcttgagcatagaaaagaagtcaatgtaaacgaagttaagatcaaccacataaaacatttcatgtgcaataagctctcaatcaagtaaataaagtttaagttgtagtctaa

SEQ ID NO: 15655 - DNA, 370 bp, Homo sapiens
agtcgcggagtagtcctcatggccgccccgccggagcccggtgagcccgaggagaggaagaattagaagatcatgtgatgttggagtaggagggtttatcttggtgactttgggatgctggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatcttgagcatagaaaagaagtcaatgtaaacgaagttaagatcaaccacataaaacatttcatgtgcaataagctctcaatcaagtaaataaagtttaagttgtagtcta

SEQ ID NO: 15656 - DNA, 370 bp, Homo sapiens; identical to SEQ ID NO: 15655

SEQ ID NO: 15657 - DNA, 467 bp, Homo sapiens
attggaaaaacaaaaacaaaaaaaaacctttgttctgtaagacagtatagaaagttgggagaaaggtctactccaggatcaagacctcctgaaaggtctcgaggaccccaatggttcctggaccacactttgaaaactatggatctgaaaataatttaggattgcattttcctgtaatgccgcgtcttagcaatgtgaccttgggaactggaccaacaggacccaagggagagtatcaaaggcaaaacaaaggaaaatgaggacaacccaatactcagaaaaaaaaacgagtaattcatggattcacaacgggcaacaaactagatgactattaggaagagaagagcaaaccttatgatctcaaaatgatttcttgttcatttgcatcctcgcatcaatctagactttaagaaatatgtgatttttaaataaatgggtatatctgaaaaaaaaaaaaaaaatgcgaa

SEQ ID NO: 15658 - DNA, 397 bp, Homo sapiens
attttcycatctttcttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtagagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctcttggaagtggatcaaacta

SEQ ID NO: 15659 - DNA, 697 bp, Homo sapiens
  misc_feature 135: n=a, g, c or t
acatgataaagtcagcacacacaaaaaggcttcttacacatacctgtcttaaaccatgtgtagagctttaaaaacagaaaaaaaaccccatatacttatgaccatcttaaatcaagaaaattgcatatttccatnctggtctttctgggccagatttttatattggttttcagtaaatgtctatctataatatttcattatagagtccagtagcttaatactgacactgacttgatacagcatgaagtttctagtgccacacacagtatttagaaaacctttaggcgtgaatgactcatgtgggatatatgtaaacataatgtttattttatctcacaaatgcatgtgaaatgtataattacatcttaggaatccaaaatggtctgcagagagtgagcggaggcaccagatcaatgttggttctttgcactggtgagattctgcctgatgaatattaaagatatcctgctttctgagaactctatcaccagatggcagttgggatatgggaggaactaaagcatcctgttttgtatctgtccagatcattatttctgtctcttgttttttcttcctggttcaggatacttttttaaggggttgagaattgaagattttccaaaagcgttcatgaatttagagcattccacccaatataataaaacctgttaagaatgtcaaaaaaaaaaaaaaatgc

SEQ ID NO: 15660 - DNA, 215 bp, Homo sapiens
attcctcctaggttattgttgtgggtaatccagccaataccaactgcctgactgcttccaagtcagctccatccatccccaaggagaacttcagttgcttgactcgtttggatcacaaccgagctaaagctcaaattgctcttaaacttggtgtgactgctaatgatgtaaagaatgtcattatctgggggaaaccattcctcgactcagttatc

SEQ ID NO: 15661 - DNA, 308 bp, Homo sapiens
tttgaaaagctcagatacacacgtttaattcactcaacttttccctcttcttctaggtttttttaactccacaagttctccccctcacttcatgagtctacaacctccattggcccaaagtcggctgcaacattggttatggagtataaggcactaacctctgcttggacaagtttctcttaactgcaggggaatgaagatttctagtcctcgacaagaagcctaacagcaacttctacattaagtttccagataaggcttctgagaactataaataaagcatcctaagctgtttcttaaaaaaaaaa

SEQ ID NO: 15662 - DNA, 207 bp, Homo sapiens
acgtgacggagcgccggagcggagggagccggggctgggagttctcctgagggaagaggagtggagtaggggggacgcggcggcggcgttgacaatgagttttcttggaggcttttttggtccaatttgtgagatcgatattgttcttaatgatggggaaaccaggaaaatggcagaaatgaaaactgaagatggcaaagtagaaaa

SEQ ID NO: 15663 - DNA, 207 bp, Homo sapiens
acgtgacggagcgccggagcggagggagccggggctgggagttctcctgagggaagaggagtggagtaggggggacgcggcggcggcgttgacaatgagttttcttggaggcttttttggtccaatttgtgagatcgatattgttcttaatgatggggaaaccaggaaaatggcagaaatgaaaactgaagatggcvaagktgggaa

SEQ ID NO: 15664 - DNA, 210 bp, Homo sapiens
acgtgacggakcgccggagcggagggagccggggctgggagttctcctgagggaagaggagtggagtaggggggacgcggcggcggcgttgacaatgagttttcttggaggcttttttggtccaatttgtgagatcgatattgttcttaatgatggggaaaccaggaaaatggcagaatgaaactgaagrttgcmaarkttaggaaaamc

SEQ ID NO: 15665 - DNA, 482 bp, Homo sapiens
agatctgcaaagtccgtatctccaaataagatcacatttactggcacagggagttagaattttaacatatctttttagggaacacaattcacaccacaacactggcacatgaagagggaataggaagtgtctggatkaatgtgggggagagggtattttcctcctctatagtcacttagacagaaagaatgtcatgaatcaagcccaagggcttgaaatgctccagtgcttctgtagaaaaccagcaatgcctcactcctcactccagcaggatgctttactttccctgtgatgaagaaatggagaaccagagaagttgcatgactwacacaaagtcamatagttgataagtattaggagcagatttggatcacaggttagtctgactatataaagttcatgttcttaaccactgtattcttgcacagcatttaatttgacagaacaaggcaacatgaatcattactctatttttctctata

SEQ ID NO: 15666 - DNA, 491 bp, Homo sapiens
ataataagagtccagtagcttaatactgacactgacttgatacagcatgaagtttctagtgccacacacagtatttagaaaacctttaggcgtgaatgactcatgtgggatatatgtaaacataatgtttattttatctcacaaatgcatgtgaaatgtataattacatcttaggaatccaaaatggtctgcagagagtgagcggaggcaccagatcaatgttggttctttgcactggtgagattctgcctgatgaatattaaagatatcctgctttctgagaactctatcaccagatggcagttgggatatgggaggaactaaagcatcctgttttgtatctgtccagatcattatttctgtctcttgttttttcttcctggttcaggatacttttttaaggggttgagaattgaagattttccaaaagcgttcatgaatttagagcattccacccaatataataaaacctgttaagaatgtcaaaaaaa

SEQ ID NO: 15667 - DNA, 324 bp, Homo sapiens
  misc_feature 27,35: n=a, g, c or t
agaactacttccgggggagcggcgcgncggcgggngaggatctctcaccccgtcactcagggtggcgcaatcacgactcattggctcactgcagcctagacctcccagctggagcaattctcctgcctcagccttctgagtagctgggactacagttggttctaaagagtggtgagtcagaagagacgtcaggcagcaagcgacttgggccatggctctgacctagacttctcacctccggagtgcccgagcccactttcctggagaacctgctacggtacgactcttcctgggagccatcttccagctcatctgtgtgctggc

SEQ ID NO: 15668 - DNA, 374 bp, Homo sapiens
  misc_feature 25,84: n=a, g, c or t
aactacttccgggggagcggcgcgncggcggggadkaagtcaaatccttcctgggaggatgaagatctgccagctctgaggagndggctgggaagaaaaagagcctcaagctttgaagcccattcccatggtagacagagctgatgtgaaaagtggccatcctgttgccccaggcacatgaccttctgaagtgaccaggctgaaagggaagcaatactcgtgtgatctctcaccccgtcactcagggtggcgcaatcacgactcattggctcactgcagcctagacctcccagctggagcaattctcctggctcagccttctgagtagctgggactacagttggktctaaagagtggtgagtcagaagagacgk

SEQ ID NO: 15669 - DNA, 234 bp, Homo sapiens
agaactacttccgggggagcggcgcggcggcgcgggaggatctctcaccccgtcactcagggtggcgcaatcacgactcattggctcactgcagcctagacctcccagctggagcaattctcctgcctcagccttctgagtagctgggactacagttggttctaaagagtggtgagtcagaagagacgtcaggcagcaagcgacttgggccatggcctctgacctagacttctm

SEQ ID NO: 15670 - DNA, 464 bp, Homo sapiens
  misc_feature 221..223: n=a, g, c or t
acctcggatgccgtcccgctggccgaaagcaaccaacacacgctcatcgcgtasttgagcagcagatccagcggataactgaaagttttctcagcctcagcccgtggcgcgtastgtccaactggtaaatcaagccgccagctttgttcaccacatacacactaaaaatcgccatcgctgccttgccgctcggaaactggtattcagcctctacccgacrnnncctccccggaaccgcatcacagcacttgccgccgdhvccaccccagcctcctcctcctcctcctcctcctcccgcgccccccgtgcagccacctgctgcacttgcgcactgggagcgacacgctcgggcataagtagtgccggaaagttagctgccgagacctggtggattggcttttcgtttatcagtgcaggaaaacaggcgctatagtactgcgtcacaactagcgcagactccggaa

SEQ ID NO: 15671 - DNA, 227 bp, Homo sapiens
  misc_feature 58,221: n=a, g, c or t
acctcggatgccgtcccgctggccgaaagcaaccaacacacgctcatcgcgtmsttgnagcagcagatccagcggataactgarattttctcagcctcagcccgtgggcgtagtgtccaactggtaaatmaagccgccagctttgttcaccacatacacactawaaaybgccatcgctgccttgcsgctcggaaaactggtaatcagcctctacccgtcknkcycct

SEQ ID NO: 15672 - DNA, 300 bp, Homo sapiens
cattatagagtccagtagcttaatactgacactgacttgatacagcatgaagtttctagtgccacacacagtatttagaaaacctttaggcgtgaatgactcatgtgggatatatgtaaacataatgtttattttatctcacaaatgcatgtgaaatgtataattacatcttaggaatccaaaatggtctgcagagagtgagcggaggcaccagatcaakgtkggtccttksmackgkkraratyckscykrwkratwttwaaggwaaycctgctttctgagaactctatcaccagatgg

SEQ ID NO: 15673 - DNA, 560 bp, Homo sapiens
aattgggtatcgcactactggaaggggcggcgctgccatgacagagaaggcaataaaactgaaggcctagctcgactaaaagcgcttactattaaggaagacttcgctgtggctccatccggcacgaaagctaaaccgtgtaatggctggcaaccaggaagctagactacctagaatccggaggattggagggactggccggcgtgggcccctgagatctcctactacatgtcttcagttttatccatagacacggaaggacactaaaattgcctggtgccatttcctgtgaaacaagtctagataagagaagggacttgcccaaggtcacatagccgagaaataaagccgagggcagtaggagaaatgatctgactttccgaaccacccccaagcctagggcccttatcaccacacctttcatggaagtgaaaatcctgctcttgtgctctttaacccttaatgaagtttataggtcccagcaaagaaaatggatgtaagaactgggcttttttccccctctaaatgatagtaaagggcctaatgcagtgagatgtgtc

SEQ ID NO: 15674 - DNA, 493 bp, Homo sapiens
gtcttgggtggatcttgccctagtatcaatatagaacctgaaatgtgtagaaagtcctcttaggattatttttcaatagttttcattgatatgctttgtacagtgatttggacctttactggttatcatgaggatcaagaccaaaggggacatgaaaaacaaattgaagagcaaacctcaaaggcataatacaaaactgaagttcctgagattagatgtcaatgcaggtaccatcccttagattggtcctagaagttctaaggaaaggcaaaagaattaaaaaatgatcaggagatcacctgaaagaacatcaacctacattgagctgtaatgataaattgaaatataaaagctaaattgagaatgtcagagccaaattatctaagacatgataataacccagaccattgactctaaagcaaggaattatagatggatatagaagtagcaaatttaagaaaatgaaaatggcaacattagcatgtgttattgt

SEQ ID NO: 15675 - DNA, 505 bp, Homo sapiens
atagaaacccttgcctgggctccgaggtacaggcctggagctaggggacgaggactgttctcctccatggtccggaagtcttcccaggctccccctctgagcttgatggctcggcggtggatttgggctgcggcgggagattaagctagaggagcccgctagtgccaaagtcaaataaagacccggcggaggagcttcggcctgattttgttgatttgtcttcagcctggtctttgtatcagattgagactggaacacaagaagtgtttgtttaatgaatgacgtacacatttaagatctgtttggacgcggaggataatcctgtgaattgctaatagttcactgggtttggcccttagtgttgacttcagtatgctgagacggaaaccaacacgcctagagctaaagcttgatgacattgaagagtttgagaacattcgaaaggacctggaggtgcacccattcctgcagttcaaagcctggcaagactcaccatcatcttcct

SEQ ID NO: 15676 - DNA, 537 bp, Homo sapiens
atgatggaagtcgtagtaggaaatggcgtcgtggcattgaggggcatccctcctagaacctccaggaaaagctcgcggaagacgaggttctgcggagagagaggctccaagcagtctgggaagtgtagtccagttggcttagcagtagtttcgttgggggggagccgrggttccgggaaggggctaggccggcttgaaaagagattatgactgtaccttttaactytgtagctggaacacaagaagtgtttgtttaatgaatgacgtacacatttaagatctgtttggacgcggaggataatcctgtgaattgctaatagttcactgggtttggcccttagtgttgacttcagtatgctgagacggaaaccaacacgcctagagctaaagcttgatgacattgaagagtttgagaacattcgaaaggacctggagctgaagaggaagtatcctgtaccggcccctgctgctactgcaatgcagaggtacccgttgtaggtcatgaagatgagcatgaggaagtagcttatgaccacc

SEQ ID NO: 15677 - DNA, 163 bp, Homo sapiens
aaccagaatctttcccaacttgtctaagtcctctcaggccagccttggtgggaggtttctaggattcgctccctgcccttcccatcttagggtgtcgtctgagacagactcttattccctcaataaagagagagactcttattccctcagcggccastcctcg

SEQ ID NO: 15678 - DNA, 402 bp, Homo sapiens
  misc_feature 248: n=a, g, c or t
aaccagaatctttcccaacttgtctaagtcctctcaggccagccttggtgggaggtttctaggattcgctccctgcccttcccatcttagggtgtcgtctgagacagactcttattccctcaataaagagagagactcttattccctcagcggccagctcctcgcctcccctcggccgtaaccacctcagtggtcaccgtcttcaccgtggtcgcctcagcccgctcgccaccccagttgaggcgctnctggtgtcatgtctgccacaggggaccgacacccgacccaaggggaccaggaggccccggtaagccaggagggagcacaggccgaggcggcsggagctggtaaccaggagggcggcgactccagccccgrcagcagcgacgtggtgcctgcggc

SEQ ID NO: 15679 - DNA, 470 bp, Homo sapiens
tggtttacataattttgggccccagatggttaagtgctaaatttgtagggtaggctatcaggaagtgcaggctggaaacatgcaggagctgtccctgaagtccacaagtggaatttgttasttcatcatggaaacctcagttttgttcatacacctaaatacttcagtatgtctttcctaaaataaaaggcatccatttamctwaccargkttamcggwttggkgaaaatttcaactgttgttaaagcgactgatgggatcagtttcacctagattatctaaagcagtctcctttacataaagtcaatgaattgtaaatattggttgcatgtacacaattccttcaccacaacacctaagattagkatttgattgagttactgggtgctacaacctagccaagttgagtcataaaactgaccatctctggaggtgtactctgcagtaaaaagctagctgaggcattattc

SEQ ID NO: 15680 - DNA, 532 bp, Homo sapiens
gccgggaacccgcgttggcgtggttgactagtgcctcgcagcctcagcatgggggaacatggcctggagctggcttccatgatccccgccctgcgragctgggcagtgccacaccagaggaatataatacagttgtacagaagccaagacaaattctgtgtcaattcattgaccggatacttacagatgtaaatgttgttgctgtagaacttgtaaagaaaactgactctcagccaacctccgtgatgttgcttgatttcatccagcatatcatgaaatcctccccacttatgtttgtaaatgtgagtggaagccatgaggccaaaggcagttgtattggtaagtgctgttattcatgcattcacttgccatctgttctataaaatcctccttttactgctcttctgaaatattacatgtacaggattatacttttttgggtcagctttgctataaattgaaggagcaaaatggtaatggttatttttccttcacatatccttattgttttctttttagtattgtatactag

SEQ ID NO: 15681 - DNA, 471 bp, Homo sapiens
aattagtttagcatcaaagcctacgtcttttgtgatctaaataaaattatttttattactctgtttctctaaatctgcattataaaaagctaattttcctttttattttagggtggaattgcgtttgttgccataaaaggagcatttaaagtttacttcaaacagcagcaatatttacgacaggcacaccgcaaaattctgaattatccagaacaagaagaagcataaaactgacttctggttgttctgcagttctctcatccttatgaatctgttgtgttgttttgattccatcattaatgcacttgtggagacttgtgataagctgctgctcctatattttttaagaaatataataaagcacttagggcaggggaaatcatctcggtaatcatggaacctaaggatgtgatttgttttcattgtttgtatgtactacttttatggcagtcatatgaaccattatcttag

SEQ ID NO: 15682 - DNA, 122 bp, Homo sapiens
agtaggacctgcctttcagtaactttcagaggcatggggagcccttccctgaaagagaggagaaggtgacatcttagaaactgtgataaaatgatctcaggacccaaaaaaaaaaaaaaaaa

SEQ ID NO: 15683 - DNA, 489 bp, Homo sapiens
tttaaaagatagacatggtgccatgaagttggggagttgggtgaattatcccattctagttacagaggagctttccttaaatgccctttaacttctaggtttagttcaagaagttcattttctgagtaaaagttattttcatatatgttgggggaaaattaactcatctaaaaagaatcttattaggtatttgaactctaaaactaacagataagacagatatgtaccttattagagcaccagaactaatttgctaagtcttttgtttagtcctgcaagactgatgcttaatacacagtctgttctcctgtgtctaggtcaggaactccagtttgcttttctgttttgtgtcctggtagcagctgttgagtaactttcattggaggttgggaaggaagtgaggagaaagtgttcttgtttagtgttttatttcctataataggatgctgcctaacccagttcatctctatgtcctgttcactgaatatt

SEQ ID NO: 15684 - DNA, 475 bp, Homo sapiens
atcttttagtggttttcatttgacttcatgttgattttcttaattttttcgtttaatatttagtaagagtctgatattgagttttactgcactttaaagcatttcggatgttaattaaaatcttgactctagtagcacattcagtcgggtcaagcgtcactatttgacataaatggagacatctggctgtcacccaagtttgataagctgaatacccatgcagatgaggcagccgtgctagaaacaccactctattacgcctagtggcatttccctacccatattgttacaatggtgctcatgtcctatgaatttttttttcagggctgctattatttgagaagctgtgatattttaagtcacggatacgatgtgcatcactaggctcacgtggcaatgggatgatgccttagtgtcttagcccgtctgactgtcactaacactttctctccctttctcatagtttctactggag

SEQ ID NO: 15685 - DNA, 532 bp, Homo sapiens
caaggccaggctggtctcgaactccttacctcaggtgatccacccatattggccctcccaaagtgctgagattacagggtgtggagccaccatgccctggcctcaatcttttcttttaaacaattattcctatattttattgtaatgcagtttaaccgtgtttgtcagattcaatactctgtgaccccgttaaccaagtctctgtatgtttawtacygggaatttcaaagtggccgtgaccgttttcttaaatatactttatttgtttagtgcaattttaggttcacagtaaaactgagcagagggtacagagagttctcatttactccctgtccccacacatgcacagcctcccttatcaccaacactgggcaccagagtggtcatttgttacaactgatggaccttcattgacacgtcactatcaccagagtccatagtttacattagggttcactcttggggtggtacatttctataggtttggatgtattttcagtgacatgcatctaccattatagtatcatacaga

SEQ ID NO: 15686 - DNA, 471 bp, Homo sapiens
caaggccaggctggtctcgaactccttacctcaggtgatccacccatattggcctcccaaagtgctgagattacaggtgtgagccaccatgcctggcctcaatcttttcttttaaacaattattcctatattttattgtaatgcagttaaccgtgtttgtcagattcaatactctgtgacccgttaaccaagtctctgtatgtttattactgcaattcaagtggccgtgaccgttttcttaaatatactttattdrtttagtgcaattttaggttcacagtaaaactgagcagagggtacagagagttctcatttactccctgtccccacacatgcacagcctcccttatcaccaacactgggcaccagagtggtcatttgttacaactgatggaccttcattgacacgtcactatcaccagagtccatagtttacattagggttcactcttggggtggtacattctatag

SEQ ID NO: 15687 - DNA, 428 bp, Homo sapiens
gtcgttgccatggatcctggggacgactggctggtggaatccttgcgcttgtaccaggatttctatgcattcgacctgtcaggagccactcgagtccttgaatggattgatgacaaaggagtctttgttgctggctatgaaagcctgaaaaagaatgaaattcttcatctgaaattacctctcagactttctgtaaaggaaaacaagggcttattcccagaaagagatttcaaagtgcgccatggaggattttcagacaggtctatctttgatctaaagcatgtgccacataccagattgctggttaccagtggccttccaggttgttatctgcaggtgtggcaggttgcagaggacagtgatgtcattaaagctgtcagcaccattgctgtgcatgagaaagaggagagtctctggcctagggtggc

SEQ ID NO: 15688 - DNA, 438 bp, Homo sapiens
caagatagctgacgtaccagacatgaagacgagatggtgagtgtgtctcacggtgagctccggtggcccaagtggctgtgtggccattatatgaaggtcattcttcaggctgtccccatgaaacctgagggcttccctgagcctctgtgagccttctcttcaaccaaaactgaggaatagataattagctggttgagatctttgcttttgttgttttacattgaaagtcacccatatactcgaattactgattctacaattttttggccactcaaagcaaataaaaacataagacgttggctgggcgcggtggctcatgcctgtaatcccagcactttgggaggccgagacgggcagatgacaaggtcaggagattgagaccatcctggttaacatggtgaaacccgtctctactaacaatacaaaaaaaaaaaaaaa

SEQ ID NO: 15689 - DNA, 349 bp, Homo sapiens
aaattcaagtaataagaaagcaaagaagagtttggccaaatcctctagtcgctctcatagctgaaggcacccaccggggccacttctgtccccagcgtcttctcgggtcgtgcagccatggccatgcagaaaatctttgcccgggaaatcttggactccaggggcaaccccacggtggaggtggacctgcacacggccaagggcatttccgagcagctgtgcccagtggggcttccacgggtatctatgaggctctggaactaagagacggagacaaaggccgctacctggggaaaggagtcctgaaggctgtggagaacatcaacagtactctgggccctgctctgct

SEQ ID NO: 15690 - DNA, 438 bp, Homo sapiens
aaccatccattggtcttcaccagtagttctgcagtggggatctgcacttctgggcttcagcacacatcagtgtggttcacgtgtttcctgctgttatgaaagagattggagaggactaagcttggaattgcctgtcccacagcaagaggctatggagctgggccacggagcagggcccatctgaatgacaaggagggccaacaggacttggacccctggaaagcggcctacagttccttggacacctccaagttcaagaaccagggtctgtcatccccacagcccctgcccctgggagccagcgctcaaggcagctccctagggcagtgccacttgaaggagattccccctccacccccgactgctgccagcagggattctctgggcatggacccacagtccaggtccctgaagaatgcgggctctcgatcctcctcg

SEQ ID NO: 15691 - DNA, 497 bp, Homo sapiens
agtctgtagatgagggtgttttgagcctgggactgaaggtgccacaagcagtgtctatttcctagtctgtcttcactttccactccctataccagcctgatgcctcggctctctccttcacaactgtatggtcacctgtcctcagaaaactgagtgctttggcacaggggtcacctcataagaaggggtggataggccggagaacctccactaactctcccactagttttggtaatatacctgagaaacacacatgaatttagggagggcggagtctggttatggcttggaaatggagatctttgatgttttaggcaatgggtgattggtaacagaggtgcaggaaggggaccatggctgatgtggtagggtgatagggagaggccaaggtggttgtacgtatctggtctgtgtggcctcaagcttgcagatgggttgggactgtaaatgctaccttccatggaggcacattcatgctcagggagatgaatgcctgc

SEQ ID NO: 15692 - DNA, 386 bp, Homo sapiens
ctagtcgttttcaaagcgcctcgstgatttctcacgggcccggctgccggcccccgctctgccctggattggtagcttatgtcgatcttgatgaaagagcaattgatgctctcagggaatttaatgaagaaggagctctgtctgtactacagcagttcaaggaaagtgacttatcacatgttcagaacaaaagtgcatttttatgtggagttatgaagacctacaggcagagagagaaacaggggagcaaggtgcaagagtccacaaagggacctgatgaagcgaagatcaaggtaaaagttttgtttgtgagaaacttggctactacggtgacagaagaaatattggaaaagtcattttctgaatttggaaaactcgaaagagta

SEQ ID NO: 15693 - DNA, 587 bp, Homo sapiens
ctttttccaggcggtatcctttgtgcatgcctactgtacattttcgacctctttccgatggaatgatctaagatgaaagtaaactttttaaatgtttaatcattcaccactaggcaaaccgtcataagcattacagttcgcattatttctgtagtgtctcttatgtaaaaatgctttcatttctgatcttgcaatgaagtgctgtactaactcgcattatgcatattagaaaactgataagtgatttgtccgacattattctgttaattagcgatgagccagtattgcacagcttgttttacgtaattttagatagctgcttgtaaccacttagattatatagaaattaagacatagaaacttttatcagaattaccagaaatagtagccttttgctattagcttcatgtagagatttacctgagtaaagtaccaaagaagttatctgaggtattgttgaaggatgatacagaatatattttctaaaaatcacgctgatttatgacacattactctgaaatacacatctcaagtccttaaaagaatatatgacaactgtaagaagccattttagataagtaatttga

SEQ ID NO: 15694 - DNA, 201 bp, Homo sapiens
aataatctccgctcccagactactccgttcctccggatttcgatccccctttttctatctgtcaatcagcgccgcctttgaactgaaaagctctcagtctaacttcaactcactcaaatccgagcggcacgagcacctcctgtatcttcggcttccccccccctttgctctttatatctgacttcttgttgttgttggtgt

SEQ ID NO: 15695 - DNA, 296 bp, Homo sapiens
atgttctgsttccaccgttgtcctactttggatagcatcaagacaaaaatctcagtcttcgaggaactcacagtgtagcagaaaagacaaaggaggtaaacaggaggagcatgaataattcatcttgatgtaatcatgcargactcctaagaagatgttaggagaccctgtcatcattcttttggcctctaatgtccgttatcttcatgtttgctggcttccttttastactatggaaatasaacatatgcaaaagtagtgttttcgctgtttaaaaacatcgtcagsagcatcat

SEQ ID NO: 15696 - DNA, 525 bp, Homo sapiens
atkttctgcttccaccgttgtcctactttggatagcatcaagacaaaaatctcagtcttcgaggaactcacagtgtagcagaaaagacaaaggaggtaaacaggaggagcatgaataattcatcttgatgtaatcatgcaagactcctaagaagatgttaggagaccctgtcatcattcttttggcctctaatgtccgttatcttcatgtttgctggcttccttttactactatggaaatacaacatatgcaaaagtagtgttttcgctgtttaaaaacatcgtcagcagcatcatcatcattaactgcaccaggaagccatgactcctttctggacaaggtgcacttgcctgtcatccttccatctctttcttcctccttgaagttcacaatacccagtccaggagcattgcagagaatgctaggtgtgtctgcagacttgactttaaaagaaaacaagttccttcaagtgagttcatcatgatggggatgatatttgtttgagagaatgtgtgtctttggcaa

SEQ ID NO: 15697 - DNA, 466 bp, Homo sapiens
tactaagtatttcttctaatcttctttaccagtgcctgaaaactaaaaacaacattctggcttcagaacaactcatcctaacaaggtatagtatttcagtgctgactgataggacaagttagcacgtctaaacgactcaagaaggtcatggggtcaggcacggtggtctgtggtcccagctactcaggaggctgaagcaggaagatcgcttgatcccaggaatttgagtctagccttggcaacacagtgagaccctgtctctaaaaaattaattaatttataaaaaagtaaatcatggggatctttttccaagaagggtgggtctatcattctgtaaaggtcccattcagccctatttctgcttcaggttctttctccttcactccctttcaatccaaccctataaattagactagaaaacaaagatgctgacaaacaccaaatggtataatctgaggcacctttt

SEQ ID NO: 15698 - DNA, 284 bp, Homo sapiens
tcatgaaccgatctttttagttgagtcagtaggaaaattaatacagtggataaagtaagaagcaaaagacagggacagagaagtgttgtgtttaaaacccaagcctgtctaaggttactgtgtattagacagggccgaactagtgtgctgagcaaaaagaattgaagcaaattgtatttacttagccgcttctgggagccacttcagcctttcccctcccctccacttcttgggtaatctgacctgaagcatagtccaggagcagagttagccagaaatgcctc

SEQ ID NO: 15699 - DNA, 464 bp, Homo sapiens
  misc_feature 415: n=a, g, c or t
aaaataaaagctctcctgatggcctgttcctgcacatttcctgaggacgccctcgatcacaagcagcttgctggatgaataaaggaaagaaggtttatatacactaataatagaaatgttttgggatggttcatgatttcgaaaagcttcagagaaaataaagatgcttaatgttagagtacaaaacatgttctccctgcagtctcacgaactgtgaacaaaaactgaagtgaaaactcatagtgcataactcgtcaatactcctgtgatcgtataaccatcagcaagaaaacaaatttgattgagcccccatccagtcctctttgcgtggaatcagacctcttttgcagtggaaaggagcaggtaaaacaaataagcagaggcacaaaaatcatcaccaaaccagactcactgnatgccaacactggcatgtgcgcagacattttctattctggacttacttc

SEQ ID NO: 15700 - DNA, 372 bp, Homo sapiens
  misc_feature 351: n=a, g, c or t
attactagaacatctaatygrrramytgttttctkraktwrtctgtgctggaggtctgctcagacgaaggtctccatggcgttagaagtcttgatgctcctcctgtcttgatttggaccggtgctgagaacctccatgtgaaaataagttgctctctggactggttgatggtctcagttatcccagttgcagaaagcagaaatctgtatatatttgcggatgaattacatctgggaatgggctgccctgcaaatcggatacatacatatgtatatgagtttatatatcttgttcgtgattgtrgcatcagaacaagggtagtttctgaggaaactctcctttttcaaaccngagctgtactttaccccaagg

SEQ ID NO: 15701 - DNA, 118 bp, Homo sapiens
aaataaaagctctcctgatggcctgttcctgcacatttcctgatgacgccctcgatcacaakcaggttataktacaaaacatkttttccctgsawtctcacgaactgtgaacaaaaac

SEQ ID NO: 15702 - DNA, 502 bp, Homo sapiens
agtatgcaactggctaaacagtggagaaagcttggttgttactgtgccccatctctcctctagggtagccaacaagatgtaagcagaagtcttatggtgtggcttctgggaaacctctccaaagcatcctgaatctcaacaggaatttctgattaaatgaatacaagaaggaagagagactggcacaaaatagagagaataaccagttataaagagaaatgagatttatgaccaaggcaagagaggagagtttcaagaataaagaaataagagagctaatagaagtctaggaaggactgagagaagacctctggaaaactgatcttcagagaatgatctttgcaggaaatctctgttacctgaagatgaaaaggaatgtgaaccaactctgatccmawttcagaccttcgccaactgacagttcaggtgaaggccctctggggtgaccagaaagcaagaaaagatgagtatattattgctgaacagttctctttcagaaaaa

SEQ ID NO: 15703 - DNA, 482 bp, Homo sapiens
ccataaaggagaaagccaggttataggagaaagagagagaaaggcgcatgtctgtttgcacagagagaggcaattttgtctacctttcgagaatcagttataaacagaagggcctcttaggattttgagctctcctgacaatgaaggaaaagctctcttgagtatacaagttccacactcattacctttcagtggtgacccatcacccactacaatttgttgaaggaagggagtgtcagagatatgctttaaagttgtactttaggctgaaattctctctgtatttggacctgcagatgttgtgtacagaaccgatgcatggcagggtcaggaaactaggagagtgaaggcgcttgtggagacagctctgtagcaaatgaaacacggaagcctccgggaatgtgtttgtgtcaccagcagcaggcatttccctgtcctccccacccccagtctccacatccccagcagcctcttccagaagc

SEQ ID NO: 15704 - DNA, 503 bp, Homo sapiens
agattaagagagtcaccagggttcccttgtaacatttctcatcaaagagtgttctatagggaagagataaaacctaaacagtcccggaagctgagacaagaaactgaaaaaaaaaaaggaaagtgagcaacaagataatgtaagtcacaactgagccaattaaggagcaggagatgcagcagcatgtcccaaacaaaactgattggaggtcaagtgtggacaaccagagcaagttcttgcacagctaatgtatccccaggtgtgaactgagtaacatgaagaaaggcatcctcctgccacctcctgaatcagtagaaaaagacaaaagcttttgatgggattatgctggagtccatgtcatggaaccaaactggaaattttctggcatgattttaggcgttttgcatgaactctaattcattgaaatgtaacaaccttataaggtccctgcaggacatgtcacccaaaataatgcatcagatataaggacttgtcttttactc

SEQ ID NO: 15705 - DNA, 503 bp, Homo sapiens
agwtsyrswwkwagatctgctttttaagtgaaacgaacatgccacccctccgagggctgcggcttccccgggcttgcttctttgccgctcctctttccggctctcgcgctcactctttaattggcactggcccctaagtttgccaggagctcgctgcccgcycsgrscrgggkccssgssgggrgscgskggkksgggsrgssrgtccssgrrmcssaakycagmarcgtcktkggcmwtgwatattyywtcaaacsgactttkggtgcgkcsckyctyactgccwtcagtgcyatktscrrtkacatttctgrmttgagtgraggaawgcssgamggaaacccgggcgraattkgtwttwgrggatcttcytggcgscmmtgmtwwwtgyccykwytkaykmmsctymwsryywwsmtcwrmrwywwmatswgaaataaaatgaaagcggtgccaagcggcatagaaccgcctggccgctggkkmysaksccggggaccagg

SEQ ID NO: 15706 - DNA, 401 bp, Homo sapiens
  misc_feature 24,45: n=a, g, c or t
agatctgctttttaagtgaamkancatgccacccctccgagggsngcggcttccccgggcttgcttctttgccgctcctctttccggctctcgcgctcactctttaattggcactggcccctaagtttgccaggagctcgctgcccgctcggagcagggtccggccgggagccgctggtgggggcggggagtccgggagccgcaatccagaagcgtcgtgggccatgtatatttcatcaaacggactttgggtgcgtcgcgtctcactgccatcaggtgctatgtgcagtgacatttctgacttgagtggaggaatgcgcgaaggaaacccgggcgaaattggtattagaggatcttcttggcgccaatgctaattgtcctgatttatgcccttctgacta

SEQ ID NO: 15707 - DNA, 211 bp, Homo sapiens
agcgcacgacgtgcgcgcaccctstcccctcgwccaccgytgccgyctycttcttctgccgytcctggtgctgcttgwgtgctcgtttggygcggacctggtacctctttkgtgaagcggyagctgaggagactccggcgctcgccatggccgacgaaaagcccaaggaaggagkcaagacttagaacaacgatcatattaatttgaaggw

SEQ ID NO: 15708 - DNA, 62 bp, Homo sapiens
cttcttctgcsgctcctggtgctgcttgtgtgctcgtttkgtgcggacctggtacctctttt

SEQ ID NO: 15709 - DNA, 283 bp, Homo sapiens
tatcagtgatggctcttctctggaagatcttgtggtcaagagcaatctgaatccaaatgcaaaggagtttgttcctggggtgaagtacggaaatatttgagtagacggggccctcttttggtggatgtagcacaatttccacactgtgaaggcagtattagaagacttaattgtaaaagctctcttgtcactgtgttacacttatgcattgccaaagtttttgttagtcttgcatgcttaataaaagtgctgagactgttactaagcaaaaaaaaaaaaaaaa

SEQ ID NO: 15710 - DNA, 328 bp, Homo sapiens
acacctctcggtgcagattgcaaagcgccttccgttgcgagagctgcagattttgcaagagccaggctcgcccaccttgtagraaggagcgccttgagtcccctctcaccctcggttgcaaagagccgaccgcttgatctggacaccccctcgcccagattgcatgatctcccgggaccctcttgagttgcacgtttctgcaccgaggacctcaaatccccgtcgctcctaggatttgcagcgttctggatactggagggttgcaggctacactcgsscgcccctgggcagasastcgtccaaaccactggagtgtgctggtgactgg

SEQ ID NO: 15711 - DNA, 458 bp, Homo sapiens
actttcttttcttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggagttcacaacctctgtggtccgtagagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtraaaaaaaaaaaaaaaaaaa

SEQ ID NO: 15712 - DNA, 497 bp, Homo sapiens
aattgatttgctgacaagagtgagtgacagtgtcagaccacagccgccttccctcacacagcctgtctgcctgtgccctgttcagccctcagggaagtctctctgttggtggcttttcatggtgcctccacctctcacctgcggctcctgtaataatgttaatgttcctctgcctgaaatgtaatgatggtcattaggtaccagcacatcacagccccagacagtgtccctggaggctggcatttttcagcagtgttaaaaatctccactcgataagtttgcatggtgctgtatgttcacagctcttagacctagactctagaagtcagctggtgactttcttctagggtttattctctcctggtggcaggtgagcccagtgatgctccattgtcatgggagtgttgggtagggggtggttgtgggagtgagagattaacaggagcattaaatgatggagttttgttttctcctcacgctctggtccctgctagact

SEQ ID NO: 15713 - DNA, 150 bp, Homo sapiens
tataattttcactaatgtggttattttatattaagcctacaacatttttcagtttgcaaatagaactaatactggtgaaaatttacctaaaaccttggttatcaaatacatctccagtacattccgttcttttttttttttttttttttt

SEQ ID NO: 15714 - DNA, 489 bp, Homo sapiens
tataaaatgaaagctgcctctgaagcactgcagactcagctgagcactgatacaaagaaagacaaacatcgtaagaagcaatagtttctctkackaatcctgagagccttatcattctacatcccatcttcctgtgagattgtctttgtagcatttaactctaattgcagttctcattttaaaaattggcttgcttattgtatattttccccaactaaagcgtgaactcctagcagggcgtggtggctcatgcctgtaatctcagcactgtggaaggccgaggtgggtcgactacctgaggttaggagttcgagaccagcctgaccaacataatgaaacgctgtctctactaaaaatacaaaaattagctaggcgtggtggctgggacctgtaatcccagctacttgggaggctgaggcaggagaatcacttgaaccctggaggtggaggttgcagtgagcagagatctcaccattacactccagcctg

SEQ ID NO: 15715 - DNA, 456 bp, Homo sapiens
atttttccgatgccaggcaccctcaaggcacagaggctggggctcatgttgggggcacttggcctctccaggcctcgaaggcttctcctgggctgatgcgagctggggaacgggagggacggacgtgggagcgagaacgtcacactggaggcagctggtggcacgatgggggacagagtgaaagagtagcaagtcaagagccttcgtgtcaccatggccacacaccccgatggcttccggcttgagggacccctggctgcagcccacagccctgggccttgcactgtgctctacgaaggccctgtccgtgggctctgccytttgccccgcgaaattccaacaccatggcggcggctgccctggctgcccccagcctgggcttcgatggggtgattsgggtgctcgtggctgataccagcctcacggacatgcacgtggtggatgtagagctgagcg

SEQ ID NO: 15716 - DNA, 222 bp, Homo sapiens
attttttccgatgccaggcaccctcaaggcacrgaggctggggctcatgttgggggcacttggcctctccaggcctcgaaggcttctcctgggctgatgcgagctggggaacgggagggacggacgtgggagcgagaacgtcacactggaggcagctggtggcacgatgggggacagagtgaaagcctcacggacatgcacgtggtggatgtagagctgagc

SEQ ID NO: 15717 - DNA, 409 bp, Homo sapiens
ggcctccaaggggcgggcagaagttggaaacatgcggctgtcggtcgctgcagcgatctcccatggccgcgtatttcgccgtatgggcctcggtcccgagtcccgcatccatctgttgcggaacttgctcacagggctggtgcggcacgaacgcatcgaggcaccatgggcgcgtgtggacgaaatgaggggctacgcggagaaggtgaggagcgcggccctcttgtccactctgcgggtctggtctgagggggcggasggctgcaagtggaaagggaccgggaccaacctggtaaaccattccccaagtctgagtcccccagaaccttgggctgaacccgcccctccatcgcctctaatggaagactggttagggctgcggagttaggggtggcgtagattggagatg

SEQ ID NO: 15718 - DNA, 551 bp, Homo sapiens
atatggatagttcctgatttcattcaattttcagtatacaacatacatgtatcacattttatatattatagtatgttgcctctttatcaatgacaatttgctgtatttagctagcttagccttgggaacacagggctgaggaacagtgaattactggtacagtaacatttctcataggagtctgaactttcttgggaatcaggagctgtgtatttggcatgttaagttggagatgtctactagacattcagaaagagctatcagatacaatgtgggacatgtgagcatgatgcagtcaggagctagagacgtatctcagttcaccatcagcatctaggtggtatttaacttcacaggacagcatgcaggcaccaagagagtggacgcacatacagaagacagccatgcactgagctggggacatgcaacaataacaggtaagaagatcagggccgggcatggtggttcacgcctgtaatcccagcagtttgggaggccgacgcgggcggatcacgaggtcaggagagtcagaccatcctagctaacacagt

SEQ ID NO: 15719 - DNA, 493 bp, Homo sapiens
attttggccttgtggcagcacatcctcacacccaaagaagtttgtaaatgttccagaacaacctagagaacacctgagtactaagcagcagttttgcaaggatgggagactgggatagcttcccatcacagaactgtgttccatcaaaaagacactaagggatttccttctgggcctcagttctatttgtaagatggagaataatcctctctgtgaactccttgcaaagatgatatgaggctaagagaatatcaagtccccaggtctggaagaaaagtagaaaagagtagtactattgtccaatgtcatgaaagtggtaaaagtgggaaccagtgtgctttgaaaccaaattagaaacacattccttgggaaggcaaagttttctgggacttgatcatacattttatatggttgggacttctctcttcgggagatgatatcttgtttaaggagacctcttttcagttcatcaagttcatcagatatttgagtg

SEQ ID NO: 15720 - DNA, 178 bp, Homo sapiens
actccttcctgcgagccctgaggaagccttgtgagtgcattggctggggcttggagggaagttgggctggagctggacaggagcagtgggtgcatttcaggcaggctctcctgaggtcccaggcgccasctccagctccctggctagggaaamccamcctctcagtcagcatgggggg

SEQ ID NO: 15721 - DNA, 420 bp, Homo sapiens
ataaaggagagaagtttaattgactcaccgttcagcagggctggggaggcctcagggaacttaccatcatggcagaaggtgaaggggaagcgaggcaccttcttcacaatgcagcaggaaggaaaatgaactcagaaggaactaccaaacacttaaaaaaccatcagatatcctgagaactcactcattaccatgacaacagcatggggggaaactgccgtcatgattcagttacttccacctggtttctcccatgatatgtgggcattatggggattacaacttaaggtttctggcattcttcaaagttgtgaaacaagacatattatctgtgtggatctcctacatagtggaaagttggacaaaaatgtagagaagtaaataaataaatggctatgaaagtaaaaaaaaaaaaaaatg

SEQ ID NO: 15722 - DNA, 410 bp, Homo sapiens
  misc_feature 351: n=a, g, c or t
aaaagggtgggagcgtccgggggcccatctctctcgggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacagcaaggacggcggggcctgggggaccgagcagcgggaggctgtctttcccttccagcctggaagtgttgcagaggtgtgcatcaccttcgaccaggccaacctgaccgtcaagctgccagatggatacgaattcaanttccccaaccgcctcaacctggaggccatcaactacatggcagctgacggtgacttcaa

SEQ ID NO: 15723 - DNA, 331 bp, Homo sapiens
  misc_feature 9: n=a, g, c or t
ttacctagnacatcctaatcgaaaaatctctctcgggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagtgagttcttccagcaaggtgcgttcatgggatactgagtgacagattagtcggtcagtggggctggagctggccgaggtggcctcatgcccamccgttaacccccagcttcgtgctgaacctgggcaaagacagcaacaasctgtggctg

SEQ ID NO: 15724 - DNA, 341 bp, Homo sapiens
  misc_feature 9..10,19: n=a, g, c or t
cacgagwsnnttacctagnacatcctaatcgaaaaatctctctcgggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagtgagttcttccagcaaggtgcgttcatgggatactgagtgacagattagtcggtcagtggggctggagctggccgaggtggcctcatgcccamccgttaacccccagcttcgtgctgaacctgggcaaagacagcaacaasctgtggctg

SEQ ID NO: 15725 - DNA, 364 bp, Homo sapiens
cacaaatgatattaaaaattggctagttgaatctattgggattttctacaagtattctgcctttgcagaaacagatttggtgaatttgaatctcaatttgagtaatctgatcgttctttctagctaatggaaaatgattttacttagcaatgttatcttggtgtgttaagagttagagtttaacataaaggttattttctcctgatatagatcacataacagaatgcaccagtcatcagctattcagttggtaagcttccaggaaaaaggacaggcagaaagagtttgagacctgaatagctcccagatttcagtcttttcctgtttttgttaactttgggttaaaaaaaaaaaaaggtctgat

SEQ ID NO: 15726 - DNA, 340 bp, Homo sapiens
atttacgttaagttagttctttgcgamkgcgactttatagcctggccccttacagaaccaattttcctgagttgtggttcaatgcgaatctcaaggctcttactgacagcctaagaaataccccagaaagtctgcttcctacactggtcattatgtcatttaatattcttttaaaaaagtaaaacaactctcatttggcaaatgccttttagagttaacagatacagtagaaaggccataggttttgtgactagggacctggattggaatcctggctctccatacactattgacactctgtcaagtggaggaatcttatttcttaatggagatagtaagc

SEQ ID NO: 15727 - DNA, 448 bp, Homo sapiens
caacttagagtctcactcaagaaaatgaactttaacaatgttgactgaccactgtttgcattagcccttgcatatttaaggaaagtctatttttactgaatgtgtgagcatattagttgttgaatctctgactgctactatgctgagcacgagagagactcagcaaaatatttgtgtattggctgggtgcggtggctcacgcctgtaatcccagcactttgggaggccgagacgggcggatcacgaggtcaggagatcgagacggtcttggctaacacggtgaagccccgtctctactaaaaatacaaaaaaattagccgggcgtggtcgtgggcgcctgtcgtcccagcagctcgggaggctgaggcaggagaatggcgtgaacccgggargcggacttgctgtgatatcgcgccamtgcactccagcctgggtgacagagcgaggg

SEQ ID NO: 15728 - DNA, 184 bp, Homo sapiens
gcatgtgacttctggagaaaactgcagacactcgtcattgatctttccacccgtaagtgcatcgtcttcttctttccagtggtttcagagcacagtgagcaaagaggacgccatgccggaagcactgaaaagtctcatattcccgaattttgadcctttgcacaaatttcatactaattttctc

SEQ ID NO: 15729 - DNA, 471 bp, Homo sapiens
aactcctgccaggcagtgcccttcccggagcgtgccctcgccgctggtacggctcctacctggtctggaaagagctgggaggcttcacagagaaggctgtggttcccctgggcctctacactgggcagctggccctgaactgggcatggcccccatcttctttggtgcccgacaaatgggctgggccttggtggatctcctgctggtcagtggggcggcggcagcactaccgtggcctggtaccagttgagcccgctggccgcccgcctgctctacccctacctggcctggctggccttcacgaccacactcaactactgcgtatggcgggacaaccatggctggcgtgggggacggcgggctgcagagtgagtgcccggcccaccagggactgcagctgcaccagcaggtscatcacgcttgtgatgtwggtggccgtcacgctttcatgaccactgggcctgctagtct

SEQ ID NO: 15730 - DNA, 408 bp, Homo sapiens
  misc_feature 401: n=a, g, c or t
gtctttcaggaagaggagctggtgagaagacagcgaaatggcgcctccggcccccggccggcctccggcggctccggggaggtagacgagctgttcgacgtaaagaacgccttctacatcggcagctaccagcagtgcataaacgaggcgcasgggtgaagctatcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggagggacagcatcgtggccgagctggaccgagagatgagcaggagccgtggacgtgaccaacatcaccttccctgcttnatggccg

SEQ ID NO: 15731 - DNA, 423 bp, Homo sapiens
  misc_feature 224: n=a, g, c or t
attttgctggagcctgcgaccgagtgggagtggagtggagcgctgtggttgccgactctttcctcttccccacggtccagtcagcgggttaattaggccatcggcctcgagccgagacttgtctcttatttagttctggggagcgcctcgtcgacatgagtgatgtggaggaaaacaacttcgagggcagagtgagtacaaagccgcgggagccgtctaggcgncggcccaatgctcggggtttcacgggaacaagcgcggtcgggcggggttgcgggtagtcccgcgaggagcaacctctggagccatcgcgattgattcctcccatcccaagatggcttctgggttccactccttccccaaacaccacggataasacccctcccccttttttggaggctgactgatacctggacttctggg

SEQ ID NO: 15732 - DNA, 246 bp, Homo sapiens
aaaggattctagtccctccgggctttccgttctccaggcccggctgacagagttagccgaggccgccatattgaataagcgacccggcctcctagggggtcgtcgtggtgcagacagtttagcagaacagcctccgcggctccggggagaaggtgaggtcttgtatggatgggaagggtgaggtgsgtcggccagaggcttatttattgacgggactgtttsctttggcmcacgcgacgtagtctt

SEQ ID NO: 15733 - DNA, 396 bp, Homo sapiens
catatttttcctttcactttcggtttaaacatgctatatgtactgtatgtcctgtagcccagtgcgctccacagcatggaatctgatgtatgatatgatagaatctggcactaaatgcagtttcagattttattttttttaatcatatgaactaaaattgtcaattgtgaggtgtgcttttctcatcatgttggttatattgcacaattggttatatttatgacctgatattcaaagactctggcattgatagccagtgtgttttcttatttaactccgtttactacattctacatggtgtttacgtgatccacacttgaaatactagatcagtagacattcactaatataccaaaataaaatgaaaaattgagtttttccaaaaaaaaaaaaaaa

SEQ ID NO: 15734 - DNA, 476 bp, Homo sapiens
attttgctggagcctgcgaccgagtgggagtggagtggagcgctktggttgccgactctttcctcttccccacggtccagtcagcgggttaattaggccatcggcctcgagccgagacttgtctcttatttagttctggggagcgcctcgtcgacatgagtgatgtggaggaaaacaacttcgagggcagatgagcggccgcgtctctgttggaaccggcggcgttgcgtctaaaaaggcgaaagcttgaggttgaaggtgggacgagcctaatgaagtggttagtcaacgaccgcaccgacccttaagcgttcttaagacgagagctgtgaggggaaactacgcaaggagcccttttcccttaatgtcccttcgactttcctttcacttcgaaatgaatgtggaaatgctgtcacgccttatttttctaattcctcgatgttgggttttttctcttctttatatctcaactttta

SEQ ID NO: 15735 - DNA, 397 bp, Homo sapiens
cagaaaaacaactcattcgctttcatttcctcactgactataaaagaatagagaaggaagggcttcagtgaccggctgcctggctgacttacagcagtcagactctgacaggatcatggctatgatggaggtccaggggggacccagcctgggacagacctgcgtgctgatcgtgatcttcacagtgctcctgcagtctctctgtgtggctgtaacttacgtgtactttaccaacgagctgaagcaggtcagtgcagtgcagtgcactcagtcttcgaggcgcttagcaaatgtctggttacctgcttctttgcatgtyagcttgcccctctctgaagactttcctgcttcctttctctgtgggtacactctaactgctaaatcacatwacaactga

SEQ ID NO: 15736 - DNA, 505 bp, Homo sapiens
aacattagtcaactttctctacactgcatgggaacagggttcccatgggggttatgggttgtaaggttcctctttagcctacccttacctatggcaacagtgtgggtagtgtcctgccaaacatggaataaaccctccaaataatcaacccacaasraattttacttatttttcataagtttactaatctgccatttgaagagatgtcttcagttgtgataacccaggctcaatggtttgtacaatattatgcatacttgtaggatgcatctgtatttcaggacacagattgcagaaatatctctgtcaaatataaacctcaatttgtttttcaagctgtcagtctaatagggtgatgggaaatgaatctcagacaaattagggagtctcattctcttattagcccagggscttggctagggtccagtctcaggtgtgtctttatcagcagcattaaaatggactaatatagtaaattggtaccagtagagtgaggcactgctgt

SEQ ID NO: 15737 - DNA, 271 bp, Homo sapiens
  misc_feature 43: n=a, g, c or t
attttgctggagcctgcgaccgagtgggagtggagtggagcgnctgtggttgccgactctttcctcttccccacggtccagtcagcgggttaattaggccatcggcctcgagccgagacttgtctcttatttagttctggggagcgcctcgtcgacatgagtgatgtggaggatggtgaaccatgtatttcagtgaaatatttaatatatttaaatatcaataaaatcaaactctttgtaaaaaaaaaaaaaaaaaaaaaaaaaaaaaaaa

SEQ ID NO: 15738 - DNA, 494 bp, Homo sapiens
gcggtgtctcggcgcctctgcgcgcgggaagatggcggaacaggctaccaagtccgtgctgtttgtgtgtctgggtaacatttgtcgatcaacccattgcagaagcagttttcaggaaacttgtaaccgatcaaaacatctcagagaattgggtcattgacagcggtgctgtttctgactgggaacgtgggccggtccccagacccaagagctgtgagctgcctaagaaatcatggcattcacacagcccataaagcaagacagattaccaaagaagattttgccacatttgattatatactatgtatggatgaaagcaatctgagagatttgaatagaaaaagtaatcaagttaaaacctgcaaagctaaaattgaactacttgggagctatgatccacaaaaacaacttattattgaagatccctattatgggraatgactctgactttgagacggtgtaccagcagtgtgtcaggtgctgcagagcgttct

SEQ ID NO: 15739 - DNA, 423 bp, Homo sapiens
aaaaacgtgttggctattatwatcaatattagttaatttatcagtactaataaaatgagtggagtgataatcacacaaaatgattgagttggagagattagagtcaaggcagaggccaagaagcaggcggggaggaagaggacagaggatttccacaggttgctttgacgtggatcccacataccacccaggaaaggagccctaaggtcatgacatgtacatagagatgctgttttcctgttcgtaatcagtaaccacagwaccacctgaaaactgcccaggaatgtctgatgttatcacatctaaataagggattagatgtgaactttagcagagagaaactgcaggccacatttgcaagtgttttgagacatgattgtaactgtaaatgttaagggtctattaaaaagtcaacgaatcaat

SEQ ID NO: 15740 - DNA, 253 bp, Homo sapiens
ctgatgcctctggagctttttccctttatagcaccattgaatcccagtcctaacagaagtactgcgaatcttgtggcctcattctgaacaaaagggattagagaagaaaaatctcttgatataaggcttgaaagcaagggcaggcaatcttggttgtgaatattttctgatttttccagaaatcaagcagaagattgagctgctgatgtcagttaactctgagaagtcgtcctcttcagaaaggccggagcct

SEQ ID NO: 15741 - DNA, 259 bp, Homo sapiens
  misc_feature 43: n=a, g, c or t
attttgctggagcctgcgaccgagtgggagtggagtggagcgnctgtggttgccgactctttcctcttccccacggtccagtcagcgggttaattaggccatcggcctcgagccgagacttgtctcttatttagttctggggagcgcctcgtcgacatgagtgatgtggaggatggtgaaccatgtatttcagtgaaatatttaatatatttaaatatcaataaaatcaaactctttgtaaaaaaaaaaaaaaaaaaaa

SEQ ID NO: 15742 - DNA, 323 bp, Homo sapiens
atgaactttatttgtatgtctgttttttcacatcactcacttatgactcgaagtctcatgtgtttcattgatggagctcaggttaccctgtctcagataaaaagaagattgggttagtaagttttctgagttctaacttacggacttataagagctgtttataaaaaaaggttattaaacttttgtcatatttgtagatgcttttcctcacctcccaattaaactgctgctttgatttgtttttcacataaaaatctctttcccattcagagattgtagaaatagactcttgaattttttgtatttcaaaaaaaaaaaaaaaa

SEQ ID NO: 15743 - DNA, 370 bp, Homo sapiens
aggggaagccatccgaatgccacgtgctggcatccatacagtgatttaaaacagcagaagatgaaggctaagaaatgatttcctctttctgggaacgtaggacggtgcagaaggaggagaacccccgatccccacccaaggaagcaaagttactcagaccaatcctggtgatcatggggtgacagatgttacagccttcacatctggcctcttttgtagctttggaaagcccaaggtttacacagaggtttctctgctgagccaggtacttactgtggaatttttatttattttttatttaataatttgtatttaatttggaattaaaatgaatttgcaaaagagaaaaaaaaaaaaaattgcgaaaagc

SEQ ID NO: 15744 - DNA, 380 bp, Homo sapiens
gccattaggggaagccatccgaatgccacgtgctggcatccatacagtgatttaaaacagcagaagatgaaggctaagaaatgatttcctctttctgggaacgtaggacggtgcagaaggaggagaacccccgatccccacccaaggaagcaaagttactcagaccaatcctggtgatcatggggtgacagatgttacagccttcacatctggcctcttttgtagctttgaactaacctgcctaagaagagaggaaaactgttgatgtagtgggaacgctccctcctcgagcattaaccgggttgaccccacccctctgtcctcgctgtcttcagtccaatcaagatcggaaagcaggatcaagagaaagatgatcagac

SEQ ID NO: 15745 - DNA, 503 bp, Homo sapiens
accagccccctattactctgcaggcgtgtgaagaaagaaggaaactagctcggaccgtgcaggtttgtaggtctgttggcctgtaggtttcggcacaagtttcagcgagagaaggagaaaactgccttggttggaaccttgcagattcatcacaagagagctacaagagcctggaagaagctgaagactgctaccctccatccttactcaccctggacctgagagacctcttcaatcagcctccttcatgtggtgaggggatcacttcagctgcctgctgtggacaaagaacatcaaattacagcatcacgagtgctattgttgcctgtggtggtctccctgtccaagcgggaccgctttgcagagaccagaggcatatcgcggcttgagctgaaaatgcatttgttgcagcttaggttgaattatttttcgttgctctttcttctacacgcgcctgatggatagtggaacctattcatcaaaaaaagtgcactgctcttctg

SEQ ID NO: 15746 - DNA, 459 bp, Homo sapiens
aattttgcaatggcagtttcaaaacatcatgtggggaaactactagggaaaaacaaggagcagttccaggcctcacattcagaacacccagaagaaggaaggggaggcaccagctaccagaaacccttgatcataattttgctgaccactcattgaccacaattgtgtcacatggccacccctagctgcaaagaagaatggggagaatgtgactaaaaatatgctgatttcaaagactgatgtgaagattacgtgagagaattagagtgttttagagagtctccctatgttcacaccaggccggcctcaaactcctgagctcaactgatcttcccacctcagcctcccaagtagctgggactacaggtgtgtgccattgcacttgacttaaaacatttaaaatttataaaatagaaccctcatgattaaaaacaagcttatttaaaaaaaaaaaaaaaa

SEQ ID NO: 15747 - DNA, 134 bp, Homo sapiens
ccttctccccggcggttagtgctgagagtgcggagtgtgtgctccgggctcggaacacacatttattattaaaaaatccaaaaaaaatctaaaaaaatcttttaaaaaaccccaaaaaaaaaaaaaaaaaagct

SEQ ID NO: 15748 - DNA, 623 bp, Homo sapiens
aatttttcccatctttcttttcagtccttgcgcaccggggaacaaggtcgcgaaaaaaaaaaggtcttscgtgaggtgccgtccatttcatkvtgtwvctcattctctgcgcctttccgcagagcyttccaggcagcggtatgttggggccagagcatccggagggttcacaacctcatgtggtccgtaggagcctastatgaaggtagggccctgggaagaatttgcaattttcaagtggaaaacaagtggtcgttgactagctaagatgtgttttgtactttggatctgcatttgcttacaccctttccttgtagtaaggacaccaactggcttaaaacataagagatgtttcagtctcctccatttaacaggatatgaaagagcatttttaagaggtgcagcctctttgggagtggatcaaaactagaaactcatatgccatgactagatatgttttgtcaataaaacttatgacgtgaatgcttaatgcctcttttttgaaatagggaatgtaataattggccatttgcctacttttattatttgggtaacattccagtattactctctgtgatttagcttatttaatggtgttaaactgaggttatattaatttttga

SEQ ID NO: 15749 - DNA, 257 bp, Homo sapiens
attttgctggagcctgcgaccgagtgggagtggagtggagcggctgtggttgccgactctttcctcttccccacggtccagtcagcgggttaattaggccatcggcctcgagccgagacttgtctcttatttagttctggggagcgcctcgtcgacatgagtgatgtggaggatggtgaaccatgtatttcagtgaaatatttaatatatttaaatatcaataaaatcaaactctttgtaaaaaaaaaaaaaaaadw

SEQ ID NO: 15750 - DNA, 98 bp, Homo sapiens
ccccttctccccggcggttagtgctgagagtgcggagtgtgtgctccgggctcggaacacacatttattattaaaaaatccaaaaaaaaaaaaaaaaa

SEQ ID NO: 15751 - DNA, 98 bp, Homo sapiens; identical to SEQ ID NO: 15750

SEQ ID NO: 15752 - DNA, 82 bp, Homo sapiens
ccccttctccccggcggttagtgctgagagtgcggagtgtgtgctccgggctcggaacacacatttattattaaaaaatcca

SEQ ID NO: 15753 - DNA, 101 bp, Homo sapiens
ccccttctccccggcggttagtgctgagagtgcggagtgtgtgctccgggctcggaacacacatttattattaaaaaatccaaaaaaaaaaaaaaaaaagc

SEQ ID NO: 15754 - DNA, 101 bp, Homo sapiens
ccccttctccccggcggttagtgctgagagtgcggagtgtgtgctccgggctcggaacacacatttattattaaaaaatmcacaaaaaaaaaaaaaaaagy

SEQ ID NO: 15755 - DNA, 86 bp, Homo sapiens
ccccttctccccggcggttagtgctgagagtgcggagwgtgtgctccgggctcggaacacacatttattattaaaaaatccaaaaa

SEQ ID NO: 15756 - DNA, 101 bp, Homo sapiens
ccccttctccccggcggttagtgctgagagtgcggagtgtgtgctccgggctcggaacacacatttattattaaaaaatccaaaaaaaaaaaaaaaaaagy

SEQ ID NO: 15757 - DNA, 98 bp, Homo sapiens; identical to SEQ ID NO: 15750

SEQ ID NO: 15758 - DNA, 100 bp, Homo sapiens
cccttctccccggcggttagtgctgagagtgcggagtgtgtgctccgggctcggaacacacatttattattaaaaaatccaaaaaaaaaaaaaaaaaagc

SEQ ID NO: 15759 - DNA, 92 bp, Homo sapiens
ccccttctccccggcggttagtgctgagagtgcggagtgtgtgctccgggctcggaacacacatttattattaaaaaatccaaaaaaaaaaa

SEQ ID NO: 15760 - DNA, 273 bp, Homo sapiens
attttgctggagcctgcgaccgagtgggagtggagtggagcggctgtggttgccgactctttcctcttccccacggtccagtcagcgggttaattaggccatcggcctcgagccgagacttgtctcttatttagttctggggagcgcctcgtcgacatgagtgatgtggaggatggtgaaccatgtatttcagtgaaatatttaatatatttaaatatcaataaaatcaaactctttgtaaaaaaaaaaaaaaaaaaaaaaaaaaaaaaaaaw

SEQ ID NO: 15761 - DNA, 98 bp, Homo sapiens; identical to SEQ ID NO: 15750

SEQ ID NO: 15762 - DNA, 98 bp, Homo sapiens
cccttctccccggcggttagtgctgagagtgcggagtgtgtgctccgggctcggaacacacatttattattaaaaaatccaaaaaaaaaaaaaaaaaa

SEQ ID NO: 15763 - DNA, 75 bp, Homo sapiens
ccccttctccccggcggttagtgctgagagtgcggagtgtgtgctccgggctcggaacacacatttattattaad

SEQ ID NO: 15764 - DNA, 101 bp, Homo sapiens; identical to SEQ ID NO: 15753

SEQ ID NO: 15765 - DNA, 99 bp, Homo sapiens
cccttctccccggcggttagtgctgagagtgcggagtgtgtgctccgggctcggaacacacatttattattaaaaaatccaaaaaaaaaaaaaaaaaag

SEQ ID NO: 15766 - DNA, 101 bp, Homo sapiens; identical to SEQ ID NO: 15753

SEQ ID NO: 15767 - DNA, 61 bp, Homo sapiens
cccttctccccggcggttagtgctgagagtgcggagtgtgtgctccgggctcggaacacac

SEQ ID NO: 15768 - DNA, 98 bp, Homo sapiens
cccctwwctccccggcggttagtgctgagagtrcggagtgtgtrctccgggctcggaasrcacatttattattaaaaaatccaaaaaaaaaaaaaaaa

SEQ ID NO: 15769 - DNA, 98 bp, Homo sapiens; identical to SEQ ID NO: 15750

SEQ ID NO: 15770 - DNA, 99 bp, Homo sapiens
cycttctccccggcggttagtgctgagagtgcggagtgtgtgctccgggctcggaacacacadttattattaaaaaatccaaaaaaaaaaaaaaaaagg

SEQ ID NO: 15771 - DNA, 97 bp, Homo sapiens
cccttctccccggcggttagtgctgagagtgcggagtgtgtgctccgggctcggaacacacatttattattaaaaaatccaaaaaaaaaaaaaaaaa

SEQ ID NO: 15772 - DNA, 101 bp, Homo sapiens
ccccttctccccggcggttagtgctgagagtgcggagtgtgtgctccgggctcggaacacacatttattattaaaaaatccaaaaaaaaaaaaaaaaaagt

SEQ ID NO: 15773 - DNA, 101 bp, Homo sapiens
ccccttctccccggcggttagtgctgagagtgcggagtgtgtgctccgggctcggaacacacatttatkattaaaaaatccaaaaaaaaaaaaaaaaargy

SEQ ID NO: 15774 - DNA, 97 bp, Homo sapiens; identical to SEQ ID NO: 15771

SEQ ID NO: 15775 - DNA, 101 bp, Homo sapiens
  misc_feature 99: n=a, g, c or t
ccccttctccccggcggttagtgctgagagtgcggagtgtgtgctccgggctcggaacacacatttattattaaaaaatccaaaaaaaaaaaaaaaaangt

SEQ ID NO: 15776 - DNA, 97 bp, Homo sapiens; identical to SEQ ID NO: 15771

SEQ ID NO: 15777 - DNA, 88 bp, Homo sapiens
ccccttctccccggcggttagtgctgagagtgcggagtgtgtgctccgggctcggaacacacatttattattaaaaaatccaaaaaaa

SEQ ID NO: 15778 - DNA, 90 bp, Homo sapiens
cccttctccccggcggttagtgctgagagtgcggagtgtgtgctccgggctcggaacacacatttattattaaaaaatccaaaaaaaaaa

SEQ ID NO: 15779 - DNA, 97 bp, Homo sapiens; identical to SEQ ID NO: 15771

SEQ ID NO: 15780 - DNA, 101 bp, Homo sapiens; identical to SEQ ID NO: 15753

SEQ ID NO: 15781 - DNA, 97 bp, Homo sapiens; identical to SEQ ID NO: 15771

SEQ ID NO: 15782 - DNA, 86 bp, Homo sapiens
ccccttctccccggcggttagtgctgagagtgcggagtgtgtgctccgggctcggaacacacatttattattaaaaaatccaaaaa

SEQ ID NO: 15783 - DNA, 98 bp, Homo sapiens; identical to SEQ ID NO: 15750

SEQ ID NO: 15784 - DNA, 51 bp, Homo sapiens
cccttctccccggcggttagtgctgagagtgcggagtgtgtgctccgggct

SEQ ID NO: 15785 - DNA, 97 bp, Homo sapiens; identical to SEQ ID NO: 15771

SEQ ID NO: 15786 - DNA, 85 bp, Homo sapiens
cccttctccccggcggttagtgctgagagtgcggagtgtgtgctccgggctcggaacacacatttattattaaaaaatccaaaaa

SEQ ID NO: 15787 - DNA, 99 bp, Homo sapiens; identical to SEQ ID NO: 15765

SEQ ID NO: 15788 - DNA, 100 bp, Homo sapiens
ccccttctccccggcggttagtgctgagagtgcggagtgtgtgctccgggctcggaacacacatttattattaaaaaatccaaaaaaaaaaaaaaaaarg

SEQ ID NO: 15789 - DNA, 97 bp, Homo sapiens
ccccttctccccggcggttagtgctgagagtgcggagtgtgtgctccgggctcggaacacacatttattattaaaaaatccaaaaaaaaaaaaaaaa

SEQ ID NO: 15790 - DNA, 97 bp, Homo sapiens; identical to SEQ ID NO: 15771

SEQ ID NO: 15791 - DNA, 483 bp, Homo sapiens
aagccgagtggagggaggcaaaggccaggctgaggatcagggtggcccgggtggcagcggggaggcgctgcatgctggaggctgtgctgagtgcccggtgcaggtgagccggtcctgcggagttgtgccgagtgcctgctgcaggtgagtcgactcccacctgcaggagctggaaagcaactctgccagaggtgaacttatgctgggtgtttgggggaaacaccatggggtggagcaaaggaaacttggcctgtcacaccttctctcacctctctagaagggaagccaaaccgttggctgaggaaggaagggaggggcaagctgtgcccttctcccctgagcgcaaatattgtccttattgagaaacaaggggaggacaagagagatctgtgtcatgctggttcctgggacatgagtttgctgcctctcccatctgcaggtgtagcatggatgctcaattccatttgggccaatattcactga

SEQ ID NO: 15792 - DNA, 99 bp, Homo sapiens
ccccttctccccggcggttagtgctgagagtgcggagtgtgtgctccgggctcggaacacacatttattattaaaaaatccaaaaraaaaaaaaaaaag

SEQ ID NO: 15793 - DNA, 82 bp, Homo sapiens
  misc_feature 18..19: n=a, g, c or t
ccccttctccccggcggnnagtgctgagagtgcggagtgtgtgctccgggctcggaacacacatttattattaaaaaatcca

SEQ ID NO: 15794 - DNA, 97 bp, Homo sapiens
ccccttctccccggcggttagtgctgagagtgcggagtgtgtgctccgggctcggaacacacatttattattaaaaaatccaraaaaaaaaaaaaaa

SEQ ID NO: 15795 - DNA, 100 bp, Homo sapiens
ccccttctccccggcggttagtgctgagagtgcggagtgtgtgctccgggctcggaacacacatttattattaaaaaatccaaaaaaaaaaaaaaaaaag

SEQ ID NO: 15796 - DNA, 99 bp, Homo sapiens
ccccttctccccggcggttagtgctgagagtgcggagtgtgtgctccgggctcggaacacacatttattattaaaaaatccaaaaaaaaaaaaaaaaag

SEQ ID NO: 15797 - DNA, 97 bp, Homo sapiens
  misc_feature 35: n=a, g, c or t
cccttctccccggcggttagtgctgagagtgcgknttgtgtgctccgggctcggaacacacatttattattaaaaaatccaaaaaaaaaaaaaaaaa

SEQ ID NO: 15798 - DNA, 97 bp, Homo sapiens; identical to SEQ ID NO: 15789

SEQ ID NO: 15799 - DNA, 76 bp, Homo sapiens
cccttctccccggcggttagtgctgagagtgcggagtgtgtgctccgggctcggaacacacatttattattaaaaa

SEQ ID NO: 15800 - DNA, 97 bp, Homo sapiens; identical to SEQ ID NO: 15771

SEQ ID NO: 15801 - DNA, 101 bp, Homo sapiens
cttctccccggcggttagtsctgarastgcgragtgtgtgctccgggctcggawcacacatttattattaaaaaatccamaaaaaatctaaaaaaatcttt

SEQ ID NO: 15802 - DNA, 541 bp, Homo sapiens
cttttcgatgctccaattgttccttctttgcatgcctgtattaacatgaaaataatactaataggattgccaaaatcaactgctgccttccccagaaacagatcctgagatgaagattaatgttaaagtgatgtaatgagttgttttcctggagctgctgataccaaacttggcagaggagaaggatggcatcaatgggtttctgggtggttgcctggacaagggagttcagccttcgggagataaagcatgatatgcagcaagtgcatgtcattggccctgatgcctttcctctggacacccctgtttgaacctcaactctggttctcagaaccacaccatcagtggtaaggctggtgaagcagaaagacagagaaaggatgtttgaacacttgaacattctgcacacttgattcaggtcatgcgatccttctacctgcttgtactctatctcacatgggataacataccccatttccactcctcccccttactttttaccctgtgttttaaattgactgtaactgtgcaattacagcac

SEQ ID NO: 15803 - DNA, 98 bp, Homo sapiens; identical to SEQ ID NO: 15750

SEQ ID NO: 15804 - DNA, 97 bp, Homo sapiens
cccttctccccggcggttagtgctgagagtgcggagwgtgtgctccgggctcggaacacacatttattattaaaaaatccaaaaaaaaaaaaaaaaa

SEQ ID NO: 15805 - DNA, 98 bp, Homo sapiens; identical to SEQ ID NO: 15750

SEQ ID NO: 15806 - DNA, 102 bp, Homo sapiens
ccccttctccccggcggttagtgctgagagtgcggagtgtgtgctccgggctcggaacacacatttattattaaaaaatccacaaagaaaaaaaaaaaaagc

SEQ ID NO: 15807 - DNA, 97 bp, Homo sapiens; identical to SEQ ID NO: 15771

SEQ ID NO: 15808 - DNA, 91 bp, Homo sapiens
ccccttctccccggcggttagtgctgagagtgcggagtgtgtgctccgggctcggaacacacatttattattaaaaaatccaaaaaaaaaa

SEQ ID NO: 15809 - DNA, 98 bp, Homo sapiens; identical to SEQ ID NO: 15762

SEQ ID NO: 15810 - DNA, 98 bp, Homo sapiens; identical to SEQ ID NO: 15750

SEQ ID NO: 15811 - DNA, 97 bp, Homo sapiens; identical to SEQ ID NO: 15771

SEQ ID NO: 15812 - DNA, 98 bp, Homo sapiens; identical to SEQ ID NO: 15750

SEQ ID NO: 15813 - DNA, 101 bp, Homo sapiens; identical to SEQ ID NO: 15756

SEQ ID NO: 15814 - DNA, 97 bp, Homo sapiens; identical to SEQ ID NO: 15771

SEQ ID NO: 15815 - DNA, 100 bp, Homo sapiens
  misc_feature 99: n=a, g, c or t
cccttctccccggcggttagtgctgagagtgcggagtgtgtgctccgggctcggaacacacatttattattaaaaaatccaaaaaaaaaaaaaaaaaany

SEQ ID NO: 15816 - DNA, 100 bp, Homo sapiens
cccttctcccsggcggttagtgctgagagtgcggagtgtgtgctccgggctcggaacacacatttattattaaaaaatcmaaaaaaaaaaaaaaaaargc

SEQ ID NO: 15817 - DNA, 98 bp, Homo sapiens; identical to SEQ ID NO: 15750

SEQ ID NO: 15818 - DNA, 97 bp, Homo sapiens; identical to SEQ ID NO: 15771

SEQ ID NO: 15819 - DNA, 98 bp, Homo sapiens; identical to SEQ ID NO: 15750

SEQ ID NO: 15820 - DNA, 101 bp, Homo sapiens; identical to SEQ ID NO: 15756

SEQ ID NO: 15821 - DNA, 98 bp, Homo sapiens; identical to SEQ ID NO: 15750

SEQ ID NO: 15822 - DNA, 99 bp, Homo sapiens
ccccttctccccggcggttagtgctgagagtgcggagtgtgtgctccgggctcggaacacacatttattattaaaaaatccaaaaaaaaaaaaaaaaaa

SEQ ID NO: 15823 - DNA, 199 bp, Homo sapiens
acagatgacaactgcagcccagacgacccatggctaggataaagctggtgctgtcctagaaattgggtctccctcccagatccaggctgcctcctgcaggctgcagactctgacatccagccatctcaatattccagagaagaggatgagtgtgaagggtgggtggcgatttttaaamcaaagggttgattcagggaaa

SEQ ID NO: 15824 - DNA, 97 bp, Homo sapiens; identical to SEQ ID NO: 15771

SEQ ID NO: 15825 - DNA, 100 bp, Homo sapiens
cccttctccccggcggttagtgctgagagtgcggagtgtgtgctccgggctcggaacacacatttattattaaaaaatccaaaaaaaaaaaaaaaaargs

SEQ ID NO: 15826 - DNA, 98 bp, Homo sapiens; identical to SEQ ID NO: 15750

SEQ ID NO: 15827 - DNA, 98 bp, Homo sapiens; identical to SEQ ID NO: 15750

SEQ ID NO: 15828 - DNA, 100 bp, Homo sapiens
  misc_feature 98..99: n=a, g, c or t
cccttctccccggcggttagtgctgagagtgcggagtgtgtgctccgggctcggaacacacatttattattaaaaaatccaaaaaaaaaaaaaaaaanns

SEQ ID NO: 15829 - DNA, 99 bp, Homo sapiens; identical to SEQ ID NO: 15822

SEQ ID NO: 15830 - DNA, 98 bp, Homo sapiens; identical to SEQ ID NO: 15750

SEQ ID NO: 15831 - DNA, 98 bp, Homo sapiens; identical to SEQ ID NO: 15750

SEQ ID NO: 15832 - DNA, 97 bp, Homo sapiens; identical to SEQ ID NO: 15789

SEQ ID NO: 15833 - DNA, 98 bp, Homo sapiens; identical to SEQ ID NO: 15750

SEQ ID NO: 15834 - DNA, 80 bp, Homo sapiens
ccccttctccccggcggstagtgctgagagtgcggagtgtgtgctccgggctcggaacacacatttattattaaaaaatc

SEQ ID NO: 15835 - DNA, 101 bp, Homo sapiens
ccccttctccccggcggttagtgctgagagtgcggagtgtgtgctccgggctcggaacacacatttattattaaaaaatccaaaaaaaaaaaaaaaaaags

SEQ ID NO: 15836 - DNA, 100 bp, Homo sapiens
cccttctccccggcggttagtgctgagagtgcggagtgtgtgctccgggctcggaacacacatttattattaaaaaatccaaaaaaaaaaaaaaaaaagy

SEQ ID NO: 15837 - DNA, 97 bp, Homo sapiens
ccccttctccccggcggttagtgctgagagtgcggwgtgtgtgctccgggctcggaacacacatttattattaaaaaatccaaaaaaaaaaaaaaaa

SEQ ID NO: 15838 - DNA, 98 bp, Homo sapiens; identical to SEQ ID NO: 15750

SEQ ID NO: 15839 - DNA, 101 bp, Homo sapiens
ccccttctccccggcggttagtgctgagagtgcggagtgtgtgctccgggctcggaacacacatttattattaaaaaatccaaaaaaaaaaaaaaaaargy

SEQ ID NO: 15840 - DNA, 98 bp, Homo sapiens; identical to SEQ ID NO: 15750

SEQ ID NO: 15841 - DNA, 98 bp, Homo sapiens; identical to SEQ ID NO: 15750

SEQ ID NO: 15842 - DNA, 100 bp, Homo sapiens; identical to SEQ ID NO: 15825

SEQ ID NO: 15843 - DNA, 98 bp, Homo sapiens
  misc_feature 10: n=a, g, c or t
csccttctcnccggcggttagtgctgagagtgcggagtgtgtgctccgggctcggaacacacatttattattaaaaaatccaaaaaaaaaaaaaaaaa

SEQ ID NO: 15844 - DNA, 448 bp, Homo sapiens
acagatgacaactgcagcccagacgacccatggctaggataaagctggtgctgtcctagaaattgggtctcccctcccagatccaggctgcctcctgcaggctgcagactctgacatccagccatctcaatattccagagaagaggatgagtgtgaagggktggtggcgattttaaacaaggtgatcaggaagaccttgtggataacttcgggtctgagcacactccatcaggagtccccctctgtcacccgggctggagtggaatggtgcgatctcggctcactgcaacctctgcctcctgggttcacgcgattctcttgcctcagcctcccaagtagctgggattacaggcatgggattacacacatagctaatttcactgagggttttcaacagtagagtgacaagatctgaattaagttttcccaaagttaaaaaaaaaaaaaa

SEQ ID NO: 15845 - DNA, 100 bp, Homo sapiens
cccttctccccggcggttagtgctgagagtgcggagtgtgtgctccgggctcggaacacacatttattattaaaaaatccaaaaaaaaaaaaaaaaargt

SEQ ID NO: 15846 - DNA, 67 bp, Homo sapiens
  misc_feature 14: n=a, g, c or t
cccttstcscmggnggttagtgctgagagtgcggagtgtgtgctccgggctcggaacacacatttat

SEQ ID NO: 15847 - DNA, 98 bp, Homo sapiens; identical to SEQ ID NO: 15750

SEQ ID NO: 15848 - DNA, 99 bp, Homo sapiens; identical to SEQ ID NO: 15822

SEQ ID NO: 15849 - DNA, 101 bp, Homo sapiens; identical to SEQ ID NO: 15753

SEQ ID NO: 15850 - DNA, 98 bp, Homo sapiens; identical to SEQ ID NO: 15750

SEQ ID NO: 15851 - DNA, 66 bp, Homo sapiens
ccccttctccccggcggttagtgctgagagtgcggagtgtgtgctccgggctcggaacacacattt

SEQ ID NO: 15852 - DNA, 101 bp, Homo sapiens; identical to SEQ ID NO: 15756

SEQ ID NO: 15853 - DNA, 100 bp, Homo sapiens
cccttctccccggcggttagtgctgagagtvmggagtgtgtgctccgggctcggaacacacatttattattaaaaaatccaaaaaaaaaaaaaaaaaagc

SEQ ID NO: 15854 - DNA, 97 bp, Homo sapiens; identical to SEQ ID NO: 15771

SEQ ID NO: 15855 - DNA, 451 bp, Homo sapiens
atttcccatctttcttttcagtccttgcgcaccggggracaaggtcgtgaaaaaaaaggtcttggtgaggtgccgccatttcatctgtcctcattctctgcgcctttcgcagagcttccagcagcggtatgttgggccagagcatccggagttcacaacctctgtggtccgtaggagccactatgaggagggccctgggaagaatttgccattttcagtggaaaacaagtggtcgttactagctaagatgtgtttgtactttggatctgcatttgctacacccttccttgtagtaagacaccaactgcttaaaacataaggakgtttcagttcctccatttaacagatatgaagagcattttaagaggtgcagcctctggaagtggatcaaactagaactcatatgccatactagatatgtttgtcataaacttatgacgtgaaaaaaaaa

SEQ ID NO: 15856 - DNA, 97 bp, Homo sapiens; identical to SEQ ID NO: 15804

SEQ ID NO: 15857 - DNA, 97 bp, Homo sapiens; identical to SEQ ID NO: 15771

SEQ ID NO: 15858 - DNA, 97 bp, Homo sapiens; identical to SEQ ID NO: 15789

SEQ ID NO: 15859 - DNA, 101 bp, Homo sapiens; identical to SEQ ID NO: 15772

SEQ ID NO: 15860 - DNA, 98 bp, Homo sapiens; identical to SEQ ID NO: 15750

SEQ ID NO: 15861 - DNA, 75 bp, Homo sapiens
ccccttctccccggcggttagtgctgagagtgcggagtgtgtgctccgggctcggaacacacatttattattaaa

SEQ ID NO: 15862 - DNA, 98 bp, Homo sapiens; identical to SEQ ID NO: 15750

SEQ ID NO: 15863 - DNA, 97 bp, Homo sapiens; identical to SEQ ID NO: 15789

SEQ ID NO: 15864 - DNA, 97 bp, Homo sapiens; identical to SEQ ID NO: 15789

SEQ ID NO: 15865 - DNA, 96 bp, Homo sapiens
cccttctccccggcggttagtgctgagagtgcggagtgtgtgctccgggctcggaacacacatttattattaaaaaatccaaaaaaaaaaaaaaaa

SEQ ID NO: 15866 - DNA, 97 bp, Homo sapiens; identical to SEQ ID NO: 15771

SEQ ID NO: 15867 - DNA, 101 bp, Homo sapiens; identical to SEQ ID NO: 15756

SEQ ID NO: 15868 - DNA, 100 bp, Homo sapiens; identical to SEQ ID NO: 15788

SEQ ID NO: 15869 - DNA, 98 bp, Homo sapiens; identical to SEQ ID NO: 15750

SEQ ID NO: 15870 - DNA, 99 bp, Homo sapiens
cccttctccccggcggttagtgctgagagtgcggagtgtgtgctccgggctcggaacacacatttattattaaaaaatccaaaaaaaaaaaaaaaaarg

SEQ ID NO: 15871 - DNA, 99 bp, Homo sapiens; identical to SEQ ID NO: 15822

SEQ ID NO: 15872 - DNA, 98 bp, Homo sapiens; identical to SEQ ID NO: 15750

SEQ ID NO: 15873 - DNA, 98 bp, Homo sapiens; identical to SEQ ID NO: 15750

SEQ ID NO: 15874 - DNA, 83 bp, Homo sapiens
ccccttctccccggcggttagtgctgagagtgcggagtgtgtgctccgggctcggaacacacatttattattaaaaaatccaa

SEQ ID NO: 15875 - DNA, 101 bp, Homo sapiens
ccccttctccccggcggttagtgctgagagtgcggagtgtgtgctccgggctcggaacacacatttattattaaaaaatccacaaaaaaaaaaaaaaaagc

SEQ ID NO: 15876 - DNA, 98 bp, Homo sapiens; identical to SEQ ID NO: 15750

SEQ ID NO: 15877 - DNA, 84 bp, Homo sapiens
ccccttctccccggcggttagtgctgagagtgcggagtgtgtgctccgggctcggaacacacatttattattaaaaaatccaaa

SEQ ID NO: 15878 - DNA, 98 bp, Homo sapiens; identical to SEQ ID NO: 15750

SEQ ID NO: 15879 - DNA, 99 bp, Homo sapiens; identical to SEQ ID NO: 15765

SEQ ID NO: 15880 - DNA, 97 bp, Homo sapiens
cccttctcctcggcggttagtgctgagagtgcggagtgtgtgctccgggctcggaacacacatttattattaaaaaatccaaaaaaaaaaaaaaaaa

SEQ ID NO: 15881 - DNA, 97 bp, Homo sapiens
ccccttctccccggcggttagtgctgagagtgcggagtgtgtgctccgggskcggaacacacatttattattaaaaaatccaaaaaaaaaaaaaaaa

SEQ ID NO: 15882 - DNA, 98 bp, Homo sapiens; identical to SEQ ID NO: 15750

SEQ ID NO: 15883 - DNA, 99 bp, Homo sapiens; identical to SEQ ID NO: 15765

SEQ ID NO: 15884 - DNA, 98 bp, Homo sapiens; identical to SEQ ID NO: 15762

SEQ ID NO: 15885 - DNA, 127 bp, Homo sapiens
ctttcttccccggcggttagtgctgagagtgcggagtgtgtgctccgggctcggaacacacatttattattaaaaaatccaaaaaaaatctaaaaaaatcttttaaaaaaccccaaaaaaaaaaaaa

SEQ ID NO: 15886 - DNA, 98 bp, Homo sapiens
cmccttctscccggsggttagtgctgagagtgcggagtgtgtgctccgggctcggaacacacatttattattaaaaaatccaaaaaaaaaaaaaaaaa

SEQ ID NO: 15887 - DNA, 101 bp, Homo sapiens; identical to SEQ ID NO: 15835

SEQ ID NO: 15888 - DNA, 102 bp, Homo sapiens
ccccttctccccggcggttagtgctgagagtgcggagtgtgtgctccgggctcggaacacacatttattattaaaaaatccaaaaaaaaaaaaaaaaaagct

SEQ ID NO: 15889 - DNA, 104 bp, Homo sapiens
ccccttctccccggcggttagtgctgagagtgcggagtgtgtgctccgggctcggaacacacatttattattaaaaaatccaagaaakawaaaaaaaaaaagct

SEQ ID NO: 15890 - DNA, 83 bp, Homo sapiens; identical to SEQ ID NO: 15874

SEQ ID NO: 15891 - DNA, 98 bp, Homo sapiens; identical to SEQ ID NO: 15750

SEQ ID NO: 15892 - DNA, 100 bp, Homo sapiens
  misc_feature 100: n=a, g, c or t
ccccttctccccggcggttagtgctgagagtgcggagtgtgtgctccgggctcggaacacacatttattattaaaaaatccaaaaaaaaaaaaaaaaaan

SEQ ID NO: 15893 - DNA, 98 bp, Homo sapiens; identical to SEQ ID NO: 15750

SEQ ID NO: 15894 - DNA, 75 bp, Homo sapiens; identical to SEQ ID NO: 15861

SEQ ID NO: 15895 - DNA, 101 bp, Homo sapiens; identical to SEQ ID NO: 15756

SEQ ID NO: 15896 - DNA, 98 bp, Homo sapiens
ccccttctccccggcggttagtgstgagagtgcggagtgtgtgctccgggctcggaacacacatttattattaaaaaatccaaaaaaaaaaaaaaaaa

SEQ ID NO: 15897 - DNA, 52 bp, Homo sapiens
cccttctccccggcggttagtgctgagagtgcggagtgtgtgctccgggctc

SEQ ID NO: 15898 - DNA, 97 bp, Homo sapiens; identical to SEQ ID NO: 15789

SEQ ID NO: 15899 - DNA, 98 bp, Homo sapiens; identical to SEQ ID NO: 15750

SEQ ID NO: 15900 - DNA, 100 bp, Homo sapiens; identical to SEQ ID NO: 15836

SEQ ID NO: 15901 - DNA, 96 bp, Homo sapiens; identical to SEQ ID NO: 15865

SEQ ID NO: 15902 - DNA, 102 bp, Homo sapiens
ccccttctccccggcggttagtgctgagagtgcggagtgtgtgctccgggctcggaacacacatttattattaaaaaatccaaaawaarraaaaaaaaagct

SEQ ID NO: 15903 - DNA, 100 bp, Homo sapiens; identical to SEQ ID NO: 15758

SEQ ID NO: 15904 - DNA, 86 bp, Homo sapiens
ccccttctccccggcggttagtgctgagagtgcggagtgtgtgctccgggctcggaacacacatttattattaaaaaatccaaaar

SEQ ID NO: 15905 - DNA, 97 bp, Homo sapiens; identical to SEQ ID NO: 15771

SEQ ID NO: 15906 - DNA, 101 bp, Homo sapiens; identical to SEQ ID NO: 15756

SEQ ID NO: 15907 - DNA, 98 bp, Homo sapiens; identical to SEQ ID NO: 15750

SEQ ID NO: 15908 - DNA, 101 bp, Homo sapiens
ccccttcttcccggcggttagtgctgagagtgcggagtgtgtgctccgggctcggaacacacatttattattaaaaaatccaaaaaaaaaaaaaaaaaagc

SEQ ID NO: 15909 - DNA, 98 bp, Homo sapiens
ccccttcttcccggcggttagtgctgagagtgcggagtgtgtgctccgggctcggaacacacatttattattaaaaaatccaaaaaaaaaaaaaaaaa

SEQ ID NO: 15910 - DNA, 90 bp, Homo sapiens
ccccttctccccggcggttagtgctgagagtgcggagtgtgtgctccgggctcggaacacacatttattattaaaaaatccaaaaaaaaa

SEQ ID NO: 15911 - DNA, 97 bp, Homo sapiens; identical to SEQ ID NO: 15771

SEQ ID NO: 15912 - DNA, 98 bp, Homo sapiens; identical to SEQ ID NO: 15750

SEQ ID NO: 15913 - DNA, 98 bp, Homo sapiens; identical to SEQ ID NO: 15750

SEQ ID NO: 15914 - DNA, 54 bp, Homo sapiens
cccttctccccggcggttagtgctgagagtgcggagtgtgtgctccgggctcgg

SEQ ID NO: 15915 - DNA, 83 bp, Homo sapiens
ccccttctccccggcggttagtgctgagagtgcggagtgtgtgctccgggctcggaacacacatttattattaaaaaatccar

SEQ ID NO: 15916 - DNA, 101 bp, Homo sapiens; identical to SEQ ID NO: 15753

SEQ ID NO: 15917 - DNA, 83 bp, Homo sapiens
ccccttctccccggcggttagtgctgagagtrcggagtgtgtgctccgggctcggaacacacatttattattaaaaaatccaa

SEQ ID NO: 15918 - DNA, 101 bp, Homo sapiens
  misc_feature 100: n=a, g, c or t
ccccttctccccggcggttagtgctgagagtgcggagtgtgtgctccgggctcggaacacacatttattattaaaaaatccaaaaaaaaaaaaaaaaaany

SEQ ID NO: 15919 - DNA, 75 bp, Homo sapiens
ccccttctccccggcggttagtgctgagagtrcggagtgtgtgctccgggctcggaacacacatttattattaaa

SEQ ID NO: 15920 - DNA, 99 bp, Homo sapiens; identical to SEQ ID NO: 15822

SEQ ID NO: 15921 - DNA, 53 bp, Homo sapiens
cttctccccggcggttagtsctgagagtgcsgwgtgtgtgctccgggytcggr

SEQ ID NO: 15922 - DNA, 98 bp, Homo sapiens; identical to SEQ ID NO: 15750

SEQ ID NO: 15923 - DNA, 98 bp, Homo sapiens; identical to SEQ ID NO: 15762

SEQ ID NO: 15924 - DNA, 100 bp, Homo sapiens; identical to SEQ ID NO: 15758

SEQ ID NO: 15925 - DNA, 97 bp, Homo sapiens; identical to SEQ ID NO: 15771

SEQ ID NO: 15926 - DNA, 99 bp, Homo sapiens; identical to SEQ ID NO: 15822

SEQ ID NO: 15927 - DNA, 98 bp, Homo sapiens; identical to SEQ ID NO: 15750

SEQ ID NO: 15928 - DNA, 99 bp, Homo sapiens; identical to SEQ ID NO: 15765

SEQ ID NO: 15929 - DNA, 99 bp, Homo sapiens; identical to SEQ ID NO: 15822

SEQ ID NO: 15930 - DNA, 69 bp, Homo sapiens
ccccttctccccggcggttagtgctkagagtgcggastgtgtgctccgggmtcggaacacacatttatt

SEQ ID NO: 15931 - DNA, 97 bp, Homo sapiens
ccccttctccccggcggttagtgctgasagtkcggagtgtgtgctccgggctcggaacacacatttattattaaaaaatccaaaaaaaaaaaaaaaa

SEQ ID NO: 15932 - DNA, 84 bp, Homo sapiens
cccttctccccggcggttagtgctgagagtgcggagtgtgtgctccgggctcggaacacacatttattattaaaaaatccasaa

SEQ ID NO: 15933 - DNA, 97 bp, Homo sapiens
cccttctccccggcggttagtgctgagagtgcggwktgtgtgctccgggctcggaacacacatttattattaaaaaatccaaaaaaaaaaaaaaaaa

SEQ ID NO: 15934 - DNA, 98 bp, Homo sapiens; identical to SEQ ID NO: 15750

SEQ ID NO: 15935 - DNA, 81 bp, Homo sapiens
cccttctccccggcggttagtgctgagagtgcggagtgtgtgctccgggctcggaacacacatttattattaaaaaatcca

SEQ ID NO: 15936 - DNA, 97 bp, Homo sapiens
cccttctccccggcggttagtgstgagagtgcggagtgtgtgctccgggctcggaacacacatttattattaaaaaatccaaaaaaaaaaaaaaaaa

SEQ ID NO: 15937 - DNA, 98 bp, Homo sapiens; identical to SEQ ID NO: 15750

SEQ ID NO: 15938 - DNA, 82 bp, Homo sapiens; identical to SEQ ID NO: 15752

SEQ ID NO: 15939 - DNA, 100 bp, Homo sapiens
cccttctccccggcggttagtgctgagagtgcggagtgtgtgctccgggctcggaacacacatttattattaaaaaatccaaaaaaaaaaaaaaaaargy

SEQ ID NO: 15940 - DNA, 103 bp, Homo sapiens
ccccttctccccggcggttagtgctgagagtgcggagtgttgttgctccgggctcggaacacacatttattattaaaaaatccaaaaaaaaaaaaaaaaaagc

SEQ ID NO: 15941 - DNA, 98 bp, Homo sapiens; identical to SEQ ID NO: 15750

SEQ ID NO: 15942 - DNA, 100 bp, Homo sapiens; identical to SEQ ID NO: 15939

SEQ ID NO: 15943 - DNA, 98 bp, Homo sapiens; identical to SEQ ID NO: 15750

SEQ ID NO: 15944 - DNA, 99 bp, Homo sapiens
cccttctccccggcggttagtgctgagagtgcggagtgtgtgctccgggctcggaacacacatttattattaaaaaatccaaaaaaaaaaaaaaaaagg

SEQ ID NO: 15945 - DNA, 101 bp, Homo sapiens
ccccttctccccggcggttagtgctgagagtgcggagygtgtgctccgggctcggaacacacatttattattaaaaaatccaaaaaaaaaaaaaaaaaags

SEQ ID NO: 15946 - DNA, 98 bp, Homo sapiens; identical to SEQ ID NO: 15750

SEQ ID NO: 15947 - DNA, 79 bp, Homo sapiens
cccttctccccggcggttagtgctgagagtgcggagtgtgtgctccgggctcggaacacacatttattattaaaaaatc

SEQ ID NO: 15948 - DNA, 101 bp, Homo sapiens
ccccttctccccggcggttagtgctgagagtgcggagtgtgtgctccgggctcggaacacacatttattattaaaaaatccaaaaaaaaaaaaaaaaaasy

SEQ ID NO: 15949 - DNA, 101 bp, Homo sapiens; identical to SEQ ID NO: 15756

SEQ ID NO: 15950 - DNA, 97 bp, Homo sapiens; identical to SEQ ID NO: 15771

SEQ ID NO: 15951 - DNA, 98 bp, Homo sapiens; identical to SEQ ID NO: 15750

SEQ ID NO: 15952 - DNA, 81 bp, Homo sapiens; identical to SEQ ID NO: 15935

SEQ ID NO: 15953 - DNA, 98 bp, Homo sapiens; identical to SEQ ID NO: 15750

SEQ ID NO: 15954 - DNA, 97 bp, Homo sapiens; identical to SEQ ID NO: 15771

SEQ ID NO: 15955 - DNA, 100 bp, Homo sapiens; identical to SEQ ID NO: 15758

SEQ ID NO: 15956 - DNA, 386 bp, Homo sapiens
  misc_feature 103: n=a, g, c or t
aacaaggtcgtgaaaaaaaaggtcttggtgaggtgccgccatttcatctgtcctcattctctgcgcctttcgcagagcttccagcagcggtagggggggccanagcatccggagttcacaacctctgtggtccgtagagccactatgaggagggccctgggaagaatttgcsattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatctttgtc

SEQ ID NO: 15957 - DNA, 97 bp, Homo sapiens; identical to SEQ ID NO: 15771

SEQ ID NO: 15958 - DNA, 100 bp, Homo sapiens; identical to SEQ ID NO: 15758

SEQ ID NO: 15959 - DNA, 97 bp, Homo sapiens; identical to SEQ ID NO: 15789

SEQ ID NO: 15960 - DNA, 90 bp, Homo sapiens; identical to SEQ ID NO: 15910

SEQ ID NO: 15961 - DNA, 100 bp, Homo sapiens; identical to SEQ ID NO: 15836

SEQ ID NO: 15962 - DNA, 100 bp, Homo sapiens; identical to SEQ ID NO: 15836

SEQ ID NO: 15963 - DNA, 85 bp, Homo sapiens; identical to SEQ ID NO: 15786

SEQ ID NO: 15964 - DNA, 97 bp, Homo sapiens; identical to SEQ ID NO: 15771

SEQ ID NO: 15965 - DNA, 100 bp, Homo sapiens; identical to SEQ ID NO: 15795

SEQ ID NO: 15966 - DNA, 98 bp, Homo sapiens; identical to SEQ ID NO: 15750

SEQ ID NO: 15967 - DNA, 100 bp, Homo sapiens
cccttctcctcggcggttagtgctgagagtgcggagtgtgtgctccgggctcggaacacacatttattattaaaaaatccaaaaaaaaaaaaaaaaaagy

SEQ ID NO: 15968 - DNA, 108 bp, Homo sapiens
ccccttctccccggcggttagtgctgagagtgcggagtgtgtgctccgggctcggaacacacatttattattaaaaaatccaaaaaaaaaaaaaaaaaggtttttcga

SEQ ID NO: 15969 - DNA, 98 bp, Homo sapiens; identical to SEQ ID NO: 15750

SEQ ID NO: 15970 - DNA, 100 bp, Homo sapiens; identical to SEQ ID NO: 15758

SEQ ID NO: 15971 - DNA, 100 bp, Homo sapiens; identical to SEQ ID NO: 15788

SEQ ID NO: 15972 - DNA, 99 bp, Homo sapiens; identical to SEQ ID NO: 15765

SEQ ID NO: 15973 - DNA, 100 bp, Homo sapiens; identical to SEQ ID NO: 15795

SEQ ID NO: 15974 - DNA, 100 bp, Homo sapiens; identical to SEQ ID NO: 15836

SEQ ID NO: 15975 - DNA, 60 bp, Homo sapiens
ccccttctccssggcggttagtgctgagagtgcggagtgtgtgstccgggctcggaacac

SEQ ID NO: 15976 - DNA, 90 bp, Homo sapiens; identical to SEQ ID NO: 15910

SEQ ID NO: 15977 - DNA, 443 bp, Homo sapiens
  misc_feature 134: n=a, g, c or t
acagatgacaactgcagcccagacgacccatggctaggataaagctggtgctgtcctagaaattgggtctcccctcccagatccaggctgcctcctgcaggctgcagactctgacatccagccatctcaatatnccagagaagaggatgagtgtgaagggktggtggcgattttdvacaaggtgatcaggaagaccttgtggataacttcgggtctgagcacactccatcaggagtccccctctgtcacccgggctggagtggaatggtgcgatctcggctcactgcaacctctgcctcctgggttcacgcgattctcttgcctcagcctcccaagtagctgggattacaggcatgggattacacacatagctaatttcactgagggttttcaacagtagagtgacaagatctgaattaagttttcccaaagttaaaaaaaar

SEQ ID NO: 15978 - DNA, 97 bp, Homo sapiens; identical to SEQ ID NO: 15789

SEQ ID NO: 15979 - DNA, 75 bp, Homo sapiens; identical to SEQ ID NO: 15763

SEQ ID NO: 15980 - DNA, 100 bp, Homo sapiens
cccttctccccggcggttagtgctgagagtgcggagtgtgtgctccgggctcggaacacacatttattattaaaaaatccaaaaaaaaaaaaaaaaaasy

SEQ ID NO: 15981 - DNA, 97 bp, Homo sapiens; identical to SEQ ID NO: 15789

SEQ ID NO: 15982 - DNA, 97 bp, Homo sapiens
cccttctcccsggcggttagtgctgagagtgcggagtgtgtgctccgggctcggaacacacatttattattaaaaaatcmaaaaaaaaaaaaaaaaa

SEQ ID NO: 15983 - DNA, 99 bp, Homo sapiens; identical to SEQ ID NO: 15822

SEQ ID NO: 15984 - DNA, 97 bp, Homo sapiens; identical to SEQ ID NO: 15771

SEQ ID NO: 15985 - DNA, 98 bp, Homo sapiens; identical to SEQ ID NO: 15750

SEQ ID NO: 15986 - DNA, 98 bp, Homo sapiens
acccttctcccgggsggttagtgctgagagtgcggagtgtgtgctccgggctcggaacacacatttattattaaaaaatcmaaaaaaaaaaaaaaaaa

SEQ ID NO: 15987 - DNA, 97 bp, Homo sapiens; identical to SEQ ID NO: 15789

SEQ ID NO: 15988 - DNA, 97 bp, Homo sapiens; identical to SEQ ID NO: 15771

SEQ ID NO: 15989 - DNA, 101 bp, Homo sapiens
  misc_feature 100: n=a, g, c or t
ccccttctccccggcggttagtgctgagagtgcggagtgtgtgctccgggctcggaacacacatttattattaaaaaatccaaaaaaaaaaaaaaaaaant

SEQ ID NO: 15990 - DNA, 439 bp, Homo sapiens
agtcaactattcaacatggaggcggaggtcgataagctggaactgatggtgagtgcaaagtgaaggagatctactgggtagtttatttttcccccatggcctcggaggtggggcacaatttggagtcgccggaaactccggagcggcggaggctggaccagagtcgagttccctcctcctgcaccaaagggagccgccaccgtctggtgtctaaaccgcctcgggtaaggggttacatccgggaaactcgtcagggaaatggcgggagatgctgagggtgcggggmctttggaattcsttgttcacttgmsstcacctttacaccccttacgaaastgcgscgggtgcagaccgcattctgtgtttgtaccaaaaaagatgtgaatggaamggtccctaagcgtcccaagaagggagaggtggttcamactccaagaaa

SEQ ID NO: 15991 - DNA, 390 bp, Homo sapiens
aactattcaacatggaggcggaggtcgataagctggaactgatggtgagtgcaaagtgaaggagatctactgggtagtttatttttcccccatggcctcggaggtggggcacaatttggagtcgccggaaactccgggcggcggaggctggaccagagtcgagttccctcctcctgcaccaaagggagccgccaccgtctggtgtctaaaccgcctcggctgtcaccactgactaaagaagagaaaactgcggcagagcaattcaaatttcacatgccagatttatgaagaaatggactttgaaaggaaattctaacagagaagagcttaattccggagaaatttaggaagatgtcttgttaacccttgaatgtctagagattgggggct

SEQ ID NO: 15992 - DNA, 183 bp, Homo sapiens
tcaaaaacaaggcttttgctcttgaagttattaaatccactcatcaatgttggaaagcattgcttatgaagaactgtaatggaggagctataaattgcacaaacgtgcagatatctgatagccctttccgttgcactcaagaggaagcaagatcattagttgaatcggtatcatcttcaccaa

SEQ ID NO: 15993 - DNA, 203 bp, Homo sapiens
tcaaaaacaaggcttttgctcttgaagttattaaatccactcatcaatgttggaaagcattgcttatgaagaactgtaatggaggagctataaattgcacaaacgtgcasatatctgatagccctttccgttgcactcaagaggaagcamsatcattagttgaatcggyatcatcttcaccaawrarwawmwagmmwraagct

SEQ ID NO: 15994 - DNA, 197 bp, Homo sapiens
  misc_feature 168: n=a, g, c or t
tcaaaaacaaggcttttgctcttgaagttattaaatccactcatcaatgttggaaagcattgcttatgaagaactgtaatggaggagctataaattgcacaaacgtgcagatatctgatagccctttccgttgcactcaagaggaagcaagatcattagttgaatcgntatcatcttcaccaaaaaaaaaaaaaaaa

SEQ ID NO: 15995 - DNA, 197 bp, Homo sapiens
tcaaaaacaaggcttttgctcttgaagttattaaatccactcatcaatgttggaaagcattgcttatgaagaactgtaatggaggagctataaattgcacaaacgtgcagatatctgatagccctttccgttgcactcaagaggaagcaagatcattagttgaatcggtatcatcttcaccaaaaaaaaaaaaaaaa

SEQ ID NO: 15996 - DNA, 446 bp, Homo sapiens
  misc_feature 59: n=a, g, c or t
acagatgacaactgcagcccagacgacccatggctaggataaagctggtgctgtcctangaaattgggtctcccctcccagatccaggctgcctcctgcaggctgcagactctgacatccagccatctcaatattccagagaagaggatgagtgtgaagggtggtggcgattttaaacaaggtgatcaggaagaccttgtggataacttcgggtctgagcacactccatcaggagtccccctctgtcacccgggctggagtggaatggtgcgatctcggctcactgcaacctctgcctcctgggttcacgcgattctcttgcctcagcctcccaagtagctgggattacaggcatgggattacacacatagctaatttcactgagggttttcaacagtagagtgacaagatctgaattaagttttcccaaagttaaaaaaaaaaaa

SEQ ID NO: 15997 - DNA, 197 bp, Homo sapiens; identical to SEQ ID NO: 15995

SEQ ID NO: 15998 - DNA, 197 bp, Homo sapiens
tcaaaaacaaggcttttgctcttgaagttattaaatccactcatcaatgttggaaagcattgcttatgaagaactgtaatggaggagctataaattgcacaaacgtsagatatctgatagccctttccgttgcactcaagaggaagcaagatcattagttgaatcggtatcatcttcaccaaaaaaaaaaaaaaaaa

SEQ ID NO: 15999 - DNA, 197 bp, Homo sapiens; identical to SEQ ID NO: 15995

SEQ ID NO: 16000 - DNA, 198 bp, Homo sapiens
tcaaaaacaaggcttttgctcttgaagttattaaatccactcatcaatgttggaaagcattgcttatgaagaactgtaatkggaaggasctataaatkgcacaaacgtgcagatatctgatagccctttccgttgcactcaagaggaagcaagatcattagttgaatcggtatcatcttcaccaaaaaaaaaaaaaaa

SEQ ID NO: 16001 - DNA, 197 bp, Homo sapiens; identical to SEQ ID NO: 15995

SEQ ID NO: 16002 - DNA, 377 bp, Homo sapiens
agaagcscggtcagcgcacgtgcccgcgagacctgcaaacttgtgccaccggctctgcccgtccccggggagcccgaacgccccgcagccctcacccctcacsgccagtctccagccatgggctgctttgaatgctgcatcaagtgtctgggaggagtcccctacgsvatccctggtggscacaatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgt

SEQ ID NO: 16003 - DNA, 424 bp, Homo sapiens
ttacaaatggrrrgcaaatgagagctggtgagttcaaaggaccaaccgaacattctctagctcatcaatggcagagcaaggatgagaactcagggagcaggagggaactccgtgcagtgtcgtttttactattgcgcatcaccttccttcagtgagtccttttcagaagcagcatattaatcaattcttgcctttttaattagagaaaccctgtgcaaagatgaaattaaaagattgtttctttattatatgttgaaatttttcttaaccttcaccatgaaaaaacaatgcttaaaatagcaaatatttttggtaaggtgacaaaatgctgtctagtatgaaatccttaatggcatcagtctaaaattcatagtggttgacaacttcacacgcagacccaaagagggtccactttctcagtggt

SEQ ID NO: 16004 - DNA, 498 bp, Homo sapiens
attctccatgtcaggaagaggaaattgcaagtaaaatcaagcattgaagtttttaggcagtggaaagtttggggctcttatgaataaggctgtcatgaacatttttgtataaatcttcatgtagacaaacgtttacatttttcttgggagcttgtgttcccagagaaatggaaatccttggagaatgtttgtctgcatgatatttggtacctggcgtatctaaacccaggacaaatgttcacagcacagcaatcaaaactgctcaggccactgtaaaaggggaagatgtgtgctagagctagagaaacacaactgaaaagtgacaactggagatgctgatcagtggtgcagattgatttcaaaagtgagtgagatgtcttgtgctttgcagtctcaggactaaagactacagaacgctggcttggtacctatgacttccaacaccagcattagtgccattctccaagtcaaagacagcaagttgcaaataaaattgga

SEQ ID NO: 16005 - DNA, 519 bp, Homo sapiens
agtaagaaggtgctgttccgagaaggagaaggaaaagggcttgacacgtattcactcggccccggacgtgggaagcaagccgtctggcttcggcctcacatcggtcctgtgctcgggacggcggcgttggcggactgatccgcggcggtgaagaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatgtttcattggcaagccacaattatgggacctaatgacagcccatatcaaggcggtgtattctttttgacaattcattttcctacagactaccccttcaaaccacctaaggttgcatttacaacaagaatttatcatccaaatattaaca

SEQ ID NO: 16006 - DNA, 125 bp, Homo sapiens
atcttgtggctgtgtcgtgcgcgtgaccccgtaggccggggaggcaccagctgccgcgcggggaggargccgaggccgcagcttgagggaggccccggcccctctgcgcctgtgtctggcagagc

SEQ ID NO: 16007 - DNA, 272 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaa

SEQ ID NO: 16008 - DNA, 359 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaaaaaaaaaaaaaaaaaaaaaaaaaaaaaaaaaaaaaaaaaaaaaaaaaaaaaaaaaaaaaaaaaaaaaaaaaaaaaaah

SEQ ID NO: 16009 - DNA, 292 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaaaaaaaaaaaar

SEQ ID NO: 16010 - DNA, 362 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtmtatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaar

SEQ ID NO: 16011 - DNA, 281 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaa

SEQ ID NO: 16012 - DNA, 329 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaaaaaaaaaaaaaaaaaaaaaaaaaaaaaaaaaaaaaaaaaaaaaaaaar

SEQ ID NO: 16013 - DNA, 336 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaaaaaaaaaaaaaaaaaaaaaaaaaaaaaaaaaaaaaaaaaaaaaaaaaaaaaaaar

SEQ ID NO: 16014 - DNA, 306 bp, Homo sapiens
attacagaactgacattctcaatacgagagaatgttgtactgacgacacaagatctcagactkgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaaaaaaaaaaawtaaaaaaaaaaaaaa

SEQ ID NO: 16015 - DNA, 339 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaawwwaaaaaaaaaaaaaaaaaaaaaaaaaaaaaaaaaaaaaaaaaaaaaaaaaaaaaaaw

SEQ ID NO: 16016 - DNA, 282 bp, Homo sapiens
attacagarctgacattctcaatacgagagaatgttgtactgacgacacaagatctcagacttgtgtgattctagcagctgaacacaccccaggctcttctgactggcagtggctctggaagcagtctggkstatagatgagctggtataactccgaagtatggaatttgctgttgtctgtgacccagcaaataaaaatagaaaaataattcgatagaaaaataatagaaatagaaaaaatttaaaaaacaaaccaagcctcattctatgamaaaaaaaaam

SEQ ID NO: 16017 - DNA, 302 bp, Homo sapiens
  misc_feature 281: n=a, g, c or t
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaanmmaaaaaaaaaaaaaaaaaww

SEQ ID NO: 16018 - DNA, 327 bp, Homo sapiens
attacagaactgacattctcaatacgagagaatgttgtactgacgacacaagatctcagacttgtgtgattctagcagctgaacacaccccaggctcttctgactggcagtggctctggaagcagtctgbwctatagatgagctggtataactccgaagtatggaatttgctgttgtctgtgacccagcarwtaaaaatagaaaaataattcgatagaaaaataatagaaatagaaaaaatttaaaaaacaaaccaagcctcattctatgaaaaaaaaaarraaaaaaraaaaaaaaaaaaaaaaaaaaaaaaaaaaaaaaaaaaaa

SEQ ID NO: 16019 - DNA, 359 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaaaaaaaaaaaaaaaaaaaaaaaaaaaaaaaaaaaaaaaaaaaaaaaaaaaaaaaaaaaaaaaaaaaaaaaaaaaaaaar

SEQ ID NO: 16020 - DNA, 305 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtcwatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaaaaaaaaaaaaaaaaaaaaaaaaaw

SEQ ID NO: 16021 - DNA, 296 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaaaaaaaaaaaaaaaaw

SEQ ID NO: 16022 - DNA, 297 bp, Homo sapiens
attacagractgacattctcaatacgagagaatgttgtactgacgacacaagakctcagacttgtgtgattctagcagctgaacacaccccaggctcttctgactggcagtggctctggaagcagtctgvwctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaaaaaaaaaaaaaaaaah

SEQ ID NO: 16023 - DNA, 279 bp, Homo sapiens
  misc_feature 279: n=a, g, c or t
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaakraaaatagaaaaataattcgatagaaaaataatagaaatagaaaaaatttaaaaaacaaaccaagcctcattctatgaaaaaaaan

SEQ ID NO: 16024 - DNA, 326 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaaaaaaaaaaaaaaaaaaaaaaaaaaaaaaaaaaaaaaaaaaaaaaw

SEQ ID NO: 16025 - DNA, 458 bp, Homo sapiens
ttctttcttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatchggaggttcacaacctctgtggtccgtagagccactatgaggagggccctgggaagaatttgccattttcagtggaaaacaagtggtcgttactagctaagatgtgtttgtactttggatctgcatttgctacacbmttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtgaaaaaaaaaaaaaaaaaaaaaa

SEQ ID NO: 16026 - DNA, 347 bp, Homo sapiens
  misc_feature 347: n=a, g, c or t
attacagaactgacattctcaatacgagagaatgttgtactgacgacacaagatctcagacttgtgtgattctagcagctgaacacaccccaggctcttctgactggcagtggctctggaagcagtctggkctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaaaaaaaaaaaaaaaaaaaaaaaaaaaaaaaaaaaaaaaaaaaaaaaaaaaaaaaaaaaaaaaaaaan

SEQ ID NO: 16027 - DNA, 324 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtcwatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaammaaaaaaaaaaaaaaaarraaaaaaaaaaaaaaaaaaaaaaa

SEQ ID NO: 16028 - DNA, 315 bp, Homo sapiens
  misc_feature 282..283: n=a, g, c or t
attacagaactgacattctcaatacgagagaatgttgtactgacgacacaagatctcagacttgtgtgattctagcagctgaacacaccccaggctcttctgactggcagtggctctggaagcagtctggtcwatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaarrradkkdnnkaaaaaaaaaaaaaaaaaaaaaaaaaaaaaar

SEQ ID NO: 16029 - DNA, 282 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaam

SEQ ID NO: 16030 - DNA, 307 bp, Homo sapiens
attacagaactgacattctcaatacgagagaatgttgtactgacgacacaagrtctcagacttgtgtgattctagcagctgaacacaccccaggctcttctgactggcagtggctctggaagcagtctggwctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaawdtaaaaaaaaaaaaaaaaaaaaaaaaar

SEQ ID NO: 16031 - DNA, 332 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtstatagatgagctggtataactccgaagtatggaatttgctgttgtctgtgacccagcaaatgraaatagaaaaaataatttcgatagaaaataaatagaaatagaaaaaawttaaaaaacaaaccmaagcctcattctatgaaaaaaaaaaaaaaaaaaaaaaaaaaaaaaaaaaaaaaaaaaaaaaaaaaaaaaaaaad

SEQ ID NO: 16032 - DNA, 333 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtcymtagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaaaaaaaaaaaaaaaaaaaaaaaaaaaaaaaaaaaaaaaaaaaaaaaaaaaaaw

SEQ ID NO: 16033 - DNA, 297 bp, Homo sapiens
attacagaactgacattctcaatacgagagaatgttgtactgacgacacaagatctcagacttgtgtgattctagcagctgaacacaccccaggctcttctgactggcagtggctctggaagcagtctggkctatagatgagctggtataactccgaagtatggaatttgctgttgtctgtgacccagcaarkaaaaatagaaaaataattcgatagaaaaataatagaaatagaaaaaatttaaaaaacaaaccaagcctcattctatgaaaaaaaaaaaaaaaaaaaaaaaaaar

SEQ ID NO: 16034 - DNA, 281 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacawwccaagcctcattctatgaaaaaaaaaar

SEQ ID NO: 16035 - DNA, 306 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtmtatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaaaaaaaaaaaaaaaaaaaaaaaaaad

SEQ ID NO: 16036 - DNA, 526 bp, Homo sapiens
tttgataagcctattgaatcttgggttaatgtctcttaccaattttggaaaattggctattatccatcaaaataatattgctcctatcccattctcacccttctcctgggattccaatacacgttagacagttggatcagtaccatatggccctcttctctctgtctctgtctctctctgtgcatgtgtgtatgtgggtgtgtgtgtttgtgtacttttaattctatcttttctctgtgctttattttggataatttctatggacctgtctgaaacttcatcaatcctttttgctactatatgtttagtctgctcttaagcccatccaatgagttcttaatttcaggtattatattaattggttaatataataaacacttatttttattatttattttatttttaataacaaataatgagcacctactttcatagctttcatctctctgttgaaattctccatcttttcatccattttgttcatccattcctccawctcawttcatgtatttacaagaatattgta

SEQ ID NO: 16037 - DNA, 279 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaav

SEQ ID NO: 16038 - DNA, 335 bp, Homo sapiens
  misc_feature 281: n=a, g, c or t
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaamynvmmaaaaaaaaaaaaaaaaaaaaaaaaaaaaaaaaaaaaaaaaaaaaaaaaaaa

SEQ ID NO: 16039 - DNA, 276 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaar

SEQ ID NO: 16040 - DNA, 318 bp, Homo sapiens
  misc_feature 318: n=a, g, c or t
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaammmaaaaaaaaaaaaaaaaaaaaaaaaaaaaaaaaaan

SEQ ID NO: 16041 - DNA, 338 bp, Homo sapiens
  misc_feature 135,197: n=a, g, c or t
ccrttacagaactgacattctcaatacgagagaatgttgtactgacgacacaagatctcagacttgtgtgattctagcagctgaacacaccccaggctcttctgactggcagtggctctggaagcagtctggtcnatagatgagctggtataactccgaagtatggaatttgctgttgtctgtgacccagcaaatanaaatagaaaaataattcgatagaaaaataatagaaatagaaaaaatttaaaaaacaaaccaagcctcattctatgaaaaaaaaaaaaaaaaaaaaaaaaaaaaaaaaaaaaaaaaaaaaaaaaaaaaaaaaaaaaaaaaar

SEQ ID NO: 16042 - DNA, 365 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaar

SEQ ID NO: 16043 - DNA, 280 bp, Homo sapiens
attacagaactgacattctcaatacgagagaatgttgtactgacgacacaagatctcagacttgtgtgaktctagcagctgaacacaccccaggctcttctgactggcagtggctctggaagcagtctggwmtatagatgagctggtataactccgaagwatggaatttgctgttgtctgtgacccagcaaataaaaatagaamaataattcgatagamaaataatagaaatagaaaaaatttaaaaaacaaaccaagcctcattctatgaaaaaaaaad

SEQ ID NO: 16044 - DNA, 334 bp, Homo sapiens
  misc_feature 334: n=a, g, c or t
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaaaaaaaaaaaaaaaaaaaaaaaaaaaaaaaaaaaaaaaaaaaaaaaaaaaaaan

SEQ ID NO: 16045 - DNA, 333 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtstatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaaaaaaaaaaaaaaaaaaaaaaaaaaaaaaaaaaaaaaaaaaaaaaaaaaaaar

SEQ ID NO: 16046 - DNA, 280 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaav

SEQ ID NO: 16047 - DNA, 175 bp, Homo sapiens
tggtatcaggtaggggtccacgtcctttttgtttttagcaagttgagtttgagatacctgcaggacattgaagtaggaggataataaaaccttgtataaaggagagtaagatgttgctggtagggaaagtgtctggaaagmttttttttttttyccggagasggagcstcgctct

SEQ ID NO: 16048 - DNA, 371 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaaggtatggaatttgctgttgtctgtgacccagcaaataaaaatagaaaaataattcgatagaaaaataatagaaatagaaaaaatttaaaaaacaaaccaagcctcattctatgaaaaaaaaaaaaaaaaaaaaaaaaaaaaaaaaaaaaaaaaaaaaaammaaaaaaaaaaaaaaaaaaaaaaaaaaaaaaaaaaaaaaaaaaaaaaaaaaar

SEQ ID NO: 16049 - DNA, 296 bp, Homo sapiens; identical to SEQ ID NO: 16021

SEQ ID NO: 16050 - DNA, 332 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaatrraaatagaaaaataattcgatagaaaaataatagaaatagaaaaaatttaaaaaacaaaccaagcctcattctatgaaaaaaaaaaaaaaaaaaaaaaaaaaaaaaaaaaaaaaaaaaaaaaaaaaaaaaaaaaaaaa

SEQ ID NO: 16051 - DNA, 336 bp, Homo sapiens
attacagaactgacattctcaatacgagagaatgttgtactgacgacacaagatctcagacttgtgtgattctagcagctgaacacaccccaggctcttctgactggcagtggctctggaagcagtctggwmtatagatgagctggtataactccgaagtatggaatttgctgttgtctgtgacccagcagataaaaatagaaaaataattcgatagaaaaataatagaaatagaaaaaatttaaaaaacaaaccaagcctcattctatgaaaaaaaaaaaaaaaaaaaaaaaarrraaaaaaaaaaaaaaraaaaaaaaaaaaaaaaaaaaaaar

SEQ ID NO: 16052 - DNA, 329 bp, Homo sapiens
  misc_feature 279,281..282: n=a, g, c or t
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaraanrnnmaaaaaaaaaaaaaaaaaaaaaaaaaaaaaaaaaaaaaaaaaaaaaa

SEQ ID NO: 16053 - DNA, 332 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaaaaaaaaaaaaaaaaaaaaaaaaaaaaaaaaaaaaaaaaaaaaaaaaaaaaa

SEQ ID NO: 16054 - DNA, 281 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaab

SEQ ID NO: 16055 - DNA, 319 bp, Homo sapiens
  misc_feature 282: n=a, g, c or t
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaagrsnaaaaaaaaaaaaaaaaaaaaaaaaaaaaaaaaaaaaw

SEQ ID NO: 16056 - DNA, 320 bp, Homo sapiens
  misc_feature 283..287: n=a, g, c or t
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaakcnnnnnaaaaaaaaaaaaaaaraaaaaaaaaaaaaaaar

SEQ ID NO: 16057 - DNA, 306 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaraaaaaaaaaaaaaaaaaaaaaaaaw

SEQ ID NO: 16058 - DNA, 357 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaaaaaaaaaaaaaaaaaaaaaaaaaaaaaaaaaaaaaaaaaaaaaaaaaaaaaaaaaaaaaaaaaaaaaaaaaaaaaw

SEQ ID NO: 16059 - DNA, 281 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaar

SEQ ID NO: 16060 - DNA, 281 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggkrtaactccgaaggtatggaatttgctgttgtctgtgacccagcaaatrraaatagaaaaataattcgatagaaaaataatagaaatagaaaaaatttaaaaaacaaaccaagcctcattctatgaaaaaaaaar

SEQ ID NO: 16061 - DNA, 335 bp, Homo sapiens
  misc_feature 194: n=a, g, c or t
attacagaactgacattctcaatacgagagaatgttgtactgacgacacaagatctcagacttgtgtgattctagcagctgaacacaccccaggctcttctgactggcagtggctctggaagcagtctggtmwatagatgagctggtataactccgaagtatggaatttgctgttgtctgtgacccagcaaatnaaaatagaaaaataattcgatagaaaaataatagaaatagaaaaaatttaaaaaacaaaccaagcctcattctatgaaaaaaaaaaaaaaaaaaaaaaaaaaaaaaaaaaaaaaaaaaaaaaaaaaaaaaaaaaaaaaaar

SEQ ID NO: 16062 - DNA, 110 bp, Homo sapiens
aagctctgaatatctgaacacacggaggtccctggagggtgccacaaccagggagggcatgagagctccacaccccttccccatgccttgccctgtgcatctcttccacc

SEQ ID NO: 16063 - DNA, 447 bp, Homo sapiens
acctacagattaagtgaaagacaaacagtagaaaaatgtggaaaaactcaaacaggtgcttctaatatggaaaaacacaaacgattggcaacatataaataggctcaagctcattagtaatcaaagaaatgcacattgaaaccacagtgttatattattttatgccttcagacaggcaaattttttaagtctaacaatatcaagtgatttgcaaggatatggtgcatctgggacaactgtaaactgcaggtgggagtaaaaactggtgcaaacactctgaaaaacaatttgagattatctagttaagttgaaggtgtacagtcctataaccagaaattcctcatcaaggtagaaactccctagagaaattgtagcatatgtgtatcaggagcgttgtgccagagtgttcatagcaacactctctgtactagaaaaaaaaaaaaaaaa

SEQ ID NO: 16064 - DNA, 450 bp, Homo sapiens
ttaaggaatgaaagataagtttagatgaaagggaagaggccaatggaggacgagttggactttattctgtagaaaatggggaacaactgaaggtgtcagtttttttttttttaagtaacatttattgtgggatttttttaattgtaaaagcaaatatgttaattgtgctgcatttggaaagcacagaaaagtataaaagaatataattacccataatttcaccaaccagcaataacaactattggcaccttactgttaactgcctgcaagttgatgccagttttcaccttctcaagcctattttgacagctctattgaaaactggaaccatatcgactgctcttcatactccctttctgctttatttttkcctccataatatttatttcctccttagaaccttaatgtgaaaaaaaaatttcctccwaatgtatgatccattgggtaagc

SEQ ID NO: 16065 - DNA, 227 bp, Homo sapiens
caacctcttcaacacagcctttgggctgctggggatggggcccgagggtcagcccctgggcagaagggtggccagtgggccagccctggggaggggatatccccccagtctgctcaggcccctcaagctcctggagacaaccacgtggtgcctgtactgcgctaactcctgattaatacaatggaagtttctgggcatttacaattccaaaaaaaaaaaaaaaaagg

SEQ ID NO: 16066 - DNA, 405 bp, Homo sapiens
agataaaagctctggagttttctcaaaaacacacatccacctacatgtaaaatttggcatccaatttcagagcatccatgattcctcaaagacaatcttgaccaacaaccttacttagatcactaaagtacctcggatcagatttcaaatcagcctactcatcaggtccactctaccatgccagaccaggcatccaagttataaagatgagattccaaattacccagctgccataaagctcgcgttcccgtgtgaatcctgaactctggctgacgacatctggagtccactgcaatcatgtgttccctcaatgactgaaaaacctgagcataatgactacctaagattcatatctgtacatacccaaaatgtttattaaatagaaataaagataaaataatgtgt

SEQ ID NO: 16067 - DNA, 516 bp, Homo sapiens
  misc_feature 501: n=a, g, c or t
agcctggdccgctgcgcagaggcgcggcgctgtacaactcggccgttgtcaccatgccggtcgtccggaagattttccgtcgccgccggggcgaytcggagtcagaggaagatgagcaggactcagaggaggttcgattaaaactggaagagaccagagargtacagaacttgaggaagaggcccaacgggtgagtgctgtggccttgctggtgggagagaaggtacaagaggagaccactctagtgatgatccctttcagatgaagacaggtggtatggtggatatgaagaaactgaaggaaaggggcaaagataagatcagtgaggaggaggacctgcacctggggacatcgttttctgcagaaaccaaccgaagratgaggatgcagacatgatgaagtacattgagacagagctaaagamgaggaaagggatcgtggacatgaggaacagaaagttaagccaaagaatgcagaggactgtctttatgaacttccagnaaaacatccgtgttt

SEQ ID NO: 16068 - DNA, 234 bp, Homo sapiens
tatcaatatcagttctttacctgtgcataaaagaatatcatgaagtaattgaacttatctgttgatataaaaacacagatccaattcgtgtctgtggatgctgcaaggactggctcattggagccaaaccatgtggcggaaactcctgaaattggtggaaaaagtggaatatggcagattgggtaggtaggagaacaattttggagattttgtttccaaaaaaaaaaaaaaaaa

SEQ ID NO: 16069 - DNA, 404 bp, Homo sapiens
gacaattattctgcaatcttcctggtcctgccattaatttatttaagtcctggaagaatacttaaattggtctcaagttccatcagcaagatgggacgactccattgaaaagaaacataatatatggaaaaattactagaaaatctaggaaaactgactgaatgctttggaaagacacagtcaagacttttaccactgaaattttcaaacaaccatcacggtatttatctcatttacttaataaataccacaatccaattcaaatactgctgaagagataatataattttgtctttaccattcttgttcasaaattgcagaaatttctctgtgcatttcaagacgtgaccacaccttccctatccctgtcccaacaggtcatgagacccccctcaygtttctta

SEQ ID NO: 16070 - DNA, 399 bp, Homo sapiens
aattattctgcaatcttcctggtcctgccattaatttatttaagtcctggaagaatacttaaattggtctcaagttccatcagcaagatgggacgactccattgaaaagaaacataatatatggaaaaattactagaaaatctaggaaaactgactgaatgctttggaaagacacagtcaagattaaaaaaaatgtgtcacaagaaagtttacagaacctactcaaactcaaagagaaatcagagactaaattctcaaaactggaagctccctacagcatccacactcttcagccttgtactatgtgatgtgtattacgaatggagccaccggcagtatttgtatgaacatgagacaatgtgtggcagatgcttggtgctttgtaatatttagtaaaat

SEQ ID NO: 16071 - DNA, 482 bp, Homo sapiens
tcaatgttaaatatgaggtgaccgtacagtagttaggagtttctttacttacaaaatcactggaaatgattaaattgcttttccccctccccagaggtgcatttttcttatttccatatagtaaagttgagcttttacagtgcataatgtgacatttggaatgcttatcaactgcatgtaaacattaataacctgcacttttttgtcttaaggtttgttgagctgttttgttcactgtactttaactgtgatatggaaaagactgcattctctgtgctgttactaattaggaaagagaattgctttcattttgtctcttgtttactatagcttcttaaagttaagccttgtactacaggttgttggagtactcctagatcactgtttcatagtagccagcaataagtagtgcaagtcaacaaaaacacagcaaacttaggcaaagtgtcctttctttgagattcgagttctttcatgaggtt

SEQ ID NO: 16072 - DNA, 498 bp, Homo sapiens
cttttttttgacaagatggcggcaggaggcagtggcgttggtgggaagcgcactcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaaagtccctgcccccaaagacgtcctcgcccaccaggtccccaacgccaagaagctcaggcggaaggagcagctatgggagaagctggccaagcagggcgagctgc

SEQ ID NO: 16073 - DNA, 500 bp, Homo sapiens
ataacggccgccatcttaacagcgcgttcccgttggcgtctgaggaacagcatctctgccttcctgttcacggtgaccttcgcttggtgtcctcctggcctcagcaacctgacaattctgtcgtgtcccggtgagcacttcatgcacttgttctggctgtgggtgtcgggtcttgaagtttaagttgtgtcgaggtggaaagaaaccttttcaggtggttgttcgagagcacatggatctgataccatcgaatgcatgagtggatgaatgcacataactgtaaaatttaccaccaaggaaaaacacaggactactcaactgtggttccaggccatcaccagatctcactctagcgccctgtagattcccccagaggttcaaaacgagggcatccccaggaacacggtgcgggctgatttactagcaggagggattgaattgataatgaatgcgaagataacttttgacaggtgggttttctaccagttactcatttgaaa

SEQ ID NO: 16074 - DNA, 276 bp, Homo sapiens
attgattagcatgtatataaagtaaaagtgtgaaatggatataatttcaggctttaacacatattaagacagatttgggattatcatacctagtggattatactatttaaagatagatcatttgttaagaatatggggtaggctgggtgcagtggtcacagctgtaattccagcacttcgggaggctaaggtgggcagatcgcttgaacccaggagttaaaggccagcctgggcaacatggtgaaacctgtctctacaaaaaaaaaaaaagggaaa

SEQ ID NO: 16075 - DNA, 470 bp, Homo sapiens
ttcactagctgtaaaaccttcccctagattttagtagggagttggtttctgttaatatctttgggtgttgtggcggtaaatgctacattataaacagtggcatgtatttacagttagagtatcgtgtgtgcactttttaatggtaaacttaagctgaatgtgtaatggatttgtctatagttttacatatttggaagcattttaaaataggttttaatcttacataaaattacttttatacttgtgttaacattttcttctgtgccttttgggtaatttaatttctgttatgaatttctggtgcctatgagctagctatcacctacccgaaaggtgcttagaggtgaaggtactgtttctaaaaacacatcactgtgacacctttctatcctcacattttcaagcttgcctcttttctgttctttgtggatataacgtaagtaattgtgttattcataaagatttagaaa

SEQ ID NO: 16076 - DNA, 328 bp, Homo sapiens
  misc_feature 201: n=a, g, c or t
acgtacggcagggcggggtcggcccgcagtggccagctgggagctacgagcgcggacttgcgcagaagacccccatcagggtgcggggtgcagttgcggctccagggccatggcggaggagcagggccgggaacgggactcggttcccaagccgtcggtgctgttcctccacccagacccgcgcgcctgcagcgcagsgcncgcgtccaacaccagccgcccagcgccaggtgctcttgccttttcccactgagagaaggctgctcttttgtactgccccccgctcattaaacagcctccccctaaaaaaaaaaaaaattgcgaaaag

SEQ ID NO: 16077 - DNA, 191 bp, Homo sapiens
acgtacggcagggcggggtcggcccgcagtggcagctgggagctacgagcgcggasttgcgcagaagacccccatcagggtgcggggtgcagttgcggctccagggccatggcggaggagcagggccgggaacggactcggttcccaagccgtcggtgctgttcctccacccagacctgggcgcctgcagc

SEQ ID NO: 16078 - DNA, 357 bp, Homo sapiens
aagtgaaatgaagcgtgaataactgcctaattagtggacatgaaaactggacagtctccaaagtcatcagagatgaccacgcttgccaggcaacttactagactaagggcacacaatgagcctcacgtaagcatcaggtactacatttaggaagagagatggtgtgaggatgcagtggccagaagaggcagcccagggaagatctgaggtgaaccctctggttggaaagccttggcaaattggaggaatgaaaagaaaaaagagtaaatctacaacaaggatcagcaaactccagtctacaggccaaatccagcctgctgcctgtttatgtcaataaagttttattggaacataaaa

SEQ ID NO: 16079 - DNA, 430 bp, Homo sapiens
aagactttttgacttgataagtgataactataaagcaatgatttatttttgcattttatttggaatcatacagaacttagaataaacaagtatgtcttacaaagaagtcatctcattcagaatttttatcaatttgtaatacatagtttaaaaagtcaaatagctgggcacggtggctcacgcctgtaatcccaacagtttgggaggctgaggcggacggaccacctgaggtcaggagttcgaaactggccaacatggtgaaacccatctctactaaaagtacaaaaattagctgggcgtgatggcgggcacctgtaatcccagctactcaggaggctgaggctgagacaggwgaatcaccacttgaacccaggaggcagaggttgcagtgagctgagatcatgccactgcactccagcctcggtgacag

SEQ ID NO: 16080 - DNA, 265 bp, Homo sapiens
ttcttcatggtattttcaaactttggataaatttacagattagaaagatatctgacagttaatctctgttctccttacaaattccttttgtgctgctggaaaggatctttggctaggtggatgactagttttattcaaagccttttctcaaaagccctttcagttacaaccaccccactatggaatcagtattagttawwmcatttgtataagaacctgtattttgaaaaacacattcatgtatatttattcctggaattatttg

SEQ ID NO: 16081 - DNA, 415 bp, Homo sapiens
ttcttcatggtattttcaaactttggataaatttacagattagaaagatatctgacagttaatctctgttctccttacaaattccttttgtgctgctggaaaggatctttggctaggtggatgactagttttattcaaagccttttctcaaagccctttcagttacaaccaccccactatggaatcagtatttagttatacatttgtataagaacctgtattttgaaaaacacattcatgtatatttattcctggaattatttgcctgttaaacagtgtctttcatgttctctccccagattgtaaactctgtaagaagctgcttgtatctgtatcccttgttgaaactctgaaaacactgaataactaaaatctcttctcatccttttaaaaaaaaaagaaaaaaaaaaaaaaw

SEQ ID NO: 16082 - DNA, 415 bp, Homo sapiens
ttcttcatggtattttcaaactttggataaatttacagattagaaagatatctgacagttaatctctgttctccttacaaattccttttgtgctgctggaaaggatctttggctagrtggatgactagttttattcaaagccttttctcaaagccctttcagttacaaccaccccactatggaatcagtatttagttatacatttgtataagaacctgtattttgaaaaacacattcatgtatatttattcctggaattatttgcctgttaaacagtgtctttcatgttctctccccagattgtaaactctgtaagaagctgcttgtatctgtatcccttgttgaaactctgaaaacactgaataactaaaatctcttctcatccttttaaaaaaaaaagaaaaaaaaaaaaaaw

SEQ ID NO: 16083 - DNA, 215 bp, Homo sapiens
cataggacaggaaggaatgcaaaactcatttacacagtgctttccagcctttggtgcttacaggaccgcgctgttccggcttcttcacggctgacattcggctaacgagggattactttggccaaaacctttcaaaggatatgcagaaagatggtagggagcatttgggtttgaatctgaatgctatactggatactctgctccggaaagatgag

SEQ ID NO: 16084 - DNA, 52 bp, Homo sapiens
attcgcctccaagtcgccgaagagcgaacaccccaaacaatcccgaagcgcc

SEQ ID NO: 16085 - DNA, 388 bp, Homo sapiens
aacctcttccgtcggctgaattgcggccgtatgcgcggctctgtggagtgcacctggggttgggggcactgtgcccccagcccmctgctcctttggactctacttctgtttgcagccccatttggcctgctgggggagaagacccgccagtgtctctggaggtcatccctaactggctgggccccctgcagaacctgcttcatatacgggcagtgggcaccaattccacactgcactatgtgtggagcarcctggggcctctggcagtggtaatggtggccaccaacaccccccacagcaccctagcgtcaactggagcctcctgctatcccctgagcccgatggggcctgatggtgctcctaaggacagcattcagttttcttctgc

SEQ ID NO: 16086 - DNA, 376 bp, Homo sapiens
cctgagaaagtggaagtaccagagtccttgagcaaagtcttaactcaaaactggcacatgatcgatcactccacagtgtcctatagaccacaaattccacagggtgcagacagtcaagggaatggggacatggataccaaatcttaatagacgtaaagtcatattttgcaagtgtgtgaatgaggaaggagagataatcaggactgtatctgcagcctaccacagaccctcccagccctctttgccaaggctgaggatatttatcacgccccctggtaatcccccaaccctctcctgtggggcaaagagccttgcatcattccttcccccatggggktgggggttgactttgaagagaccaaaaaaaaaaaaaaaa

SEQ ID NO: 16087 - DNA, 499 bp, Homo sapiens
agtctcacagggaataggcagtggatgagtctgaagccacgcccttctgggttccttctactccaccatgctgttcgagatatttgcaagggtcactgtagaccacaagacttctaaaatgcatttctcactttgctatttgtctggaacccctggtgaatgctggaatagagcacctggcttgaggttgagctggggtttgggcatatagttctgctacttccttggcctctcagaatctcagaatctgctcattcttccagtagtgaagatcagagaataaggggtrgggatagagtgaaaactgggctggccgggcttgaaatgcatctctaccacttggcagctctgcgatcccatgattccaagagtctcaaggttagagaagtcgcctagtccacctcccctctctgcttctcacagaagggtctgctgaacactctggtgacagagaactcacccaacatgttccatggcagaggcttttcattagatcaag

SEQ ID NO: 16088 - DNA, 422 bp, Homo sapiens
tttttaacttaaagtgtaaagagtaacattttatcttatgtcaattaaagttacatttttcatttgttggtgtacatgtgctacctgttttatggggaatgtttaacacgatcctccaagttggttctatgcataaccattcaccaaatactgctgctgtgattccttgaaggaaatattctgtggtctgctatgatgcattgccatcttgctgcttgacaataggtttataaataattagaattacgtgttttaatagtacctttgtatatataacaagatgtaaaattaaagatgaggaatgtgtgtaaatgatcattcactgtttttgttttaaaactggtcagtactatgaagcttctgtggtttgtatgatgttttaactttcactttaaactgcatagaataaattaaattgaaaa

SEQ ID NO: 16089 - DNA, 529 bp, Homo sapiens
aaaacgtccaatgtgagtgtgcctgtgcaagcccctggctgtttatactccggaggtgtccccgtgcgtcatcggtggagtggaccaaaactggtgatctgtttgccctgtgtgaccttgcccagaaccctgctgactgagagaacacatctgctggaagtcctctgggattcaaggtacaggggtaagcatgaccttgaatgcagtagcaatgtgctttagccaactaagctggctcatttcatttaccgctctatctcccatggttaagcattaaaaatacatgttgtggctgggcatggtggctcacgcctgtaatcccagcactttgggaggctgaggctggcagattgcctgaggtcaggagttcgagaccagcctggccaacatggtgaaattctgtctctactgaaaatacaaaaattagccgggcatggtggtgcacgcctgtggtcttagctactgggaggactgaggcgggaggaacgcttgaacccgggagcagaggttgcagtgagctgagattgtg

SEQ ID NO: 16090 - DNA, 165 bp, Homo sapiens
  misc_feature 3,22: n=a, g, c or t
aanaaaggatgtgacgtgaganaaccagctcggctgttagcaactctgttagcaaagctgtttgtctttctcggaaacaacattaacgataagcctctttgaatatggaggccgctgcatacggcccggctgagacccaaagcccggtggaaaaagacagcccgg

SEQ ID NO: 16091 - DNA, 302 bp, Homo sapiens
tgccacgccgtgtcagtcgggagggagggagcgagcaggcgagggggaggacggggtgaagatggcggccttctccgagatgggtgtaatgcctgagattgcacaagctgtggaagagatggattggctcctcccaactgatatccaggctgaatctatcccattgatcttaggaggaggtgatgtacttatggctgcagaaacaggaagtggcaaaactggtgcttttagtattccagttatccagatagtttatgaaactctgaaagaccaacaggaaggcaaaaaaaaaaaaaaaaagg

SEQ ID NO: 16092 - DNA, 270 bp, Homo sapiens
  misc_feature 16: n=a, g, c or t
agagcgagcaggcgangaggacggggtgaagatggcggccttctccgagatgggtgtaatgcctgagattgcacaagctgtggaagagatggattggctcctcccaactgatatccaggctgaatctatcccattgatcttaggaggaggtgatgtacttatggctgcagaaacaggaagtggcaaaactggtgcttttagtattccagttatccagatagtttatgaaactctgaaagaccaacaggaaggcaaaawaaaaaaaaaaaa

SEQ ID NO: 16093 - DNA, 454 bp, Homo sapiens
atttcccaactttcttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggagttcacaacctctgtggtccgtagagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctcttggaagtggatcaaactagaactcatatgccatactagatatgtttgtcaataaacttatgacgcaaaaaaaaaaaa

SEQ ID NO: 16094 - DNA, 572 bp, Homo sapiens
aacacacggatgcggaaaccgagacgggctggatggaaaactctttccagacagactccggggccctcaactggtctccgacttcccctgcaacctgcgacacctgccattttcccatcttaggctccagaagcagaatcaagtgggatgtcttggaagaaaaacaaacaaaaggcccactaggtggagtgaaatggatcaggagcaattawgttcaatttcacctttaagttttctcaaaaggaggagcattaagaatcagccaccttagtacatacttaaagatttactgaaacctgatcctgtccccgctgatgaaacatcagaggaatgggatcctgtaggtgaagatcatcagcttataaaatcctgttgccatcaatgggggtagcaggaaaatgatgaagattggttaaggggccagtggactcagcattgaaatgaatcatggacttgaagccaaaagactcagtttgtgtcccagctctctcaagcaaagcccccaaktcccagtttcctcatctataaaaaataataaaaatacttaatggacaaaaaaaaaaaaaaaaaaa

SEQ ID NO: 16095 - DNA, 280 bp, Homo sapiens
caagatcattgctcctcctgagcgcaagtactccgtgtggatcggcggctccatcctggcctcgctgtccaccttccagcagatgtggatcagcaagcaggagtatgacgagtccggcccctccatcgtccaccgcaaatgcttctaggcggactatgacttagttgcgttacaccctttcttgacgaaaacctaacttgcgcagaaaacaagatgagattggcatggctttatttgttttttttgttttgttttggtttttwtttttttttttgggctt

SEQ ID NO: 16096 - DNA, 288 bp, Homo sapiens
ccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtatgaaggctttttggtctccctgggagtgggtggaggcagccagggcttacctgtacactgacttgagaccagttgaataaaagtgcacacctcaaaaaaaaaaaaaaaaaaaaaaaaaaaaaaaaaaaaaaaa

SEQ ID NO: 16097 - DNA, 51 bp, Homo sapiens
accgccgagaccgcgtccgccccgcragcacagagcctcgccttgcagcac

SEQ ID NO: 16098 - DNA, 556 bp, Homo sapiens
aaaaactctttccagacagactccggggccctcaactggtctccgacttcccctgcaacctgcgacacctgccattttcccatcttaggctccagaagcagaatcaagtgggatgtcttggaagaaaaacaaacaaaaggcccactaggtggagtgaaatggatcaggagcaattatgttcaatttcacctttaagttttctcaaaaggaggagcattaagaatcagccaccttagtacatacttaaaggtaaatattacatttaagaaaatccttgttatcttaatgtggcactgagaaaatactatcaagtacagcacgtggactaagttagaacattaaatacacaggatctcttgatagaattatcctcagactttccagttttaatcttctagatttactgaaacctgatcctgtccccgctgatgaaacatcagaggaatgggatcctgtaggtgaagatcatcagcttataaaatcctgttgccatcaatgggggtagcaggaaatgatgaagatttggttwatgggcartgatcagcattgaatgatc

SEQ ID NO: 16099 - DNA, 304 bp, Homo sapiens
  misc_feature 31: n=a, g, c or t
ccacacaggggaggtgatagcattgctttcntgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacacctcaaaaaaaaaaaaaaaaaaaaaaaaaaaaaaaaaaaaaaaaaaaaaaaaaaaaaaaar

SEQ ID NO: 16100 - DNA, 331 bp, Homo sapiens
ccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacacctcaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 16101 - DNA, 93 bp, Homo sapiens
tcttcagaaggagcagcagccaccgaagaggctgaggatttttggtccgcacgctcctgctcctgactcaccgctgttcgctctcgccgagga

SEQ ID NO: 16102 - DNA, 321 bp, Homo sapiens
atctgattagaaccatatctctcgccgcgcggccactcccggccggcgctatttaagcgaggcccgccgcatccgctgcgctgtagcctggaggctccgggcgcggggaagtcatgctcgcttcacggaggcaatagctagccggtgtctgtgggaggttatgtttatttgagacttctccatcgggatcgtctggtgtcaccaagtgtccactggtactgaggtttgctgcctgccttcttgccatgtctaacgaagtagaaacaagtgcaccaatggtcagcccgaccaacaggccgcaccaaaagcaccctcaaaaaa

SEQ ID NO: 16103 - DNA, 470 bp, Homo sapiens
aggacgcctcagccactaggctgcttccggtgtgtcactgaacaccttccccgtaccagcagctggaggatttgtttggtagcacctgggggatggctctgtcccgggcgcacttaggcgggctgtgcggasgcttttaccttccacagtgtccggcacacgcatccttttcgacatcatcacttgacctgctgcaatagacaagtcttgctgtgttgcccaggccggagtgcagtggtgcaatctctgctcagtgcaacctctgcctcctgggttcaagtgatcattctgcctcaggctcctgactaattgggattacaggcatgcaccaccacaccagctaatgtttgtattttcagtggagacggrggttttaccatgttggccaggctggtctcaaactcctgacctcaggtgattcgcctgcctcggcctcccaaagtgctgggtttacaggcgtgasaccgccc

SEQ ID NO: 16104 - DNA, 569 bp, Homo sapiens
attctttcattcaactactgtgcatcaacagcctgccatctaccaccccctcatgaacctccagggcaagctcagtcatctcagaggaagcaaggtgccccaggtaacacagacggctcacagcgaggacccacatgaggtgttattgagcaagacaggaaggcagctttctggataatcgaacgtgctagtgaacagagtgttgccagagatactccaggtgtacactcagatgtatacgtcatatgctccctgagtgattacgtgttccaggctctgagggtaggaaaatgaagacaacagtctctgtctcagggaagctccaggtccacaggggaaaatggaagtcaacgccaagtgtactgcagagtggcaaacaccacagcacaaagtstccagaaacactcatcaggggtcagccatatgctggaaggcaggcaatggcccactccacagggaccctcacaaaacacacaaggcttggatgatgaaggggagatggaaaggctttgtagtttttcagggcaattgtaatgaatggcaattatcatggcaaaaaaaaaaaaaaa

SEQ ID NO: 16105 - DNA, 351 bp, Homo sapiens
acagctggactcagccaacctttatggtttctgtggaatgccatgccaggcgtggggctctgtggagactcaggtgtgrggtctgagagggacacagcaccactatcaaggcaagaggcagctgggaacacgagggtcctgcctctgtctcaaggaccccaggatttcccccagcagctgtcttcctgcctgctttggtttgcgtttttggtttgggtttttttttttttycttttttkggtgtcycwaggstgrggtcatcactgtgtctctcggtctgggtggggcmatctaccctccctgmaastgggagtgtctttgacctcattctataagatacagttcagccta

SEQ ID NO: 16106 - DNA, 517 bp, Homo sapiens
caacagaacggaatttcatggagtggagtgatcacaaatgtcagatatagcagagatctgccacaacaaaaacaccttcaggtattgtcattgggatttcactggtgaccttacaaaagttttttccagtagactggtgagaatggaaaccgaaattcaaattgcactgacgggtggctgagagacaagcatagacagtgagcatagactgttatttgggggaagtataatatacctttgtttattcattcaataaagatttattggccaggtgtggtggcttatgcctgttcggagcactctgggaggctgagatgggtggatcacctgaggtccggagttcaagaccagactggccaatatggtgaaacctgtctctactaaaattacaaaaattagccaggtgtggtggcacatgcctgtaatcccagctgcttgggaggctgaggcatgagawtcgcttgaaactgggaggcagaggttgccaatgagctgagatcgcgccattgcactccag

SEQ ID NO: 16107 - DNA, 466 bp, Homo sapiens
aacccgatgcaaatatttttcttgttggttatttgcctttacttttatttatttgttttgatatgtagatacatttacattttttatgtaatatatctttttaaaaatggtttctgcttttcctgaacatgttttcagaatttaaaattgtatatggaaaacaaattacatgaaagatttgagcatttcaaaattttaaacataaaagcataaacgtagataaaatgaaggtgtactatgatatcttcagttttatcagaaatgatgtaaaaattacaacctctttaaaaagtagtgttaatcattaagttagaaaatatatagctgggcatggtggcagatgctgtaatcccagctacatgggaaggtgaggtgggagaatcgcttgaacccaggcagtggaggatgcagtgagccaagatcatgccactgcaccccagcctgggtgacagacaagactccatct

SEQ ID NO: 16108 - DNA, 272 bp, Homo sapiens
  misc_feature 140: n=a, g, c or t
actctaatctggaaataggtagtcggagaggtggttctgcatggggcctctcacatgtgctacagtcaaacattagccggggccacagtcatctgaaactcacttacatggctgacaattgatgttggctgttgcctggngaagacatatgtggcgtggtggaatggaatggtgactagattcaagaaagagcttcccaggaggaaggctaccaagagaccgaagtagaggcttcagtttcttaaaaaaaaaaataaaaaaaaaaaaaaaaa

SEQ ID NO: 16109 - DNA, 255 bp, Homo sapiens
actctaatctggaaataggtagtcggagaggtggttctgcatggggcstctcacatgtgctacagtcaaacattagccggggccacagtcatctgaaactcacttacatggctgacaattgatgttggctgttgcctggagaagacatatgtggcgtggtggaatggaatggtgactagattcaagaaagagcttcccaggaggaaggctaccaagagaccgaagtagaggcttcagtttcttaaaaaaaaaaat

SEQ ID NO: 16110 - DNA, 233 bp, Homo sapiens
actctaatctggaaataggtagtcggagaggtggttctgcatggggcctctcacatgtgctacagtcaaacattagccggggccacagtcatctgaaactcacttacatggctgacaattgatgttggctgttgcctggagaagacatatgtggcgtggtggaatggaatggtgactagattcaagaaagagcttcccaggaggaaggctaccaagagaccgaagtagaggct

SEQ ID NO: 16111 - DNA, 271 bp, Homo sapiens
actctaatctggaaataggtagtcggagaggtggttctgcatggggcctctcacatgtgctacagtcaaacattagccggggccacagtcatctgaaactcacttacatggctgacaattgatgttggctgttgcctggagaagacatatgtggcgtggtggaatggaatggtgactagattcaagaaagagcttcccaggaggaaggctaccaagagaccgaagtagaggcttcagtttcttaaaaaaaaaaatwaaaaaaaaaaaaaaa

SEQ ID NO: 16112 - DNA, 440 bp, Homo sapiens
agcgaccaggactgtccaacacgcccccgacctccagacaattgaggagttgtccatctggggacacacagcagtgacaaggacgtagcctttcctaatccctgaagagctcttccgcaggtactctgaagggcaattccagcagaatgtacattccatgacatctgggactttgatgcgttgccccagaagataataccagtacctacagcatgttcacctaagcactggtcaagtggatattactcaaccagaatgcaaacatttctattggttttagtaagacctgaaagaggctgggcgcggtggctaacgcctgtaatcccagcagtttgggaggctgaggcgggcggatcatgaggtcagatgatcaagaccatcctggctaacatgtgaaaccccctctctactaaaaatwcaaaaaaaaaaaaaaaaaagct

SEQ ID NO: 16113 - DNA, 76 bp, Homo sapiens
aagaagaggaaagaggaagaagcgctcagatgctccgcggctgtcgtgaaggttaaaaccgaaaataaaaatgggc

SEQ ID NO: 16114 - DNA, 93 bp, Homo sapiens
aagaagaggaaagaggaagaagcgctcagatgctccgcggctgtcgtgaaggttaaaaccgaaaataaaaatgggctagacaaaaaaaaaaaa

SEQ ID NO: 16115 - DNA, 146 bp, Homo sapiens
aagaagaggaaagaggaagaagcgctcagatgctccgcggctgtcgtgaaggttaaaaccgaaaataaaaatgggctagacargggraaaaaaaaaaaaaaaaaaaaaaaaaaaaaaaaaaaaaaaaaaaaaaaaaaaaaaaaaaa

SEQ ID NO: 16116 - DNA, 485 bp, Homo sapiens
actttgccacagggaggcactgaactgaaaaactgccttgtaagaggtgtcgcccctctgtctactccctttcttatatcaagaggggaaaaacacgtaactacctctacccgatctkktcaccatacgcctattacctttactgttacaagtaccggatcactctccgggagaagatgctgcctcgttgttataaaagcatcacttataaggaagaggaggacttgacactccagccccgttcctgcctccagtgctcctgagtccctagtaggcctccaggagggcaaaagcaccgagcagggtaaccacgaccagcttaaagaactgtattcggctgggaacttgacggtgctggctactgaccccctgctccaccaggacccagtacagttagactttcacttccgccttacctcccagacctctgcccattggcacggccttctctgtgaccgtcgactcttcctggatatcccatatca

SEQ ID NO: 16117 - DNA, 528 bp, Homo sapiens
actttgccacagggaggcactgaactgaaaaactgccttgtaagaggtgtcgcccctctgtctactccctttcttatatcaagaggggaaaaacacgtaactacctctacccgatctggtcaccatacgcctattacctttactgttacaagtaccggatcactctccgggagaagatgctgcctcgttgttataaaagcatcacttataaggaagaggaggacttgacactccagccccgttcctgcctccagtgctcctgagtccctagtaggcctccaggagggcaaaagcaccgagcagggtaaccacgaccagcttaaagaactgtattcgtttgactgcaaccctggagtacgtggaagagaagacaaatgtggactctgtgtttgtgaacttccagaatgatcggaacgacagaggtgccctgctgcgggccttcagctacatgggctttgaggtggtcagaccagatcaccctgccctccctcccttggacaatgtcatctttatggtgtatccccttga

SEQ ID NO: 16118 - DNA, 530 bp, Homo sapiens
  misc_feature 526: n=a, g, c or t
actttgccacagggaggcactgaactgaaaaactgccttgtaagaggtgtcgcccctctgtctactccctttcttatatcaagaggggaaaaacacgtaactacctctacccgatctggtcaccatacgcctattacctttactgttacaagtaccggatcactctccgggagaagatgctgcctcgttgttataaaagcatcacttataaggaagaggaggacttgacactccagccccgttcctgcctccagtgctcctgagtccctagtaggcctccaggagggcaaaagcaccgagcagggtaaccacgaccagcttaaagaactgtattcgtttgactgcaaccctggagtacgtggaagagaagacaaatgtggactctgtgtttgtgaacttccagaatgatcggaacgacagaggtgccctgctgcgggccttcagctacatgggctttgaggtggtcagaccagatcaccctgccctccctcccttggacaatgtcatctttatggtgtatcccttnaagg

SEQ ID NO: 16119 - DNA, 740 bp, Homo sapiens
agtttttcttgggctgtttgcaaatttgtttcgcagttaaaaggggatttgccagctgggatgggggaattgggaggcagatggggcttccaggagcgaggatagggtcgttggcctcaggtgccgctctccagttaggagtattttaggcacctcgttccttattgtcaggtttaacttcatttgttctcccactttataccttagtgaatttgtagatgtgacaaggctttcgcagttatatagctttcccagatcagtatgttaagaatttaagcagaagttattgagaaaagcaggtgtcttgctttttcacttttcgttcttctttgctcataaaacctttttctgaatctcgggacgacagttatctttcggatggaacgtgatctggatgtctatctaccttattgacttaatcctgttttgtagtggttggttactcgcactatgcagacgtgttgcggtgctgaatacaacatttattactaaagccagacactggatcaccgtcacggcagatgtcagcacacctgttgtaatcaactcatctttcaagaggactttagactaattgcagataattaagagaatatgccttctgcatcctgtgatacactactggatgacatcgaagatatcgtgtctcaggaagattcaaaaccacaagataggcattttgtaagaaaggatgttgtcccgaaggtacgaaggcgaaatacccaaaaaaaaaaaaaaaa

SEQ ID NO: 16120 - DNA, 327 bp, Homo sapiens
aggtcaggggcgttcccttcatgtcgcggccgcagtagctcctggacgcctccccgaagcagccgtccagcgcccgcccgcagcagagctctgcccggggccgtgacaacgggcgccgccatgttcacaggcacagaatgagacctgagggaggaccccggcgtcggcggcaggaaaggcccccgccagtgctgcctgcgsgcgccgatcacttataaggaagaggaggacttgacactccagccccgttcctgcctccagtgctcctgagtccctagtaggcctccaggagggcaaaagcaccgagcagggtaaccacgaccagck

SEQ ID NO: 16121 - DNA, 395 bp, Homo sapiens
attctttgtactttgaagatctagggattaacagacaagtacagcaacgtgtactagcaaagatgacaggcccaagacacgctaaaactgtaggatttaaaatacgcaaatgtctaacagttggcaaagtatgtgaccaaaaggtgaaggaaatcctgatatcaacttacacttttaaatgctctggaaccaatgagaacaaatacattcatcacaagtaccagctgctcttcttactaaatttaacaataacatgaattttaactcagtgatttccccatcaccaaccccgccaaacacctgtaaatatttaggaaaaacaagctaaaaaaattgaatctaaaaggcaggagaacaaatcattgcaaatcattgtggtgacggactgcacttca

SEQ ID NO: 16122 - DNA, 281 bp, Homo sapiens
gggagttccccggasmaggatcctgcagcccgagtcccgtcctyaggcttccccaatccaggggactcggcgccgggacgctgctatggacgacattttcactcagtgccgggagggcaacgcartyrycrttcgcctgtggctggacaacacggagaacgacctyaaccagggtatcgtcttggatgctttgtgaagagcadgyggaaaggaggcaattgcctarttcatcgtagaagtaatgatgtcttggactagaattaggctcaatgaccattgcc

SEQ ID NO: 16123 - DNA, 272 bp, Homo sapiens
agaggctgcgcacagcggatccggcactcagcgaccggacccaaggatccgccggggaacaagccacaggagagcgactcaggaacaagtgtgggagaggaagcggcggcgcggcgcggcccgggggtggtgacagcaggtctgaggttgcatcataaatacaaaggactgaagttataaaagagaaaagagaagtttgctgctaaaatgaatctgagcaatatggaatattttgtgccacacacaaaaaggtactgaagatttacccccca

SEQ ID NO: 16124 - DNA, 512 bp, Homo sapiens
attatagccatccccactgccaccaaagccaccatgaccactgaagtttcctccactaccagagttgtcattcccactgaaaccacctccacgaccaccacgtttccagaatcacttagcttctttggctggatgaagcactagccatctcttgctttgacagggctttcctaacttcacaattgttgccattcacagtatgatatttctgaatgacagtcttatccacggagttgtggtcgtcaaaggttacaaaggcaaagcccttttcttgccactgcctcggtcagtcatgatttcaatcacttcagtttttcagaactgtttaaaataatctcttaggtgatgttctttagtgtcttctttaatgccaccaacaaatatctttttcacagttaagtgggcacctggtctttaagaatcttctgttgagacagctctctttggttccacaagtcttctgttcaccttgtgtggccttgcattcatggctgcatcctccacctccacag

SEQ ID NO: 16125 - DNA, 313 bp, Homo sapiens
gcttccggtccgcgtgaggtgcattctcgcgccggtggcgaggttagggcccgcgttgcgacgtggtgcagcgcatattttcacaagtgggtctcccttgtccgggactatggccaccgactcgtgggccctggcggtggacgagcaggaagcggctgtcaagtcgatgaccaatttgcagatcaaggaagagaaagtcaaagcagataccaatggtattatcaaaaccagtaccactgccgagaaaacagatgaagaggagaaagaggacagagctgcccagtccttactcaacaagctgatcagaagcaac

SEQ ID NO: 16126 - DNA, 418 bp, Homo sapiens
  misc_feature 94..95,159: n=a, g, c or t
agccttgtagtggggctggagcagagcctgccgcgaacccccggagcccacgatccctcgtgccatccctcgaatccaccagcacgagcgtscnnccgcgcctgggaccatggccactgactcatgggccctggcggtggacgagcaggaagctgcggnctgagtcgttgagcaacttgcatcttaaggaagagaaaatcaaaccagataccaatggtgctgttgtcaagaccaatgccaatgcagagaagacagatgaagaagagaaagaggacagagctgcccagtccttactcaacaagctgatcagaagcaaccttgttgataacacaaaccaagtggaagtcctgcagcgggatccaaactcccctctgtactcggtgaagtcttttgaaagagcttcggctgaaaccacagc

SEQ ID NO: 16127 - DNA, 293 bp, Homo sapiens
attaccttcttgagttgtggctcagacactacaacagagctccgtcacctctttctaaaagctgggaaatggttattgtcaacgccagccccattttggaggcacctggttgcaggggaccacagctagacccgagtcatccctggagtctcacacttgatcttagccaaaaggccgagaagcgatcatccctggagtctctctgaatctgccgtgatcctgggggctgcccgattcgtgcattgttcattgctcaattaaactcctttaaatttaaaaaaaaaaaaaaaaaa

SEQ ID NO: 16128 - DNA, 326 bp, Homo sapiens
attaccttcttgagttgtggctcagacactacaacagagctccgtcacctctttctaaaagctgggaaatggttattgtcaacgccagccccattttggaggcacctggttgcaggggaccacagctagacccgagtcatccctggagtctcacacttgatcttagccaaaaggccgagaagcgatcatccctggagtctctctgaatctgccgtgatcctgggggctgcccgattcgtgcattgttcattgctcaattaaactcctttaaatttaaaaaaaaaaaaaaaaaarrraaaaaaaaaaaaaaaaaaaaaaaaaaaaar

SEQ ID NO: 16129 - DNA, 319 bp, Homo sapiens
  misc_feature 261: n=a, g, c or t
attaccttcttgagttgtggctcagacactacaacagagctccgtcacctctttctaaaagctgggaaatggttattgtcaacgccagccccattttggaggcacctggttgcaggggaccacagctagacccgagtcatccctggagtctcacacttgatcttagccaaaaggccgagaagcgatcatccctggagtctctctgaatctgccgtgatcctgggggctgcccgattcgtgcattgttcattgctcaatbmnrctcctttaaatttaaaaaaaaaaaaaaaaaaaaaaaaaaaaaaaaaaaaaaaaaaaa

SEQ ID NO: 16130 - DNA, 301 bp, Homo sapiens
  misc_feature 192..195: n=a, g, c or t
attaccttcttgagttgtggctcagacactacaacagagctccgtcacctctttctaaaagctgggaaatggttattgtcaacgccagccccattttggaggcacctggttgcaggggaccacagctagacccgagtcatccctggagtctcacacttgatcttagccaaaaggccgagaagcgatcatccnnnnagtctctctgaatctgccgtgatcctgggggctgcccgattcgtgcattgttcattgctcaattaaactcctttaaatttaaaaaaaaaaaaaaaaaaaaaaaaam

SEQ ID NO: 16131 - DNA, 323 bp, Homo sapiens
attaccttcttgagttgtggctcagacactacaacagagctccgtcacctctttctaaaagctgggaaatggttattgtcaacgccagccccattttggaggcacctggttgcaggggaccacagctagacccgagtcatccctggagtctcacacttgatcttagccaaaaggccgagaagcgatcatccctggagtctctctgaatctgccgtgatcctgggggctgcccgattcgtgcattgttcattgctcaattaaactcctttaaatttaaaaaaaaaaaaaaaaaaaaaaaaaaaaaaaaaaaaaaaaaaaaaaaw

SEQ ID NO: 16132 - DNA, 306 bp, Homo sapiens
attaccttcttgagttgtggctcagacactacaacagagctccgtcacctctttctaaaagctgggaaatggttattgtcaacgccagccccattttggaggcacctggttgcaggggaccacagctagacccgagtcatccctggagtctcacacttgatcttagccaaaaggccgagaagcgatcatccctggagtctctctgaatctgccgtgatcctgggggctgcccgattcgtgcattgttcattgctcaattaaactcctttaaatttaaaaaaaaaaaaaaaaaaaaaaaaaaaaaar

SEQ ID NO: 16133 - DNA, 310 bp, Homo sapiens
attaccttcttgagttgtggctcagacactacaacagagctccgtcacctctttctaaaagctgggaaatggttattgtcaacgccagccccattttggaggcacctggttgcaggggaccacagctagacccgagtcatccctggagtctcacacttgatcttagccaaaaggccgagaagcgatcatccctggagtctctctgaatctgccgtgatcctgggggctgcccgattcgtgcattgttcattgctcaattaaactcctttaaatttaaaaaaaaaaaaaaaaaaaaaaaaaaaaaaaaara

SEQ ID NO: 16134 - DNA, 310 bp, Homo sapiens
attaccttcttgagttgtggctcagacactacaacagagctccgtcacctctttctaaaagctgggaaatggttattgtcaacgccagccccattttggaggcacctggttgcaggggaccacagctagacccgagtcatccctggagtctcacacttgatcttagccaaaaggccgagaagcgatcatccctggagtctctctgaatctgccgtgatcctgggggctgcccgattcgtgcattgttcattgctcaattaaactcctttaaatttaaaaaaaaaaaaaaaaaaaaaaaaaaaaaaaaaaw

SEQ ID NO: 16135 - DNA, 341 bp, Homo sapiens
  misc_feature 201: n=a, g, c or t
attaccttcttgagttgtggctcagacactacaacagagctccgtcacctctttctaaaagctgggaaatggttattgtcaacgccagccccattttggaggcacctggttgcaggggaccacagctagacccgagtcatccctggagtctcacacttgatcttagccaaaaggccgagaagcgatcatccctggagtmwntctgaatctgccgtgatcctgggggctgcccgattcgtgcattgttcattgctcaattaaactcctttaaatttaaaaaaaaaaaaaaaaaaaaaaaaaaaaaaaaaaaaaaaaaaaaaaaaaaaaaaaaaaaaaaaaar

SEQ ID NO: 16136 - DNA, 347 bp, Homo sapiens
  misc_feature 237..238,253..254,347: n=a, g, c or t
attaccttcttgagttgtggctcagacactacaacagagctccgtcacctctttctaaaagctgggaaatggttattgtcaacgccagccccattttggaggcacctggttgcaggggaccacagctagacccgagtcatccctggagtctcacacttgatcttagccaaaaggccgagaagcgatcatccctggagtctctctgaatctgccgtgatcctgggggctgcccgathnntgcattgttcattvnncaattaaactcctttaaatttaaaaaaaaaaaaaaaaaaaaaaaaaaaaaaaaaaaaaaaaaaaaaaaaaaaawwwaaaaaaaaaaaaaaaan

SEQ ID NO: 16137 - DNA, 348 bp, Homo sapiens
  misc_feature 265: n=a, g, c or t
attaccktcttgagttgtggctcagacactacaacagagctccgtcacctctttctaaaagctgggaaatggttattgtcaacgccagccccattttggaggcacctggttgcaggggaccacagctagacccgagtcatccctggagtctcacacttgatcttagccaaaaggccgagaagcgatcatccctggagtctctctgaatctgccgtgatcctgggggctgcccgattcgtgcattgttcattgctcaattamrchnkmttaaatttaaaaaaaaaaaakkaaaaaaaaaaaaaaaaaaaaaaaaaaaaaaaaaaaaaaawaaaaaaaaaaaaaaaaaaw

SEQ ID NO: 16138 - DNA, 351 bp, Homo sapiens
attaccttcttgagttgtggctcagacactacaacagagctccgtcacctctttctaaaagctgggaaatggttattgtcaacgccagccccattttggaggcacctggttgcaggggaccacagctagacccgagtcatccctggagtctcacacttgatcttagccaaaaggccgagaagcgatcatccctggagtctctctgaatctgccgtgatcctgggggctgcccgattcgtgcattgttcattgctcaattaaactcctttaaatttaaamamwaaawrwrmaavvarrwamttckcvcadhvhdrgwwaammmwrrawwtammaatamwwwaaaaaaargct

SEQ ID NO: 16139 - DNA, 300 bp, Homo sapiens
attaccttcttgagttgtggctcagacactacaacagagctccgtcacctctttctaaaagctgggaaatggttattgtcaacgccagccccattttggaggcacctggttgcaggggaccacagctagacccgagtcatccctggagtctcacacttgatcttagccaaaaggccgagaagcgatcatccctggagtctctctgaatctgccgtgatcctgggggctgcccgattcgtgcattgttcattgctcaattaaactcctttaaatttaaaaaaaaaaaaaaaaaaaaaaaar

SEQ ID NO: 16140 - DNA, 351 bp, Homo sapiens
attaccttcttgagttgtggctcagacactacaacagagctccgtcacctctttctaaaagctgggaaatggttattgtcaacgccagccccattttggaggcacctggttgcaggggaccacagctagacccgagtcatccctggagtctcacacttgatcttagccaaaaggccgagaagcgatcatccctggagtctctctgaatctgccgtgatcctgggggctgcccgattcgtgcattgktcattgctcaattaaactcctttaaatttaaaaaaaaaaaaaaaaaaaaaaaaaaaaaaaaaaaaaaaaaaaaaaaaaaaaawtwaaaaaaaaaaaaaaaaagct

SEQ ID NO: 16141 - DNA, 327 bp, Homo sapiens
attaccttcttgagttgtggctcagacactacaacagagctccgtcacctctttctaaaagctgggaaatggttattgtcaacgccagccccattttggaggcacctggttgcaggggaccacagctagacccgagtcatccctggagtctcacacttgatcttagccaaaaggccgagaagcgatcatccctggagtctctctgaatctgccgtgatcctgggggctgcccgattcgtgcattgttcattgctcaattaaactcctttaaatttaaaaaaaaaaaaaaaaaaaaaaaaaaaaaaaaaaaaaaaaaaaaaaaaaaaw

SEQ ID NO: 16142 - DNA, 322 bp, Homo sapiens
attaccttcttgagttgtggctcagacactacaacagagctccgtcacctctttctaaaagctgggaaatggttattgtcaacgccagccccattttggaggcacctggttgcaggggaccacagctagacccgagtcatccctggagtctcacacttgatcttagcccaaaaggccgagaagcgatcatccctggagtctctctgaatctgccgtgatcctgggggctgcccgattcgtgcattgttcattgctcaattaaactcctttaaatttaaaaaaaaaaaaaaaaaaaaaaaaaaaaaaraaaaaaaaaaaaaar

SEQ ID NO: 16143 - DNA, 328 bp, Homo sapiens
  misc_feature 278,280..284: n=a, g, c or t
attaccttcttgagttgtggctcagacactacaacagagctccgtcacctctttctaaaagctgggaaatggttattgtcaacgccagccccattttggaggcacctggttgcaggggaccacagctagacccgagtcatccctggagtctcacacttgatcttagccaaaaggccgagaagcgatcatccctggagtctctctgaatctgccgtgatcctgggggctgcccgattcgtgcattgttcattgctcaattaaactcctttaaatttaanbnnnnnaaaaaaaaaaaaaaaaaaaaaaaaaaaaaaaaaaaaaaaaaaaw

SEQ ID NO: 16144 - DNA, 328 bp, Homo sapiens
attaccttcttgagttgtggctcagacactacaacagagctccgtcacctctttctaaaagctgggaaatggttattgtcaacgccagccccattttggaggcacctggttgcaggggaccacagctagacccgagtcatccctggagtctcacacttgatcttagccaaaaggccgagaagcgatcatccctggagtctctctggaatctgccgtgatcctgggggctgcccgattcgtgcattgttcattgctcaattaaactcctttaaatttaaaaaaaaaaaaaraaraaaaaaaaaaaaaaaaaaaaaaaaaaaaaaaaaaw

SEQ ID NO: 16145 - DNA, 354 bp, Homo sapiens
  misc_feature 324..325: n=a, g, c or t
attaccttcttgagttgtggctcagacactacaacagagctccgtcacctctttctaaaagctgggaaatggttattgtcaacgccagccccattttggaggcacctggttgcaggggaccacagctagacccgagtcatccctggagtctcacacttgatcttagccaaaaggccgagaagcgatcatccctggagtctctctgaatctgccgtgatcctgggggctgcccgattcgtgcattgttcattgctcaattaaactcctttaaatttaaaaaaaaaaaaaaaaaamrraaamaaaaaaaasaaaaaawmammaaannrravaawtamaaaaaaaaaaaaaaaagct

SEQ ID NO: 16146 - DNA, 479 bp, Homo sapiens
ttggggaatgggaatgtacctgtaagcaggaatatggaattgttgattgtagccactgtgatgaattaatctattacagcttttcaatttatgtggctattcattcaaggagtagatatgggagactttttctatgccctgagagactccagggagtgtgtattggccctccttctggctacccgttctgtagttcctcttttttggaatctgcatatgtaccaaggcctggagacaggaaaatgaatgctgagggactgactcagtggttctaccatttcccactctcgaatgtgtcagtatgtagcacttcataggcaagcaggttaacctgcatccacttttcagccagttggctttccgagaataggtgcttagggttacttgaatgagaaggtagaaggagggacagagggctggataagccttgctgctgcctaataaatagccatgggagggcccaggctcatattactcat

SEQ ID NO: 16147 - DNA, 410 bp, Homo sapiens
  misc_feature 338: n=a, g, c or t
rgtrccctttcctcctcccaccgcgcaccaaaacatggggtccawgatcttctgtwgttgccgcaagaccagcgaggggtcttccaccactgttggcttccrsaatccaagrrtgttcgaacagcatcatccacggtccttcaatctgaacacaaattctctccacagtgctgtaccaaaaagacatccacgcctcccctatgacaaccgcatgatgctcaaggcgtgcrtccttaggaggccatgagcattctagccggcggacccacgtggtccctgcggctgcacagctgstgggcttccatgaggaagagggcagtggacaggagtcatgawrnctgattcagaarctcccctgcarraggagaagacgtctgagccatccctgtgccaccaccaagagtcactcc

SEQ ID NO: 16148 - DNA, 396 bp, Homo sapiens
gagctgagccctgtgcggccgccgccacaatgggccgcgagtttgggaatctgacgcggatgsgcatgtgatcagctacagcttgtcaccgttcgagcagcgcgcctatccgcacgtcttcactaaaggaatccccaatgttctgcgccgcattcgggagtctttctttcgcgtggtgccgcagtttgtagtgttttatcttatctacacatgggggactgaagagttcgagagatccaagaggaagaatccagctgcctatgaaaatgacaaatgagcaacgcatccggatgacggttccctgtctctgaaagacctttctctggaagaggagtctgcattgtagtgtctcaaagacacaataaacttcctatggtctgcaaaaaaaaaaaaaaa

SEQ ID NO: 16149 - DNA, 393 bp, Homo sapiens
ctcgttggtggggctgggggatgagagctgcaccgcgcgggacaagtcgccggckgccccgacggagcaggtaaaatgtggataatacggccgggcgcggtggttcatgcctgtaatcccagcactttgggagaccgaggcgggtggattgcctgaggtcaggagttcgagaccagtctggccaacatggtgaaaccccgtctctactaaaaaatacaaaataaatttgccaggcatggtggcatgcgactgtaatcccagctactcaggaggctgaggcaggggaattgcttgaaccagggaggtggaggttgcagtgagctgagatcgcaccactgcactccagcctggatggcagagcgagactccgtctcaaaaatacataaataaata

SEQ ID NO: 16150 - DNA, 434 bp, Homo sapiens
tttacctcttctgggccccctgtggacctgcgttgacccagcatggctacaatgggggagttgggtaatcgctcccgttgcatcctgtttctgtctgaaaacccttgtctttctgaatccatctttcagtctctcacattctgtctttcccctcctccttcaccttccctccgtccctctcccttgcgcacttgccgggtaccagctgagtgcatccttttcccaaacctgctctgcttccaaggggcccttttctgtctcctccacctgtccccatgttttggggactgcctggaaatccgggacaccctcctgaggagggagctggtgcccaacggcacttcttaggatgaacccagccagctgcgttcctggcctctgcagaatggcatacagaaggcattttaagcaagcgagctgagctsgacgcagac

SEQ ID NO: 16151 - DNA, 353 bp, Homo sapiens
accccataccccctccccatcttgtgatcaccctcattacctcttctgggccccctgtggacctgcgttgacccagcatggctacaatgggggagttgggtaatcgctcccggtaggttcctccccaacccccgaggcggggtcaggtggagcgtgggcgccagagcagcccctctgccttgggtgtcttggagatgacttggcgccccccggagccccgtcatggctgtggctgcgtccacaacactgcatcagcagagtcctggggaagccatttaggaatctgaagcccgggatttctgctttgtcccttcaggggttcctgagcctgttaaaaaaaaaaaaaaaaaagc

SEQ ID NO: 16152 - DNA, 110 bp, Homo sapiens
attacctcttctgggccccctgtggasctgcgttgacccadcatkgctacaatgggggagttgggtyatcgctcccggtaggttcctcsccaasccccgaggcggggtca

SEQ ID NO: 16153 - DNA, 559 bp, Homo sapiens
aaactgcctgggaatgtagcccactgggtgtcykscycattttactcagcccctattcaagatggagttactctggttcacacacctctgacatgacctccaacaagttgtgaacattgagagaaaacccaaactgcccaagatgaggaagttagtgagaaagtggtacctaaagccatgataccaacgagctctatgcttcttgaaaggtggtaactttgtgagacaagcctcaaattttaccactgtaccaagaaatgaaagccagaatgtggaattggagctggtaatgacgacgtcaggacaggttcaaaggaagcccatcacttgagtaaaaatttatagccctgcttgtgctgtgctgtgctgtgctgtgagtttcagttccgggccagcaaaagatttatcaaaggaaagcaacaaggtgtgtggaaatagaaggggctcttcaatgaccaaaggccataagagactggaaggcaaaaggacccattaatgtaatccaaacatcagtctcctgcagcaaagaggtgawkgagaagggtggagatactgtgga

SEQ ID NO: 16154 - DNA, 193 bp, Homo sapiens
aaactgcctgggaatgtagcccactgggtgtctgcctcattttactcagcccctattcaagatggagttactctggttcacacacctctgacatgacctccaacaagttgtgaacattgagagaaaacccaaactgcccaagatgaggaagttagtgagaaagtgggtaccctaaaaagcccattgataccca

SEQ ID NO: 16155 - DNA, 498 bp, Homo sapiens
aaactgcctgggaatgtagcccactgggtgtctgcctcattttactcagcccctattcaagatggagttactctggttcacacacctctgacatgacctccaacaagttgtgaacattgagagaaaacccaaactgcccaagatgaggaagttagtgagaaagtggtacctaaagccatgataccaacgagctctatgcttcttgaaaggtggtaactttgtgagacaagcctcaaattttaccactgtaccaagaaatgaaagccagaatgtggaattggagctggtaatgacgacgtcaggacaggttcaaaggaagcccatcacttgagtaaaaatttatagccctgcttgtgctgtgctgtgctgtgctgtgagtttcagttccgggccagcaaaagatttatcaaaggaaagcaacaaggtgtgtggaaatagaaggggctcttcaatgaccaaaggccataagagactggaaggcaaaaggaccccattaat

SEQ ID NO: 16156 - DNA, 390 bp, Homo sapiens
aacaaggtcgtgaaaaaaaaggtcttggtgaggtgccgccatttcatctgtcctcattctctgcgcctttcgcagagcttccagcagcggtagggggggccaagagcatccggagttcacaacctctgtggtccgtagagccactatgaggagggccctgggaagaatttgccattttsagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatctttgtcaat

SEQ ID NO: 16157 - DNA, 512 bp, Homo sapiens
  misc_feature 298: n=a, g, c or t
agcctgaggcatctaagaaaagctgtaagggtctcatcaagcagcatatacctcagctgcaagtcacagctgaccacaaagattctgccttctctagtgaggtcagcctgccttaaaggaccagccctctaaggggtatattggcttgcctgatggaagagaaagtcagatgcaggctcaattttcctttaggcctctccttgctttcctcctgtgcccaaagtcaatgattttctaagagtcctctttactgattgccttgggctccactagttatgggatgaaaacttgaattgancagcagccaggacattggggtgacacagcatcttctacaaataaatctgtcagaggtatttgctggtgattgctgcacagtaagccaggctagaactcgatgacgtaaatgaataagcatttattactgcttactagtctattggtctgctgcatagttctggtctctgaaagaatcaggcatctacggtcagctgtgagccaactgtgagcaa

SEQ ID NO: 16158 - DNA, 476 bp, Homo sapiens
ctcctgaccttaggctatccaaccgccttggcctccttaagtgctgggattacaggcatgagccaccacacccggcctgttatccttaattttaaatcacatgtggattgacaagtccaaaactctaagagagctctcattagctgtgaaacatgtacccaaggttcaagatcctgacattttgctacggtgagaatagtaactgaaactggtgtagtgtctttcaatggggctcaagggcagttgttctctgctgtcttttacaaaagagctagtctcggccgggcacagtgacttgcgcctgtaatggtagcactttgggaggctgaggcgggcggatcgctgaggtcgggagtttgagaccatcctggccagcgtggtgaaacccatctctactaaaaatgcaaaaattggccgggcatggtgacacatgcctgtagtcccagctacttggaaggctgaggcaggagaatcgc

SEQ ID NO: 16159 - DNA, 523 bp, Homo sapiens
tgtattccaggcgcctgcaactaaacgtggccgggtctgcaagctaggtgccagcggggaaagtttccctgcttcttatcgtctgctttaacgccttaaatagcccgctgaaggctgcagcaggtgctaggtagcagcctcccggccctcgggaaaggcggggtggggaggcgagagcagcttagcctcctcgacctcccttcctggtgacggacgaacagttcccgtagaatttcgcttcaccgagtgaccttgagcccagggcgacggtcagcttgttaattcctggctgcaggaactttgtgagaattttaatgcatggaaaagctgtccatgttccaactgctgtacatccaaaagtctcagtgtaatagcaggaccaaaatattctgtcaatcagctgaccatatacttaatgactcctaaaatctcgtggacttctaagaaagcgccatggcctgtgctgctgttatgattcctgggttgttgcggtgctctgttggagccatccgtattgaggctg

SEQ ID NO: 16160 - DNA, 157 bp, Homo sapiens
cttaaagaagcatgctactaattgctttttttctaaattaaaactatgtactgtggtaaattaaaaatctgcaggaaaaattgcttagtgttttagcacaataagaatttttattactcaggagtttggagacccagtctgggcagtacggtgaaac

SEQ ID NO: 16161 - DNA, 201 bp, Homo sapiens
cttaaagaagcatgctactaattgctttttttctaaattaaaactatgtactgtggtaaattaaaaatctgcaggaaaaattgcttagtgttttagcacaataagaatttttattactcaggagttggagaccagtctgggcagtacggtgaaacctgtcgctactaaaatacaaaaaaaaaaaaaaaaaaaaaaaaaaaa

SEQ ID NO: 16162 - DNA, 202 bp, Homo sapiens
cttaaagaagcatgctactaattgctttttttctaaattaaaactatgtactgtggtaaattaaaaatctgcaggaaaaattgcttagtgttttagcacaataagaatttttattactcaggagttggagaccagtctgggcagtacggtgaaaccctgtcgctactaaaatacaaaaaaaaaaaaaaaaaaaaaaaaaaaa

SEQ ID NO: 16163 - DNA, 201 bp, Homo sapiens; identical to SEQ ID NO: 16161

SEQ ID NO: 16164 - DNA, 201 bp, Homo sapiens
cttaaagaagcatgctactaattgctttttttctaaattaaaactatgtactgtggtaaattaaaaatctgcaggaaaaattgcttagtgttttagcacaataagaatttttattactcaggagktggagaccagtctgggcagtacggtgaaacctgtcgctactaaaatacaaaaaaaaaaaaaaaaaaaaaaaaaaaa

SEQ ID NO: 16165 - DNA, 201 bp, Homo sapiens; identical to SEQ ID NO: 16161

SEQ ID NO: 16166 - DNA, 200 bp, Homo sapiens
cttaaagaagcatgctactaattgctttttttctaaattaaaactatgtactgtggtaaattaaaaatctgcaggaaaaattgcttagtgttttagcacaataagaatttttattactcaggagttggagaccagtctgggcagtacggtgaaacctgtcgctactaaaatacaaaaaaaaaaaaaaaaaaaaaaaaaaa

SEQ ID NO: 16167 - DNA, 202 bp, Homo sapiens; identical to SEQ ID NO: 16162

SEQ ID NO: 16168 - DNA, 527 bp, Homo sapiens
tatgtgccaccttccatcccctttcccagcagatggtaattgatgcaatttgagaatagaacacttcattgaaacaagtcactggaggtcctctggggatgcagcttaaaagcccaggatcaggccaggtgtggtggctcacgcctgtaatcccagcactgtgggagactgagacgggcagatcacctgaagtcaggagttcgagaccagcctggccaatatagagaaaccccgtctgtactaaaaatacaaaaattaggtctgggcggtggctcacgcccgtaatcctagcactttgggaggccgagaaaggtggatcacgaggtcaggagttcgagaccagcctggccaacatggtgaaacccgtctctactaaaaatacaaaaattgggtgtggtggtacatgcctgtaatcccagctgcttaggaggctgaggcaggagaatcacttgaacccaaaaggcagaggttgcagtgagccgagatcacgccactgcactccagcctggcaacagagcgagactctg

SEQ ID NO: 16169 - DNA, 489 bp, Homo sapiens
ttcttctagcattaaatattttcagagatctcagtaaaaagcatttctagcagcaagaccaaaggcctaagatgagaaatatttggcatggtgagcttgagggacagtagtcaggcagacaagagtatcagacatgccagagcatttggggcctgtaggtaaggagcatgttttgattatatatatttgtatgtgtttgattatattttataattttactttgatattcaaattgtactgatccaaaaataagggagggacaaatcttggccattgtagtatgagagatgtaaatttacaactcagaatccctgcttatcacttctccttcagcacacaactgtttcattttctatttaagaaacttcctctcactgcaaaaagacattctggctgataaagttagcctataatttcagtaaatctaagaatatgactaatggaagttgccagacctaaactttgaaaattattgttccactgaagagc

SEQ ID NO: 16170 - DNA, 409 bp, Homo sapiens
  misc_feature 386: n=a, g, c or t
aattttcggtactggtgccatcacaactgctgatcgtttctgcaggattccagaaaataatgtatccatgatacagagtgtatacaagttttgcgattacgccttctgcgtaacagtcagtcccaccgcagtttaacccacaaggaattttctcttgtcctaaactattatggccttctttgtccgattgaacggaggtaacgaagtctcgtcttccgccagtcgtccgggcgaasagtctggagccgctccggagcgcgcgttgtgattggctcttayattacttttctacctaattcgtatccttggggtgacagattttccccactacaaggaagactgggaagttctaagcaccgtcctttggcaggaaaaaacaaacaaancaaracaaaaaaacagaaggccg

SEQ ID NO: 16171 - DNA, 492 bp, Homo sapiens
attttgattggtgttggatttatttgtaggagaggctcctgagcgctaggtccgcactgtggtgactgaacccagaagtcggggagcagttgtsctccgctgcacagaggctactctggagctctgtgacggcgcccagcgtgacccactcctgggccaggatacggaccgtcgtgcccatatctcctggctggtcgccctatcctcccgactctgcttaaaaccacgtggttcgatggctgccgcggctacstgaggctctccgctcagggcacagtgacttttgaagatgtggctgtgaactttacctgggaggaatggaatctccttagtgaggctcagagatgcctgtaccgtgatgtgacgctggagaacctggcacttatatcctccctggcagcttcttcttggcacaatcctgaactgggcagaacgtccttcccaaactcggcggaagacaaatggctcctgtgacaccctgaggcttacgtt

SEQ ID NO: 16172 - DNA, 489 bp, Homo sapiens
agtagcgaccatttccattggcgttagggagtccttggagcgctgtgttgggaccgtggtggtgactggatccaggaggtcgagagtcgttcttctctttgcacagacgtgactctgcagctctttaacggcgcccgctgctctcaacccagcttaccccacgtggtcccatggcggcggccgcgctaaggttccccgttcaggcacagtgacttttgaagacgtggctgtgaaatttacccaggaggaatggaatctccttagtgaggctcagagatgcctgtaccgtgatgtgacgctggagaacctggcacttatgtcctccctggggaaagaaacagtagctccactcctgccggtccctcccctaggggagagggaagcagaggagaaaacagcagcataggtggctggcaaagacaaaggaaagaccagtagaagagaaagaaaccaaaaacagcaagcgcgagccaaacagccaggcaggta

SEQ ID NO: 16173 - DNA, 479 bp, Homo sapiens
atcatctaggttttcagccctgcatgcattaggctggagtgcagtggtgtgatctcggctgactgcaacctccgcctcccgggttcaagcgattctcctgcttcagcctcccgtgtagctgggattacaggcatgcaccaccacctccagcaaatttttgcatttttagtggagacactgattcaccatgtatcccatgctttttgatcagactaaaccatctactccttatcttgggatctgcctatggggagaagtgggtcgtagmagactctaaggtgtttgtggccaccaggatgaagacaagaacagagaatgagaggtagtctgaattgtcctgccaggcagtaataccaccttcttgtgaaaaggagattctatctatgtcctcaatgctgatgaatcatcttttccctcttccttttatgactgttatgagtgttgagagtttaaagctattcattccagcatgctgccac

SEQ ID NO: 16174 - DNA, 333 bp, Homo sapiens
  misc_feature 15,78,239: n=a, g, c or t
aagatttttcaagcnagatgaagtccatcatcctctttgtcctttccctgctccttatcttggagaagcaagcagctntgatgggacaaaaaggtggatcaaaaggccaattgccaagcggatcttcccaatttccacatggacaaaagggccagcactattttggacaaaaagaccaacaacatactaaatccaaagdcagtttttctattcaacacacatatcatgtagacatcaanyratcatgactggacccgaaaaagtcagcaatatgatttgaatgccctacataaggcgacaaaatcaaaacaacacctaggtggaagtcaacaa

SEQ ID NO: 16175 - DNA, 400 bp, Homo sapiens
  misc_feature 237..240,326..327: n=a, g, c or t
aagatttttcaagcaagatgaagtccatcatcctctttgtcctttccctgctccttatcttggagaagcaagcagctgtgatgggacaaaaaggtggatcaaaaggccaattgccaagcggatcttcccaatttccacatggacaaaagggccagcactattttggacaaaaagaccaacaacatactaaatccaaaggcagtttttctattcaacacacatatcatgtagacatcnnnnmrdcatgactggacccgaaaaagtcagcaatatgrtttgaatgccctacataaggsgacaaaatcaaaacarcacctaggtgggannadacaactgctcaaaattataaacaagaaggcagagaccatgataaatcaaaaggtcattttcacatgatagt

SEQ ID NO: 16176 - DNA, 504 bp, Homo sapiens
aagcctttggattacagctctgatgtttctggtagccatctttttctaatatctctgtgaaggtcaacccctgactcctaaggtaaccttttaaggtggagaccggtggcctgtttggggcagttcccctctagagggagaatttgtctctgaagtaccaggagactgcaggagattttcctgtgcttttcctacccagacaccagcccagaactcaggtgacttcaggagcgttcacatcctgtttggaaacaaagtctgcaaattgtttaataggccgagccttgatatccgcatccctctcagctctatcacaggtctgctttgctgttttctcttggctgtgacagtccgcctgatggtcattataacagcagttcaccattagtacaaacaagagtaccatacataaattctgtgcgcggtttaccaacatcatcaaaaagttatattgttctactgttctcattctttacttgatcacatcattaatcatatcaacat

SEQ ID NO: 16177 - DNA, 418 bp, Homo sapiens
  misc_feature 306: n=a, g, c or t
agatttttcaagcaagatgaagtccatcatcctctttgtcctttccctgctccttatcttggagaagcaagcagctgtgatgggacaaaaaggtggatcaaaaggccaattgccaagcggatcttcccaatttccacatggraaaaaagggccagcactattttggacaaaaagaccaacaacatactaaatccaaaggcagtttttctattcaacacacatatcatgtagacatcaatgatcatgactggacccgaaaaagtcagcagtatgatttgaatgccctacataaggcgacaaaatcanaaacaacacctaggtggragtcaacaactgctcaattataacaagaaggcagagacccatgataaatcaaaaggtcattttcacatgatagttatacatcataaaggaggcc

SEQ ID NO: 16178 - DNA, 531 bp, Homo sapiens
cttttttccctgggtgcccacatgaacagagacaccaggatgctctcctgagaccacagcaactgcagaagctgaagacatttccagaagttcaagcttccaccctctgcaggtccccactgagctgggacccaggtcatccaccccaccccaaatccctggataggaaacccctttctcctcctgctccttgtccccttcatccctgccgcccagcatcctactggcctcagcacctgtggccagaccgtccaagatcctctgaaggcccagctcttgctgtccaccccggcagtaggcaggcagcctggccatgtgccctccggtcagcrtgcggtatgaggaagagggcatgtcctacctctacgcctcctggatgtatcagcttcaacatggagatcagctaagcatttgcttcacctgcttcaaggctgcctttctagactttaaagacttgctggagtcagargactgggragaagacaactgggacctgagctgatggagcacactgaggcagagtcagagcag

SEQ ID NO: 16179 - DNA, 403 bp, Homo sapiens
aatggctgcccccagctggcgcggggctaggcttgttcaatcggtgttaagagtctggcaggtgggccctcatgtcgcgagggagcgggtgatccctttttcctcactcttaggcttccaacggaggtgcgtgtcctgcgtcgcggggtccgctttctctggtccccgcttggcctcggcttctcgcagtaatggccagggctctgccwrmmcmacttcctcggattctctcagcccgacagttcggtgactccttgcgtccccgcggtgtccatgaacagagatgagcaggatgtcctcttggtccatcaccctgatatgcctgagaattcccgggtcctacgagtggtcctcctgggasccccgaatgcagggaagtcaacactctccaaccagctactgg

SEQ ID NO: 16180 - DNA, 494 bp, Homo sapiens
ttttaacttctctctataaggaactgatttcatctgaaattgaagagacaatcagagaaaaactatagaccactcatgatggttgttatatgtgcttggstgggccatgggtcccagtgtttggtgaaacacagcagcagatgtccctgtgagtagatgttgctttgaaggtatcttttagatgtgatgaacatttgtcatcagtagactttgagtaaggcagatagcccgtcacaatgtggatgggccttatccaattagttgaaggcctttgaaaaaagactgagatcccaaacgaagaaggaattctgcctccagacagccttccaactcaagtagcaacataacctcctccctgcggctctagcctgctggcctttcctatagacttcagacttgccagccccacaatcatgtaagccaattccttaaaataaattctctgtcctgtttttgccccctctctctttctgacagcacacacatgccctctt

SEQ ID NO: 16181 - DNA, 396 bp, Homo sapiens
  misc_feature 390: n=a, g, c or t
actatgctcaagtccaggcaacgtacaggcaggggaaatgtctcttccaaggctaaaagtaaacatcagaacatatgataattccattccaatcaktgaatcaagcagaaaatcatggaatcaaaaacactttgctttgacatttcccaaaccactccagagaggtacaaatgataaatcaagacctttgaaatcacaaataacagttactagacatgacaaaagaaaactagaagaaggccagaaaccagctcataaatggataaggcattctttcagaaaaattttgcaatggccacccatttacacagctgccagggaacagactccattcagacatctttatacttccaaaacccatcttaaaaaagcagaatataaaaagtccanagatga

SEQ ID NO: 16182 - DNA, 547 bp, Homo sapiens
aggtatctaggtatcctcccatctcaggccagactggagattgagcgcctgttgtatacgggccctgggctaaccctccccccatcacacaactcaacagcaacgcccaagccacaacttctctggacctcaggttccctacctgcaaaacagtttgcacctcctccctccacaaaactgcaaccggggccggcgcggtggctcacgcctgtcatcttaacaccttgggaggcggaggtgggcggatcatcagaggtcaggagttcgagaccagcctggccaacaaggtgaaaccccatctgtactaaaaatacagaaatcagccgggcatggtggctcgcgcctgtagtcccagctacttgggaggctgaggtaggagaatcgcttgaatccgggaggtggaagtcgcagtgagccgagatcgcgccactgcactccagcctgggtgacacagtgagactccacctcaaaaacaaaacaaaacaaaaaactgcccgcagagagctgcccccgaccacaaggcctgaatccagccttccagccccag

SEQ ID NO: 16183 - DNA, 481 bp, Homo sapiens
caacagttcagcaagaaacatgttattcgatccattcactgaggaggaaactgaaatcactcggagaggaggagtgattcagccccaaattccaaagtgacaggggtatatgtcagagccattcttccagatcagatgacctgttaaactgagacttctgcaccatctgaaccatcagtcactcatctgaaccatcagtcactctctggcccagagaggtggtgttatttgccaaggacacacagcaggtggccaagatggagccaagccattttccccactgcagggacccctgatctccattcccctggacatctcaagggcacaaattctctggacacacggagggaataatgctgacattttatagaagctgacccactggatatccttctcacccaactccattaggctggggagagtaagaggcacggtgacaaggtggcaaagatgtcaccatgccatccaatcacgaggtctc

SEQ ID NO: 16184 - DNA, 409 bp, Homo sapiens
gagaattttctgcaagamataaaaaatgcaaaatcagaagcaagtatttataagaatagcttgtcagaaattggcaaggaatgtgaaatgttatcaaaaatggtaatggaaaccaaaacagataatcagattctaaaagaagaactaaagaaacatagtcaagaaaatataaaatttgaaaacagcatcagtagacttactgaagacaaaatacttttagaaaattacgtaagaagcatagaaaatgaaagggataccttggaatttgagatgcggcatcttcaacgagaatatttaagtttaagtgataaaatttgtaatcagcataatgacccttcaaaaacaacttatatttcaagaagagagaaattccattttgacaactatactcacgaagatacttctagtc

SEQ ID NO: 16185 - DNA, 413 bp, Homo sapiens
ctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtgggatgagtctgctactagtcttatcagctcttaaaaacagaaactcatctgtccaagttcgtggcagaaaggaacgtccttgtgaagacctttatctgagccactgtacttcgttatcactgccatgcagtttacatgagctgttctgcagctcaaatttccattttgtgaatgggtttttttttttaataaactgtattaacaaaaaaaaaaaaaaaaag

SEQ ID NO: 16186 - DNA, 431 bp, Homo sapiens
tacaaatactcatcttgatgtgtttaaacatgttgagacagttctgtctgaggtgaggaacaaattaaggatagatacattggtttcttattaatttagtgtttaagacagtgcttatttccttggggaaaaatactgtaaagaaaaagaaaacacctggtacggtgagtcacgcctgttaatcccagcactttgggaggccaaggcgagtggatcatgaggtcaggagatggagaccatcctggctaacacggtgaaacccttctctactaaaaatacaaaaaattagccgggcgtggtggtgggcactgtagtcccagctgctcgggaggctgaggcaggagaatggtgtgaacctgggaggtggagcttgcagtgagtggagatggtgccactgcactccagcctgggtgacagagtgagactctgtc

SEQ ID NO: 16187 - DNA, 199 bp, Homo sapiens
agagtcgcacgcgcrgggaaggtgtgagtcgtgaacggcccgggtctccgccatggcctctctactcgccaaggacgcctacctgcagagcctggccaagaagatctgctcccattcggccccggaacagcaggcgcgcacsggctggcaaaactcaaggctcagaaactgcagggcccccaaaaaaaaaaaaaaaaag

SEQ ID NO: 16188 - DNA, 464 bp, Homo sapiens
tagaaggtggagatgctggcaacagggaggaccarattccaaaccaggcttattagaagaatgaactaaggtgagagacctcatcctgagaaaggttgagttaatgttagagtataagtggtggtaatcttgaatacttttcccattaaatattgatgggggtttgaattttaatcagtgcttttgtggggagtgggggtcaactatcttaatgattacagttggtttgtttactgcttttgaggacctttctggaggaaaggaaaagcctgttttggggagtctttaaagatggaaattgggtggtcttaaaaatgtaaactcaatcattactttataactgcctagtttatgttaattgttagctgcctaaagtgttttctaatggttttctttttttcctttcaggtgtctaccatgattatttttctaagctggttggttaataaacagtacctgctctc

SEQ ID NO: 16189 - DNA, 265 bp, Homo sapiens
aacttcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaagctggcaac

SEQ ID NO: 16190 - DNA, 458 bp, Homo sapiens
atttaaatagttccaagtaggggagaccagctgcccctgaaccccagaacaaccagctggatcaattctcataggagccacagcgcggagactgtgaaacatggttccaaaactgttcacttcccaaatttgtctgcttcttctgttggggcttctggctgtggagggctcactccatgtcaaacctccacagtttacctgggctcaggggtttgacgtccatcagtaggaaccagctccaatgcaccaatgcaatgcgggtatgcgcagacaccagcaaacatgttctatatagttgcatgtgacaacagggatcaacgacgggaccctccacagtatccagtggttccagttcacctgcataccatcatctaagctcctgtatcagcactcctcatcatcactcatctgccaagctcctcaatcatagccaagatcccatccctccatgtactctg

SEQ ID NO: 16191 - DNA, 477 bp, Homo sapiens
aagaagacctcccgctaccctggagagctgggtttaagacatttgccagcacaccactgcccagggaccagtctcagctccagagctgtgggttattggtaaaggatgtgatttcattgagcctcagtttctgtatctgtaaagcaggaatctatcacttatgaaatatcctgtgcaggcacaatcttaggtgtggaggatacaatacaactctttgtaatagttaattttatgcatcaacttgactggatcacagtgtgcccagatatttgatcaaacattattctgagtgtttccgtgacaatgtttttggatacaatcaacatttatttaattggttgaagacctgaatagaacaaagagttcaattctctcaagtaagagaagtcctcctgtctgactacttcagaattgggacatatcgataccgtcgacctcgagggggggcccggtacccaattcgccctatagtgagtc

SEQ ID NO: 16192 - DNA, 488 bp, Homo sapiens
atttacaccatcgacatcagcaaatgcaaccaagacctcccgctaccctggagagctgggtttaagacatttgccagcacaccactgcccagggaccagtctcagctccagagctgtgggttattggtaaaggatgtgatttcattgagcctcagtttctgtatctgtaaagcaggaatctatcacttatgaaatatcctgtgcaggcacaatcttaggtgtggaggatacaatacaactctttgtaatagttaattttatgcatcaacttgactggatcacagtgtgcccagatatttgatcaaacattattctgagtgtttccgtgacaatgtttttggatacaatcaacatttatttaattggttgaagacctgaatagaacaaagagttcaattctctcaagtaagagaagtcctcctgtctgactacttcagaattgggacattggctttttcctgcctctacactacaactacaccatcaag

SEQ ID NO: 16193 - DNA, 211 bp, Homo sapiens
aagaagacctcccgctaccctrggagagctgggtttaagasatttgccagcacaccactgcccagggaccagtctcagctccagagctgtgggttattggtaaggatgtgatttcattgagcctcagtttctgtatctgtaaagcaggaatctatcacttatgaaaatatcctgtgcagggcacaaatcttaggtgtgggagggatacaat

SEQ ID NO: 16194 - DNA, 461 bp, Homo sapiens
attttttcccatctttcttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtagagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgcaaaaaaaaaaaaaaaa

SEQ ID NO: 16195 - DNA, 447 bp, Homo sapiens
acaagcaccctgagaggaagttaaggatattatccttttcagcactggtctttgtaatagttaattttatgcatcaacttgactggatcacagtgtgcccagatatttgatcaaacattattctgagtgtttccgtgacaatgtttttggatacaatcaacatttatttaattggttgaagacctgaatagaacaaagagttcaattctctcaagtaagagaagtcctcctgtctgactacttcagaattgggacattggctttttcctgcctctacactacaactacaccatcaagccttcagacatggaaaggaaccacactattggctctcctcggtcttcagcttgccaactcaatgcagatctttgcatttgtcagccttataaccatgtgagctaattccctaaaataaatgtcctcatttaaatgtaaaaaaaaaaaaaa

SEQ ID NO: 16196 - DNA, 493 bp, Homo sapiens
tcaggctttttgactacttcggctctaggctctgttcatactgcatttacaagcaagagcaaggaggccagggcaaaatagcttttattttattagaaagttcagtacctttccacaaacttcccattgcatcttactcaccaaaattgggtcaattccacactagttgcaagggagggtgaggacatgaacatccagcaaaggggaaacaaatagttttaattggattagacccataatgacttatcattgagacttcacatactgctgaaacaaaactgttcagcttataaggaagaagaaagggatgacaaattgattgctaacatattctgccatagaaggcagttatttaattttccaaactcattgacatttagattatgtatactctgtgctattaaaaataatacttcaggccaggcgctgtggctcacgcctgtggtcccagcactttgggaggctgaggcaggcggatcatgaggtcaggaga

SEQ ID NO: 16197 - DNA, 369 bp, Homo sapiens
attttgctctggacgcactgatgttcccggctcgccgccgtgccgcagtcacgaggctctccgaacgcctttcactgtgtttctgtttacattcgcgtctgcaagmccggcggcgcgaccgaggcccgaacagatggagatgggctgccatgttgtgagctgccccatggggaagaggctcacatgtgaggaactgagggaggcctccagaaaacagccagtgaagaactgagaccctcagtccaatagcctatgaggaactgaatcctgctgacaaccatatgaatgagcttggaagcagatccttccccagtgaagccttcatgtgagactgcagcccacttgacactttgatttgtagcttgtgac

SEQ ID NO: 16198 - DNA, 441 bp, Homo sapiens
attttgctctggacgcactgatgttcccggctcgccgccgtgccgcagtcacgaggctctccgaacgcctttcactgtgtttctgtttacattcgcgtctgcaagmccggcggcgcgaccgaggcccgaacagatggagatgggctgccatgttgtgagctgccccatggggaagaggctcacatgtgaggaactgagggaggcctccagaaaacagccagtgaagaactgagaccctcagtccaatagcctatgaggaactgaatcctgctgacaaccatatgaatgagcttggaagcagatccttccccagtgaagccttcatgtgagactgcagcccacttgacactttggatttgtagcttgtgacagaccccaagccagaagagtcaggtaagcagtgcctgcactcctgacccatggcaactggcatgataaatg

SEQ ID NO: 16199 - DNA, 478 bp, Homo sapiens
attttgctctggacgcactgatgttcccggctcgccgccgtgccgcagtcacgaggctctccgaacgcctttcactgtgtttctgtttacattcgcgtctgcaagaccggcggcgcgaccgaggcccgaacagatggagatgggctgccatgttgtgagctgccccatggggaagaggctcacatgtgaggaactgagggaggcctccagaaaacagccagtgaagaactgagaccctcagtccaatagcctatgaggaactgaatcctgctgacaaccatatgaatgagcttggaagcagatccttccccagtgaagccttcatgtgagactgcagcccacttgacactttgatttgtagcttgtgacagaccccaagccagaagagtcaggtaagcagtgcctgcactcctgacccatggcaactggcatgataaatgttttttcccatgaagctatgttttagagtaatttgttt

SEQ ID NO: 16200 - DNA, 435 bp, Homo sapiens
attttgctctggacgsactgatgttcccggctcgccgccgtgccgcagtcacgaggctctccgaacgcctttcactgtgtttctgtttacattcgcgtctgcaagaccggcggcgcgaccgaggcccgaacagatggagatgggctgccatgttgtgagctgcsccatggggaagaggctcacatgtgaggaactgagggaggcctccagaaaacagccagtgaagaactgagaccctcagtccaatagcctatgaggaactgaatcctgctgacaaccatatgaatgagcttggaagcagatccttcsssagtgaagccttcatgtgagactgcagcccacttgacactttgatttgtagcttgtgacagaccccaagccagaagagtcaggtaagcagtgcctgcactcctgacccatggcaactggsatgat

SEQ ID NO: 16201 - DNA, 451 bp, Homo sapiens
attttgctctggacgcactgatgttcccggctcgccgccgtgccgcagtcacgaggctctccgaacgcctttcactgtgtttctgtttacattcgcgtctgcaagaccggcggcgcgaccgaggcccgaacagatggagatgggctgccatgttgtgagctgccccatggggaagaggctcacatgtgaggaactgagggaggcctccagaaaacagccagtgaagaactgagaccctcagtccaatagcctatgaggaactgaatcctgctgacaaccatatgaatgagcttggaagcagatccttccccagtgaagccttcatgtgagactgcagcccacttgacactttgatttgtagcttgtgacaggaccccaagccagaagagtcaggtaagcagtgcctgsactcctgacccatggcaactggcatgataaatgttttttccca

SEQ ID NO: 16202 - DNA, 492 bp, Homo sapiens
attttgctctggacgcactgatgttcccggctcgcgccgtgccgcagtcacgaggctctccgaacgcctttcactgtgtttctgtttacattcgcgtctgcaagacccggcggcgcgaccgaggcccgaacagatggagatgggctgccatgttgtgagctgccccatggggaagaggctcacatgtgaggaactgagggaggcctccagaaaacagccagtgaagaactgagaccctcagtccaatagcctatgaggaactgaatcctgctgacaaccatatgaatgagcttggaagcagatccttccccagtgaagccttcatgtgagactgcagcccacttgacactttgatttgtagcttgtgacagaccccaagccagaagagtcaggtaagcagtgcctgcactcctgacccatggcaactggcatgataaatgttttttcccatgaagctatgttttagagtaatttgttttgcagcaatagata

SEQ ID NO: 16203 - DNA, 364 bp, Homo sapiens
attttgctctggacgcactgatgttcccggctcgccgccgtgccgcagtcacgaggctctccgaacgcctttcactgtgtttctgtttacattcgcgtctgcaagmccggcggcgcgaccgaggcccgaacagatggagatgggctgccatgttgtgagctgccccatggggaagaggctcacatgtgaggaactgagggaggcctccagaaaacagccagtgaagaactgagaccctcagtccaatagcctatgaggaactgaatcctgctgacaaccatatgaatgagcttggaagcagatccttccccagtgaagccttcatgtgagactgcagcccacttgacactttgatttgtagctt

SEQ ID NO: 16204 - DNA, 146 bp, Homo sapiens
attttgctctggacgcactgatgttcccggctcgccgccgtgccgcagtcacgaggctctccgaacgcctttcactgtgtttctgtttacattcgcgtctgcaagmccggcggcgcgaccgaggcccgaacagatggagatgggct

SEQ ID NO: 16205 - DNA, 467 bp, Homo sapiens
attttgctctggacgcactgatgttcccggctcgccgccgtgccgcagtcacgaggctctccgaacgcctttcactgtgtttctgtttacattcgcgtctgcaagmccggcggcgcgaccgaggcccgaacagatggagatgggctgccatgttgtgagctgccccatggggaagaggctcacatgtgaggaactgagggaggcctccagaaaacagccagtgaagaactgagaccctcagtccaatagcctatgaggaactgaatcctgctgacaaccatatgaatgagcttggaagcagatccttccccagtgaagccttcatgtgagactgcagcccacttgacactttgatttgtagcttgtgacagaccccaagccagaagagtcaggtaagcagtgcctgcactcctgacccatggsaactggcatgataaatgttttttccatgaagctatgttttagag

SEQ ID NO: 16206 - DNA, 463 bp, Homo sapiens
attttgctctggacgcactgatgttcccggctcgccgccgtgccgcagtcacgaggctctccgaacgcctttcactgtgtttctgtttacattcgcgtctgcaagmccggcggcgcgaccgaggcccgaacagatggagatgggctgccatgttgtgagctgccccatggggaagaggctcacatgtgaggaactgagggaggcctccagaaaacagccagtgaagaactgagaccctcagtccaatagcctatgaggaactgaatcctgctgacaaccatatgaatgagcttggaagcagatccttccccagtgaagccttcatgtgagactgcagcccacttgacactttgatttgtagcttgtgacagaccccaagccagaagagtcaggtaagcagtgcctgcactcctgacccatggcaactggcatgataaatgttttttcccatgaagctatgttt

SEQ ID NO: 16207 - DNA, 430 bp, Homo sapiens
aacagcggggcgtcacctcggacatacgaacagcgggcggtgttcccggctccgtggggccgtcttcccggcgagtccgcgacgrtcgccgcccacggsaggtacgaggttttaaaaagtttttaatttggaaggcagggtgcrgtggctcacgcctttaatcccagtactttgggaggccgaggcgggcggatcacgaggtcaggagatcgagactatcctggccaacatggtgraaccccgtctcaactaaaaatacaararattrgcggggcgtgatggcgggtgcctgtcgtcccakctrctcgggaggccgaggcrggagaatcgcttgaacctgggaggcggaggttgcagtgagccgagatcgcgccactgcacttctgcctggcaacagagcgagactgcgtctcaaaaaaaaaaaaaaaaa

SEQ ID NO: 16208 - DNA, 444 bp, Homo sapiens
acttccgccagcccgccacagcgggcgtcacctcggacatacgaacagcgggcggtgttcccggctccgtggggccgtcttcccggcgagtccgcgacggtcgccgcccacggcagggtacgaggttttaaaaagtttttaatttggaaggcagggtgcagtggctcacgcctttaatcccagtactttgggaggccgaggcgggcggatcacgaggtcgggagatcgagactatcctggccaacatggtgaaacccgtctcagctaaaaatgcaaaaaattagcggggcgtgatggcgggtgcctgtcgtcccagctactcgggaggccgaggcaggagagtcgcttgaacctgggaggcggaggttgcagtgagccgagatcgcgccactgcacttctgcctggcaacagagcgagactgcgtctcaaaaaaaaaaaaaaaa

SEQ ID NO: 16209 - DNA, 453 bp, Homo sapiens
cttgtcggcgccattttgtctcggcakcggtggccgtagctccatcgcattttatgtttctggcgagaagggaacggagttttcatcaggtagattggtttttgtgcggccgtcctccaccgtttcctccaggacagcacctagtcgtgkccggagagtctcagagctgtcagaaaggtgagcatttgtacagtgaaacattttgctacacaaaagtgatrtttaggaatactaacaaattattttcaagaataagactgattttatgggaaaattaagcagatgctccagtttgagaaacctggatctgcgatctgtttgtggtctctatgaataaagaaaagcaaatagaatcttatcaggtaccagcatcaagatgatttatggtaataaggtactcagtctttgcttaaaataaattttacgtttatcaaagcaaaaaaaaaaaaaaaa

SEQ ID NO: 16210 - DNA, 204 bp, Homo sapiens
tgttaaattagctaaatcatgtaaccgcagataggaagggctcgcctggggaaactctggtttccgatgggacaggaaagtcatacgggcaacagtatgcggaaagtacgttttttaagtaaaaaaacaaaggcaaactttgtactatccagttatctaaggaacaataaaaacattaggagatcagaaaaaaaaaaaaaaaaa

SEQ ID NO: 16211 - DNA, 393 bp, Homo sapiens
cattttgtctcggcagcggtggccgtagctccatcgcattttatgtttctggcgagaagggaacggagttttcatcaggtagattggtttttgtgcggccgtcctccaccgtttcctccaggacagcacctagtcgtggccggaggagtctcagagctgtcagaaaggtgagcatttgtacagtgaaacattttgctacacaaaagtgatgtttaggaatactaacaaattattttcaagaataagactgattttatgggaaaattaagcagatgctccagtttgagaaacctggatctgcgatctgtttgtggtaccagcatcaagatgatttatggtaataaggtactcagtctttgcttaaaataaattttacgtttatcaaagcaaaaa

SEQ ID NO: 16212 - DNA, 343 bp, Homo sapiens
attttgtctcggcagcggtggccgtagctccatcgcattttatgtttctggcgagaagggaacggagttttcatcaggtagattggtttttgtgcggccgtcctccaccgtttcctccaggacagcacctagtcgtggccggagagtctcagagctgtcagaaagaataagactgattttatgggaaaattaagcagatgctccagtttgagaaacctggatctgcgatctgtttgtggtctctatgaataaagaaaagcaaatagaatcttatcagataagtgcttttataagtctaaatatattctttggaatctctaaagcaaaacttttaaactttttt

SEQ ID NO: 16213 - DNA, 440 bp, Homo sapiens
atttttgtctcggcagcggtggccgtagctccatcgcattttatgtttctggcgagaagggaacggagttttcatcaggtagattggtttttgtgcggccgtcctccaccgtttcctccaggacagcacctagtcgtggccggaggagtctcagagctgtcagaaagaataagactgattttatggcaaaattaagcagatgctccagtttgagaaacctggatctgcgatctgtttgtgaggtgaagaagaaagaaaatgaaacatactcaagatttaagaaagagggaacgagcagtaccattcactgatttggcaagtcaagaaaagccactgagtggtattcagttaagagaacaattatttcgtataagccacatcagagacgactgaagatgaaaaaactaccatccccgtatataactaatttgtgctgtgca

SEQ ID NO: 16214 - DNA, 507 bp, Homo sapiens
ggcgccattttgtctcggcagcggtggccgtagctccatcgcattttatgtttctggcgagaagggaacggagttttcatcaggtagattggtttttgtgcggccgtcctccaccgtttcctccaggacagcacctagtcgtggccggaggagtctcagagctgtcagaaagaataagactgattttatgggaaaattaagcagatgctccagtttgagaaacctggatctgcgatctgtttgtggcacagcactttgggaggctgaggcgggcgtgagattgggagtttgagaccagcctgaccaacatggagaaaccgcatctctactaaaaatacaaaattagcctggcgtggtggcgcatgctgtaatcccagctactctggaggctgaggcaggagaaccgcttgaatccgggaggcgaaggtcacggtaccagcatcaagatgatttatggtaataaggctgggtgcagtggcttgtgcctgtaatcccagcactttggga

SEQ ID NO: 16215 - DNA, 478 bp, Homo sapiens
tttgtctcggcagcggtggccgtagctccatcgcattttatgtttctggcgagaagggaacggattttcatcaggtagattggtttttgtgcggccgtcctccaccgtttcmtccaggacagcacctagtcgtggccggagagtctcagagctgtcagaaagtgcaagaaatcagccagcgtggtggcgtgcacctgtgttccccgctaatcaagaggctgaggtgggatgatcacctgagtccaggagatcaaggctccagtgaaccatgattgtgccactgaactccagcctgggtgacagacttcatctcaaatatatagaataagactgattttatgggaaaattaagcagatgctccagtttgagaaacctggatctgcgatctgtttgtggtctctatgaataaagaaaagcaaatagaatcttatcagataagtgcttttataagtctaaatatattctttggaatctcta

SEQ ID NO: 16216 - DNA, 363 bp, Homo sapiens
atttttgtctcggcagcggtggccgtagctccatcgcattttatgtttctggcgagaagggaacggagttttcatcaggtagattggtttttgtgcggccgtcctccaccgtttcctccaggacagcacctagtcgtggccggaggagtctcagagctgtcagaragaataagactgattttatgggaaaattaagcagatgctccagtttgagaaacctggatctgcgatctgtttgtggtctctatgaataaagaaaagcaaatagaatcttatcagataagtgcttttataagtctaaatatattctttggaatctctaaagcaaaacttttaaactttttttttttttttttttttttd

SEQ ID NO: 16217 - DNA, 322 bp, Homo sapiens
tttatgtttctggcgagaagggaacggagttttcatcaggtagattggtttttgtgcggccgtcctccaccgtttcctccaggacagcacctagtcgtggccggagagtctcagagctgtcagaaagaataagactgattttatgggaaaattaagcagatgctccagtttgagaaacctggatctgcgatctgtttgtggtctctatgaataaagaaaagcaaatagaatcttatcagataagtgcttttataagtctaaatatattctttggaatctctaaagcaaaacttttaaacttttttttttttttttttttttt

SEQ ID NO: 16218 - DNA, 359 bp, Homo sapiens
aaaccagcttgtcggcgccattttgtctcggcagcggtggccgtagctccatcgcattttatgtttctggcgagaagtgaacggagttttcatcaggtagattggtttttgtgcggccgtcctccaccgtttcctccaggacagcacctagtcgtggccggagagtctcagagctgtcagaaagaataagactgattttatgggaaaattaagcagatgctccagtttgagaaacctggatcttcgatctgtttgtgatataaaaccaaggaaaataacctaaagtctgaaaaagaccagaatcgaagtttccttgattcatattttaatgttttgaaatttatactccaggctgggtg

SEQ ID NO: 16219 - DNA, 348 bp, Homo sapiens
taaaccagcttgtcggcgccattttgtctcggcagcggtggccgtagctccatcgcattttatgtttctggcgagaagggaacggagttttcatcaggtagattggtttttgtgcggccgtcctccaccgtttcctccaggacagcacctagtcgtgtccggaggagtctcagagctgtcagaaaggtgagcatttgtacagtgaaacattttgctacacaaaagtgatgtttaggaatactaacaaattattttcaagaataagactgattttatgggraaattaagcagatgctccagtttgagaaacctggatctgcgatctgtttgtggtctctatgaataaag

SEQ ID NO: 16220 - DNA, 536 bp, Homo sapiens
aggttcttttccccagctgtttcttbvtaggttgagtcctgttgcttgattagaattaagtgcactgaaatcctgtgtcagcttctcagtagcacctgagcttttagaaagctattccattcactaagtagtgccatttacaaacttccattagagatgaacagaagaaaactgtttaactggcagagaaatatgtttagcccagagatatgtaaacattgcccctgtaggttgggctcaggaagaagaagagagtcacataacataggagctgggctcagctttatgtcacaataacccctgtaggcagggcccaagcataataggagagtcacatcacttaggtgctaagccaagccatatgtcacaatcttcactgtgaacagggtctgggcataagaggacagtcacatctctgatgggaccatagatacgtcaaaatgacttctgcaggcagggcccaggcaaaagaatcagccaattagctcagcaaacttggattcaatcaaacagttatctaaatagcgactgcagat

SEQ ID NO: 16221 - DNA, 291 bp, Homo sapiens
tcagtgcatctccttctcctctctgcctgcctcctccctcaccgaaggttagcggacacccatccttttctgcttggggaccccaccaccacccgcaacactgccgctgtctcttcttcaccgtatccttctctacccaccctcttctctcttctcttctccctgcccctttaaatctgcctggcccagcctcccccgtgatgctgggatggagcaaacattgatttgtgctgggatggaatcggaattttgatttatttttcctctcccaaccaaaaaaaaaaaaaaaaa

SEQ ID NO: 16222 - DNA, 493 bp, Homo sapiens
tttttataatttttttttttaccaaaaacacctttcactttctttayacaccttccatgtaaaactgtttttattttccaaagattactaaagtcatgtgaactaaaaggcattacgctttttacttttaaaatatttaagctcttattattcttaagccaattaaagctctttcatatgtaaacaccacacacacaacatawagaaatatacagacagaagaagatctagtagttgtaatatttttcatttgccagtttcttttctddtyytctttcttkkyytttttcctttgagactaagtcttgctctgttgcccaggctggagtgcagtggcgtgatctcagctcactgcaagctccgcctcccgggttcatgccattcttctgcctcagactcccaagtagctaggattacaggtgcctgccgccatgcctggctaattctttgkgtttytagtagagatggggtttcaccatgttaaccaggatgg

SEQ ID NO: 16223 - DNA, 460 bp, Homo sapiens
gcaacagggccgactgcagctggaagatggcggcgtccgtggtctgtcgggccgctaccgccggggcacaagtgctattgcgcgcccgccgctcgccggccctgctgcggacgccagccttgcgagtacggcaaccttcgctcaggcgctccagttcgtgccggagacgcaggttagcctgctggacaacggcctgcgtgtggcctccgagcagtcctctcagcccacttcacggtgggagtgtggattgatgttggcagccgttttgagactgagaagaataatggggcaggctactttttggagcatctggctttcaagggaacaaagaatcggcctggcagtgcctggagaaggaggtggagagcatgggggcccatcttaatgcctacagcacccgggagcacacagcttactacatcaaggcgctgtccaaggatctgccgaaagctgtggactc

SEQ ID NO: 16224 - DNA, 585 bp, Homo sapiens
gagcaagccctggtggcagcgcagggtccagtgcagcccctccccacagcatgctgggggctaattctgatgtcatctttctgcagaaaaccattagaccatccctccagactgccaccctcaaagccgtctgcccaggccccatctgacactcttgacatctgcaggtcccagaccctatgatgtgtccactctggaggctcctcatcttcctcgggttgctggccttgcccttggcaccacacaagcagccttggcctggcctggcccaagcccacagagacaacaaatccaccctggcaagaagtccttcgataamaacatcgtaaagatgtgtggcacatatgagcatcgttgtggagttctggctggagaaagacgagtttggccggagggatctggtgatagggcaaatgcgatgcagagcccagcagtgtccatgtggccatcctcactgaggctatcccaccaaagatgaatcagtttctctacaacctcaaagagaatctgcaaaaagttctcccacacatggtagaaagtcaggtatgtcctctgatcggtgaaatctcgggcagctggatgtga

SEQ ID NO: 16225 - DNA, 498 bp, Homo sapiens
acagctgcccgggactccagtgatcgccgcggctcgctcgcgccccggaaactgccccttctcgggggtcatgatgggcagcaagatggcgtctgctagtagggtcgttcagtatcagaagctttgagatcagcagggctaccatctcactcttctgtaatttcacaacattctaaaggaagtaaatcaccagatttgctgatgtatcagggtccaccagacactgcagaaataataaaaacattacctcagaaatacagaaggaaacttgtgtctcaagaagaaatggaatttatccaacgtggaggtcctgaataaccatggtggctgctgtttgtcatcagacaatagaattgtctttacaataaaggacttccaaaatgacagatgagaaactgtatattaaacacctttaataaatattatgaaaaaaatgaaatatagaaaatttagatggacacttgtatttccctaatttatgtatcttggtcagcttct

SEQ ID NO: 16226 - DNA, 299 bp, Homo sapiens
aattacatcccaaacatttctgataatggaagcattttctctctaaaggggatgggattattggattggcaatttctcttaatctgagaaaactcatctcccactcccttccccatatcccctttccatcctctcactcacgcacacgcacacacacacacacactccattcactgtctccatgactctggagtaaactaacgtctcgagttgccattggaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 16227 - DNA, 300 bp, Homo sapiens
aattacatcccaaacatttctgataatggaagcattttctctctaaaggggatgggattattggattggcaatttctcttaatctgagaaaactcatctcccactcccttccccatatcccctttccatcctctcactcacgcacacgcacacacacacacacactccattcactgtctccatgactctggagtaaactaacgtctcgagttgccattggaaaaaaaaaaaaaaaaaaaaaaaaaaaaaaaaarrgaaaaaaaaaaaaaaaaaaaaaaaaaaaaaaaaaaaaaaaaaaar

SEQ ID NO: 16228 - DNA, 409 bp, Homo sapiens
acattctcccatttggatttttcaaagacaacatctaatcatccccagagaaatttcagctgagaagacaggatggtgagacagttcctaagtctttcctagacacaattgtctttgcaagtcctctgccacagtcaaagatgaagtgccctgggggccagagtccagacaagtattttggcacctccaaggactcgcagaacacagagaagaaaagagagaccctgttatctttccgcagggtggccgttcaaactctcagagatggaagttaagatttcctttggtataagtggcagtttgactggctgcaaggagagcctcagtttgtttaatttggagtaaaattttatgagttaatctctagtgagggaaagcagcagtaaacacagaacatactggtcattaa

SEQ ID NO: 16229 - DNA, 416 bp, Homo sapiens
attgaaaacttactgtgctcaaggcacagaacggggtagttttatacacattctcccatttggatttttcaaagacaacatctaatcatccccagagaaatttcagctgagaagacaggatgatgaagtgccctgggggccagagtccagacaagtattttggcacctccaaggactcgcagaacacagagaagaaaagagagaccctgttatctttccgcagggtggccgttcaaactctcagagatggaagttaagatttcctttggtataagtggcagtttgactggctgcaaggagagcctcagtttgtttaatttggagtaaaattttatgagttaatctctagtgagggaaagcagcagtaaacacagaacatactggtcattattccaaaaaaaaaaaaaattgcgaaa

SEQ ID NO: 16230 - DNA, 516 bp, Homo sapiens
tgaagaattacttgttcacgaattgcataaagctgcacaggattcccatctaccctgatgatgcagcagacatcattcaatccaaccagaatctcgctctgtcactcaggctggagtgcagtggcgcaatctcggctcactgcaaactctgcctcccaggttcacgccattctcctgccacagcctcccgagtagctgggactacaggcgcccgccaccaagcacagctaagttttttatttatagtagagacggggtttcactgtgttagccaggatggtctcgatctcctgacctcgtgatctgcctgcctcggcctcccaaagtgccgggattacaggcgtgacaccgcgccgggcctgatttcagtttcttccagcccttcctattgttaacatgggggttgtgttgaagaatataaagttacaaagtcaaggaagtaggaaacatttttacaagtattatgtagccatcttggtggggctgtggtgaggtaggsctgcaaatgattctcct

SEQ ID NO: 16231 - DNA, 483 bp, Homo sapiens
ctttttagctagtggccaagattcgcaaagcctcgcggcgaggaaagcacgagtattcaagcgcggctgaggccctccttggctagtgctgggacatggagccccggcagccaaggccaaccttgtgcattccgcccacgtaggcgcctggggccctggtcttcctcgactgcctctccactgcctggaggtcatcaaatgcccctggaccacctcctacgtgccacacgctgtgttggccatccaaggttccatattgagcataaaacagccctctgccctaaaggagttaacctgttggaatcacatacaaaggattctgactaccaagcgccttgaagttaagttgaactctgaagacagattgcctggctacaaagctcagttccactacatatggtccaggaacttaagacaaattattttaatgtctttatgtttcactatccgctgtagtgaaatagaataatacctactcatggc

SEQ ID NO: 16232 - DNA, 385 bp, Homo sapiens
ctaaatatgtttttggaagaaaccaaagaaagtgaagacaagagttctcagcagccccttcaccctgtaagccagcgagggcagccattgtcccgtgtccccaggtgagtcctgcttatggagctggatggaccagcggastargagtcaggtctggctagcaggccagtggagggaggccagcgggacacagaatagaggtggagacagtggccaccacaggagccccccagctgggcacagggtgaccaccccagggtcccccgagctctgtaagggactgcccctccatggatgtcctggccccacagagaggaccacagcatcactcaccatctagggggacgccaggsccgtccctgttctcagcctctccttgggtctc

SEQ ID NO: 16233 - DNA, 161 bp, Homo sapiens
aatgcaacagtacagctccacctggaagcagccccccaacttccccctccaatactgccctccacccgttttctagagttcttgaccatcattttgaaaagatttattaaaactagctaaagacttcatctcaaaaaaaaaaaaaaaaaaaaaaaaaaaaa

SEQ ID NO: 16234 - DNA, 182 bp, Homo sapiens
aatgcaacagtacagctccacctggaagcagccccccaacttccccctccaatactgccctccacccgttttctagagttcttgaccatcattttgaaaagatttattaaaactagctaaagacaacagaaaaaaaaaaaaaaaaaaaaaaaaaaaaaaaaaaaaaaaaaaaaaaaaaaaad

SEQ ID NO: 16235 - DNA, 464 bp, Homo sapiens
acttctcagtttaatccggtctgagttaacttcctgacccaggaagtggcagcaacagaggggactagcagcgaatatactttacaccaaatctcagaagattcagaacttagatgagtggggcccaggacaggaaccctggagccttggaaggaggggagccccatctccccagaagagcagtgaccccagcagagaggggcctggtgtatcactggaggaaatagcctgccaaggaatacacgtcttcagaagaaattctgtgtggcttcaagagactgatcaaattgtgagaggaaaacagcctacccgagccaatattggagcttttcaataaaagctatggcctcaaccaccagcaccaagaagatgatggaggaagccacctgctccatctgcctgagcctgatgacgaacccagtaagcatcaactgtggacacagctactgccacttgtgtataac

SEQ ID NO: 16236 - DNA, 598 bp, Homo sapiens
ctcatttggtggtgtctccagcggctcagcagctcctcctttgtgtgtctggacaaactctggtttacaaatatattcttttttttggtctagaaatctcggttttgggtctcgaatgccggctctgtttcgcaccctgctcaattctgaccacaggctccaggccagagcatcaccttggccatcaggggccagctcatcttcagatgttgaactgtgtgaggcagactcagctcccaagcctgtctcaggcagcaggcagcccccgtgtgctggccatcccagctagcaggctggggtcctagagaatcgctaacctcaaggaaaacagcctcctgtcgccgccacctggagacgctcatccagcagggtctgttctctctgctggagaaagccaccctggctgcaaggttcagcggcggccgccgggggcagcacgcaccggattgcaacatgcgatgctttaaacctggtctgccgccagctcttcagatgcacagagggctacaaacaaccacaattagctttcagcacaacagccaccgtctgcgttaatgcgagatgaaccgcagtctttcacagagagagctgcgtgggg

SEQ ID NO: 16237 - DNA, 249 bp, Homo sapiens
attctggaaagagagatttccaacctcttgcatcccctcctctagggctcatgggacctctggttctgaatgcatattcccctaaaatcaaagaacttgaagaccgaaaaagaccatggttattgtcaacttaagtggtctccaagatgggctataagacaccagattgaagtgagaccttagtggctgacagagaacctaaaccctggcttgcaactcgaggctgtgtgaaaggaatcggaacttact

SEQ ID NO: 16238 - DNA, 124 bp, Homo sapiens
ctggaaagagagatttccaacctcttgcatcccctcctctagggctcatgggacctctggttctgaatgcatattcccctaaaatcaaagaacttgaagaccgaaaaaaaaaaaaaaatgcgaa

SEQ ID NO: 16239 - DNA, 87 bp, Homo sapiens
ctbraaagacabmtttccaacctcttscatcccctcctctagggctcatggbacctctggytctgaatgcatattcccctaaaatcw

SEQ ID NO: 16240 - DNA, 122 bp, Homo sapiens
ctggaaagagagatttccaacctyttgcatcccctcctttagggctcatgggacctytggttctgaatgcwtattcccctaaaatcaaaraactkgarraccgaaaaaaaaaaaaaaatgcg

SEQ ID NO: 16241 - DNA, 317 bp, Homo sapiens
agtaaccggccccatcctgccgcgcaccagcctctggtggttatgctctgaagagaccaagtctccagctgaagtggcccagccctttagcagtgtccagtgtgtgctggagccagctcctgcaggcttgcaagccgacggtgcacccagctggtcccaactctgagctcagtgatgtggagccgtagttgaaagtggccacgatgggagaatttacaccacagcaatggacaaatgctacaaaccaaagctccctgcacccagtctgaccccaataaaactggcttgccagcaaaaaaaaaaaaaattscgaaaag

SEQ ID NO: 16242 - DNA, 97 bp, Homo sapiens
ttgaacacatttctgataagagctttaggaggagagaatagagagattggaggaaaggcaaaacttagaattttccaaaaaaaaaaaaaaaaaagct

SEQ ID NO: 16243 - DNA, 502 bp, Homo sapiens
actgacacagtgcttcacaggctgaaggtgaaggggaatggcagtgatccacttttaaaaagttctcttgtagctagtatgccaaaacttttaagagaccatgtgcaaccctccagagccctatttgttggctacaaggacctggaagccacatgtggagatggtggaatcacaggcatggcaatgaaggcagatgcttggtgggctgtggcaagtcaaaagccttaatacgatgacaacagcacgtcaacttctctttcagcatgaaaacatgctacagaaataggctaaagagtagtcttcattggaagtcacctttgaaaacagaacgtcacttttgtttagcactgcaatactcttcaccactctccacttgggttctccctgttttgcacactgtaagaaaatgaattaaccaattaattagccccctgtggctgagttcttaaactctagaaggggtacagagagatcctacctaccctatggatggcagaaatgg

SEQ ID NO: 16244 - DNA, 401 bp, Homo sapiens
tcatgcaccccaagggcctccacttggcctgaccttgctgcgggggctctctgtccccaggaacagtagagatggcaatcttatcgagaccctctctgcccagctgcctctgctccttcctcctcctcctcctcctccaagtgtcttccagctatgcagggcagttcacaaggtcaggagatcaaaaccatcctggctaacacagtgaaaccccacctctactaaaaatacaaaaaattagccaggcgtggtggtgggcgcctgtagtcccagctacttggaaggctgaggcaggagaatggcgtgaacccaggaggcggasttcagtgagctgagatcatgccactgccctccagcctgggcaacagtgtgagactctgtctcaaaaaaaaaaaaaaaaa

SEQ ID NO: 16245 - DNA, 496 bp, Homo sapiens
aagtatcggatccggccttcttcagctctctgttgtctccatcagctcccctggggcactgtgacatttccgctgtgagactgtgtcgccgctgcgcgtcatcacgtgtcgatggaggcatcgcaatgcaacagccaactctagagatgcccaatgcacaagactcccgatggaaagagaatgccgatggagttgggctgccaggccttttctcctaggttgcagcactggtggagaggagaggcatctggaggaggggagccatgtcaagcgcgtatgagcacacaccttctctctcgggtcctgggttcctttttgagccgtggatgagaaaatgagaggcgtaaacaggactgatttcaaacgttctgcctaactatcatggcaaagagaaggaagtcatcccctagagtgatgaactagcttcttcagaactttcttggaattgagaagaaaatttaattaatccagggttattaaatggattattactaat

SEQ ID NO: 16246 - DNA, 337 bp, Homo sapiens
aagagtactagacataactgccctcacagcactcctgatatgtgacttatcaccagatcctgcgattgctgacagcggtgcacagaacagtctggaatgttgctagggacaggcagatggaaaggatactgcagagaagaccaagaaagagaaataggaagaaaatgcagagtgggttgtcatggaatcttcaagaaggaagctcattgcctgacccacttgtttcataatgcaatgaaatgctaaagaattttaactccataaggaaaatcagggcaagacaataaaagaaacattaaatattagtaaaagtacgaaaaaaaaaaaaaaatgcgaa

SEQ ID NO: 16247 - DNA, 239 bp, Homo sapiens
ggttacaggacgtggcagctggttggacgagtctgtggacagcacagaggaggatgcgggtgccctggcccctgcccacatcagcgggctggtcttggagaacagtgactccctgcagtaggggcaggagcagacgcacctgactttttggagtttgcacagcaaacattttacacagttttatttctaatatgttttatatgtagatatagaagagtgcacttttgtatttcgaaaaa

SEQ ID NO: 16248 - DNA, 631 bp, Homo sapiens
cttttccctggtgtgattccgtcctgcggcgggsttgttctctggagcagcgttctttttatctccgtccgccttctctcctacctaaagtgcgtgccgscaaccgaatkggaagattcggatggacatggacatgagcccccttgagggccccagaactatcttttccggttgtgaactaaaggccgacaaaagattatcactttaaggtggataatgatgaaaatgagcaccagttatctttaagaacggtcagtttaggggctggtgcaaarggatgagttgcacattgttgaagcagaggcaatgaattacgaaggcagtccaattaaagtaacactggcaactttgaaaaatgtctgtacagccaacggtttcccttgggggcttttgaaataacaccaccagtggtcttaaaggttgaagtgttggttcaggggccagtgcatattagtkggacagcaacttagtagctgtggaggaaagatgcagagtcagaaagatgaagaggagggaggatgtgaaactcttaagtatatctggaaagcggtctgcccctgggargtggtagcaargktccacagaaaaaagtaaaacttgctgctgatgaagatgatgacgatgatgatga

SEQ ID NO: 16249 - DNA, 63 bp, Homo sapiens
atccctggtgtgattccgtcctgcgcggttgttctctggmgcggctttcttttatctcygtcc

SEQ ID NO: 16250 - DNA, 56 bp, Homo sapiens
atccctggtgtgattccgtcctgcgcggttgttctctggagcggctttcttttatc

SEQ ID NO: 16251 - DNA, 63 bp, Homo sapiens
atccctggtgtgattyygtcctgcgcggttgttctctggagcggctttcttttatctccgtcc

SEQ ID NO: 16252 - DNA, 445 bp, Homo sapiens
  misc_feature 380,384: n=a, g, c or t
aatttcccatctttcttttcagtccttgcgcaccggggaacaaggtcgtgaaaaaaaaggtcttggtgagcgtgccgccatttcatctgtcctcattctctgcgcctttcgcagagsttccagcagcggtymtgttgggccagagcatccggagttcacaacctctgtggtccgtagagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctcnttgngtggatcaaactagaactcatatgccatactagatatgtttgtcaataacttatgacgcaa

SEQ ID NO: 16253 - DNA, 63 bp, Homo sapiens
  misc_feature 41: n=a, g, c or t
atccctggtgtgattccgtcctgcgcggttgttctctggancggctttcttttatctccgtcc

SEQ ID NO: 16254 - DNA, 147 bp, Homo sapiens
cttttccctggtgtgattccgtcctgcgcggttgttctctggagcagcgttcttttatctccgtccgccttctctcctacctaagtgcgtgccgccacccgatggaagattcgatggacatggacatgagccccctgaggccccaga

SEQ ID NO: 16255 - DNA, 56 bp, Homo sapiens; identical to SEQ ID NO: 16250

SEQ ID NO: 16256 - DNA, 56 bp, Homo sapiens; identical to SEQ ID NO: 16250

SEQ ID NO: 16257 - DNA, 56 bp, Homo sapiens; identical to SEQ ID NO: 16250

SEQ ID NO: 16258 - DNA, 369 bp, Homo sapiens
gtcgggaaatggcggccgcggccgggctggggcttcagcgggaggcagcagaggggaagtggtcagcgtggcgaatgacggragaaactcgcattgkctactggatcaaggacagacagctcaccaaccgtgacagsaccatactggaacttcaaaaagttctgaaaacatgttgtgctcagagcatgaaaattttctgctgtctttggaactttgtctacaaacagttagaagatgcagcccaagggctcaccatgggtggcgatgttgaagaacatgaagaccttactgctgatagcaccatcttcaaatttgtggaagcttatgtgagttggataggaaaattkcctacatataatgttggctctt

SEQ ID NO: 16259 - DNA, 57 bp, Homo sapiens
atccctggtgtgattccgtcctgcgcggttgttctctggagcggctttcttttatct

SEQ ID NO: 16260 - DNA, 56 bp, Homo sapiens
atcsctggtgtgattccgtcmtgcgcggttgttctctggagcggctttcttttatc

SEQ ID NO: 16261 - DNA, 64 bp, Homo sapiens
atycctggttgtgattccgtcctgcgcggttgttctctggagcggctttcttttatctccgtcc

SEQ ID NO: 16262 - DNA, 147 bp, Homo sapiens; identical to SEQ ID NO: 16254

SEQ ID NO: 16263 - DNA, 322 bp, Homo sapiens
aattattacggtcatataaatgatgagagstaatgaacttcagtgatcagaggaaactattaacagtgataatataataatactgatttattctcacttgagttttttccttaaggtctgacaccatgccaatttccacagacctgtaactttaagttaccttaagctgggcctggtggctcacgcctgtaatacaagcactttgggaggccgaggtgggaggattgcttgagaccagcaacaacatagtcagaccacgtttctaccaaaaaagaaaaaaaattagcctggtagtgcacgcctgtagtaccagctasttggg

SEQ ID NO: 16264 - DNA, 226 bp, Homo sapiens
taacagttattctaaaaatatttcttataggggagaaaatgtaatcagtatattgtatgttttagtctggtgtggtggtgcaagcttgtgatcccagctactcaggaggctgaggcaggagaatggcttgaacccgggaggcggaggttgcagtgagccgagatcgcgccattgcactccagcctgggcaaaagagcgaaactccatctaaaaaaaaaaaaaaaaa

SEQ ID NO: 16265 - DNA, 490 bp, Homo sapiens
ttattctacaatgtgtagataattattactattttcatgcattttcttctagtttttttctttaccctgcgtaatattttattttatttttttgagaccagagtctcactctgttgcccaatctgaagtacagtggcatgatcttggcttactgcagcctccccctcccaggaggatagcttgagcccaggagtttgaggttatggtgagctatgatcacaccagtgtgctccagcgtgggtgatacagagtgagaccctgtctctataaagtgacaactacaaaaacaaacatttgctgacataatcacaatgtcattgttacactttacataattgacaacagttctctgacatcagctggtcatgtcacctctcctagatgggccacagaagtctttctagacttggtttgtcacctcaggacccagtgagactcacacattcattatgtttggctgttaggctcttaggttccttttaactagggt

SEQ ID NO: 16266 - DNA, 353 bp, Homo sapiens
cggctgtgctagacgagtggtgaagcccaagtatggagtaacgtcattaattctttcattcacttattcgaatgcttgctgagttctgtgttgctactggtttagttcttgggatactgcgagtgaacagttggcggcgaggctgttgttgcaacgtcagagtaaaagaaggaccctgcacggcggcctcccagcacttcgggaggccgaggcgggcggatcacctggtctcaaacttctgacctcaggtaacccgcctgcctcagcctcccaaagtgttgggattataggcatgagcctccatgcccggcaggatattatattaaagaattgttgtatactttttttttttt

SEQ ID NO: 16267 - DNA, 461 bp, Homo sapiens
agaaacacctaataagagtaaaggcaaagagttcctgaatatatcacatgtggtgataaacatgaagatgtatgaaaaattgtgttcgttgagagaaaatggaaggcttttcattctacttccacattttcattccagcagcttttctgttttggaagatgagtactgaatcttgcaatgaaatttttttaacttaaacaagacaaggaaaatgaagcgcagagacgttaaataactctctcaaggtcatgcagctgagaagagatgagacttgaactccagtgccagccctgttaatcactattctgtactgtctttcaggttcttatgcctttgtttgaaaaacatggttccctgtgaaattttacacgtagaagaaagcttcacactacgagagctctcaggatataattatttcagacagatactgggaacataagatggcttatcaatctaagatg

SEQ ID NO: 16268 - DNA, 451 bp, Homo sapiens
  misc_feature 251..253,285..286: n=a, g, c or t
actttacgactagcgggagggggccgggctagcgggctactgggctgcggagaccagagcccggctccactgaagaaacccgccggctgctggggcagggcggcgaaaggtcagtcggccgagaggagtccgtggagccaccgtttcatagcctcagggaaaggatcgggcgtgctcacgagccctctaacccatggcttaaacacccgcttcctaagcctgggttcttatgcbwttgtttgaaaaacatnnntccctgtgaaattttacatgtagaagawagcnncacactacgagagctctcaggatataattatttcagacagatactgggaacataagatggcttatcaatctaagatggccttcctgtccttcggattgaactgaaaccatccctggttccggggataggtaggtgatccgggtttggacaatcaaagtgttgagc

SEQ ID NO: 16269 - DNA, 430 bp, Homo sapiens
aaaaaaaacttgatcctttattgtggtagaagcatagggcatgttggagatgcagtagacatgctggcatggctggttataccaaggagtacataacatagctaacatgtattagacatgtattatgttttacgtactgtcctaaatatttcatacatcttttaaagtttgccagaaggaccctgtgaaacagtattattatgtacttcattttccagatgttaaaaattaggaagatcaaataatctgctcaagctcaggcctgggtactgggtgacagagggtatactcttaaccagctcatcatgctacctgcatgcaacacaaggagttattggataggcacatgaggctggaaaaggtagaagattctgaggccctgggcgggaactagtaagccacaatctggaagagtcttttaccaccatgt

SEQ ID NO: 16270 - DNA, 408 bp, Homo sapiens
cttaggatttgaacttttccttgtagacagtgggaagaaaagggagtgttttaagccaaatagtgacatttgtgtttcagaaattcaggtaggcagacgtgtggagaatcactatgaggggaggccagtcacgctattccaaagaggctgaaggctggccgagattagggcagagggggtaggcaggctcttcagccagagtggtgtgttagaatcctggttctgccagttggacattaagctctccatctctcagttttgtcatctgtaatgtggagatattaagagttcttggccgggtccagtggctcacgcctgtaattccagcagtttgggaggccgaggcagacagatcacttgaggtcaggaagtttgagacagcctggccaacatagcaaaacttgtctc

SEQ ID NO: 16271 - DNA, 508 bp, Homo sapiens
cttaggatttgaacttttccttgtagacagtgggaagaaaagggagtgttttaagccaaatagtgacatttgtgtttcagaaattcaggtaggcagacgtgtggagaatcactatgaggggaggccagtcacgctattccaaagaggctgaaggctggccgagattagggcagagggggtaggcaggctcttcagccagagtggtgtgttagaatcctggttctgccagttggacattaagctctccatctctcagttttgtcatctgtaatgtggagatattaagagttcttggccgggtccagtggctcacgcctgtaattccagcagtttgggaggccgaggcagacagatcacttgaggtcaggagtttgagaccagcctggccaacatagcaaaactgtctctactaaaaataaaaaattagccaggtgtggtggtgcatgtttgtaatccccactattcgggagagaattgcttgaacctgggaagcagaagttgcaatgag

SEQ ID NO: 16272 - DNA, 519 bp, Homo sapiens
ataattttattggactgtttgtctttgttctctgcctcttgtattctagcatccgcacttccactaatagccaagtagacaagctgaccctgtcaggagtgacagcgtcatccttggtgatacaactaccagtggtgccagtgatgaagaagatggacagcctcggcggctgtkgacaackagaaagagggagtgcagtatagctactccttattccacctcatgctctgcttggcttccttgtacatcatgatgaccctgaccagctggtacascctgatgcaaagtttcagagcatgaccagcaagtggccagctgtgtgggtcaagatcagctccagctgggtctgcctcctgctttacgtctggacccttgtggctccacttgtcctcaccagtcgggacttcagctgaacctctgagtgccaaggacaccactggaactcacaaaggtctccttcaccgaaaacccatataccttttaagtttgtttcaactaaaatattaagtgaatgctttg

SEQ ID NO: 16273 - DNA, 450 bp, Homo sapiens
gtatttaggacagttgtcctcacccgtgtgtaccgagcactgggagtctgagctgggagggtgtgcaaggaacagatgcagcggatcccaaaggcacccacggaaaatgggcagggtttagcacattccagttgaaggagaggaaggagttgggaatgataccctgggtgtattagtttgctagggctgctataacagtaccataaactgggtggcttaaggaacacaaccttcttgcctcacagttctggaggctggaagtacaagatcaaggtgttggcgctgttggttcctgtgagggctgccagggagggagtcgccgttaaaacacctactgaaaaagttgaaaagatgtttccacatcgcaaaaatgtgaacaaaccagtcggtggaactaatgtccctgagatgtttatcaaaaaagaagaattacaagaactaaagtgtgcg

SEQ ID NO: 16274 - DNA, 337 bp, Homo sapiens
aagaaatgggacttaactcaaaaagaccttcttcaggtaatgcagaaccttttcatggtatagagtgggcatttcaacacaatcctgtagcctgtagaagaacttgaagagcttctatgtagatttttatcatttacagataatattaatcaggcctttttcttaaagaatgtttcatcctccccagagttcttcactgggagaagggaaacagtcaacattgaataatacccgctagataagagaagaagagatgctgataagagttgaaagatctagggttgctccatgcatgtgtttattaaataaaatcagcctgggagtagagcaaaagagg

SEQ ID NO: 16275 - DNA, 552 bp, Homo sapiens
tatataggcagttgcatgctagcatgggtatttttataacaatataactgagttatattggaattataaatattttcsgtcacttaaatttgttctttgtttagcctgaaaacctttatggctcaagatcagattcctgactaacccctctcttagagctacagcagctgcattaccagcttaaaacacttcttagggattaaatatagatgtaatttttcaaaatcgtttttaatttaaactgtgttttagtgtaaaattgttaaccttgtaagatggataatgtgtataagaatgtaggccttaactatttcacatgagtcaaaacaaagcagctttaaaaaaataattggaagcacaagtgcatggcactgactgaatgctgttaatatttctaaaagtttctacattcagattatatgcctgattcatagtaaaatacctctaataaacactgttttatagaaaacctgacttcagtgaatatttttgtattttacatgggccagtttatatactgctatttacactattatttcctatagctacatg

SEQ ID NO: 16276 - DNA, 459 bp, Homo sapiens
tatcaactaatcactaactccttccttttcctctgcatgccagcctgaaaattccaaatctagcctctgaatgtcttggctccatctcttcagacccctttgcctttaaaaaaaaaacaaaaacaaaaacaaaaaaacccataatgcccacagaatgtcaaatgaggggcctcctgcctcctgctctgaatattctgtagctgtagaggcattttaaccctttgtcctccagcatcccttcacttcctcatcctctctaacctcctttttctttttttaatgctgcagcctccacactccacccacaggtgacccttccctttttctctagctggatctgttttcttcccttcgggcccccatgttttcctgcacccgccctaccatggtctctctctgcagttatttaatgcctgtgtcagatctactgtaaaaagacgattaagtaaaataaaatgg

SEQ ID NO: 16277 - DNA, 412 bp, Homo sapiens
ataacagcttgtcagagacttcctatggaagaaagaattttttagatactatcattaggttggatatggtaatagatatatttcagaatagcaagtggtggtatatcttatccatatctttaggctgctgcagaattttaaggttatagataaagctgtgatattttatgcaaagactggctctaggtatttgaggagcacaatacagagattttaaaaagtgattttgtaaaatctacactatggtctctgtttctccaaagtaagtgtttgtgatttgttcctcatactgcagtgagtaaaaaagaaacaagaaaacaacaacataaatattaaagtacgtttcaatgttgggtgaattttgtttttagatgccaataaaacttatttgtttggaaaaaaaaaaaaaaaa

SEQ ID NO: 16278 - DNA, 454 bp, Homo sapiens
  misc_feature 13: n=a, g, c or t
agtctgaggcganttcggagcggccggtactgttgaaagcgacaagtggaggcgccgctctagcgcgggactctgaactatggcgcccagagcacatgtgaggagaggcagaccatattttgcagagcactgtgccaaggggctgttttcattaaagagggttaatgacattaagatgaggttctcacttaggctagtgatacagagcgagatggactagccccagaaaagacatcaccagatagagataagaaaaaagagcagtcagaagtatctgtttctcctagagcttcaaaacatcattattcaagatcacgatcaaggtcaagagaaagaaaacgaaagtcagataatgaaggaagaaaacacaggagccggagcagaagcaaagagcgtgcttatgcgcgaagagactgaactgaagacgctgcagactcagatagcaaaataataa

SEQ ID NO: 16279 - DNA, 459 bp, Homo sapiens
aaggatcctctaccggcttttcgagtcagtgctgccgccgctgcccgcggctttgcagagcaggatgaatgtgatagaccacgtgcgggacatggcggccgcggggctgcactccaacgtgcggctcctcagcagcttgttacttacaatgagtaataacaacccgttttagcctggatatctctcctaaagagccttctctgactcccaggactctcgggtactcccacttttctacccttcgcatcacccaccaattgaaagcgcagtgctgtgcgcaataagcactcacatgcttattgagtgtgttgaggaatgagttattctccccacctcagaagtaccagcttttggtgtatcatgcagattctctctttcatgataaggaatatcggaatgctgtgagtaaagtataccatggctttacagcagaagaaagcgctaagtaaaacttcaaaa

SEQ ID NO: 16280 - DNA, 422 bp, Homo sapiens
aacgatccttcctcaaagcatggttgctgagtacccagagttgcgaggagttttttaactgatttagccaggtggcaatcatgagtgaatggatgaagaaaggccccttagaatggcaagattacatttacaaagaggtccgagtgacagccagtgagaagaatgagtataaaggatgggttttaactacagacccagtctctgccaatattgtccttgtgaacttccttgaagatggcagcatgtctgtgaccggaattatgggacatgctgtgcagactgttgaaactatgaatgaaggggaccatagagtgagggagaagctgatgcatttgttcacgtctggagactgcaaagcatacagcccagaggatctggaagagaaaaagaacagcctaaagaaatggcttgagaataaccac

SEQ ID NO: 16281 - DNA, 268 bp, Homo sapiens
ccttcctcaaagcatggttgctgagtacccagagttgcgaggagttttttaactgatttagccaggtggcaatcatgagtgaatggatgaagaaaggccccttagaatggcaagattacatttacaaagaggtccgagtgacagccagtgagaagaatgagtataaaggatgggttttaactacagacccagtctctgccaaggttctactgtcacccaggctggaatgcagtggcgagatctcggctctttgtaacctccacctcgc

SEQ ID NO: 16282 - DNA, 506 bp, Homo sapiens
caaacacctgggccttctraggtccaagcaatcagacaaagagcaccgtgagggaggtcacactctaggtcagggtgaaagacagacagacacacgtttaccctctctccttcctcatatcccactgaagagacacgattcacagaagagaataagtccacagcagatgagaagtgaggtgggcagaatcagcctacagttcgaataattttttttacgattgaaagcaaatgataacctatgatagatgaaccagaataaaggggccatatcctttaatacggggtacagaagaagctggaatcagagatgagagccattcttggtggggcagtcccaccaagcaccaaaggatgaataaaaagactctcagccctagagacaaatttgtgaaattgaaaatgaaggataaagaaaagaccatataaccttccagagagagaacaacagattacctgtaaagaacaggagtcccatgaagacagcactcttctcatcagcatcag

SEQ ID NO: 16283 - DNA, 210 bp, Homo sapiens
agtatcgcggacggaagatggcgtccgcacccgtctcatccagcggctgcgaactgggcgtccgggcatgacctgcaggggaagctgcagctacgctacagggagaatgtgacctaatttatgacaaatacgtagagctcaggtatcacttctagttttactttaaaaaataaaaaaatagagacagagtctcaaaaaaaaaaaaaaaaa

SEQ ID NO: 16284 - DNA, 441 bp, Homo sapiens
agttcacagctgccctgttgcagggaggcggtggcccttctgttactagaccgagcctgtgggatataccaaggcagaggtatggatgagagaggcagctgcagatagaagtggtcacatgcaggatgtattttgaaagtagacctggccaggtcgtggctcaggcctgtaatctgagcactttgggaggccaaggcaggaggatcacttgagcccaggagatcaaggctagcctgggaaacatagcaagaccctgtctctaaaaaaataaaaaattagctgggtttggtagtgcatgcctgtagtcccagggacttgggaggctgaggtgagagaatcgctttagcctgggaagtcatggctgcagtgagctgtgatcacgccactgcactccagcctgggcaacagagcaagaccctgtctagaaaaaaaaaaaaaaaa

SEQ ID NO: 16285 - DNA, 492 bp, Homo sapiens
acgcccgcaacaattcctgagtagggccttgcttgagttcttcggaaagtctcatccacccccacatcgcctctttaggaagtcacttaatgttgggcttcattattcccacatccctttccttactacttgcctgcacttcttgagaaaaagactgcagaaaggagaggtggggctttcagtagaaacaagcaaaccgcatccctgtgggggactctccaggaagaagggtaatttcctgcctccttaaattggctgctactgtcagttattttgctcccaaccccagagcttcacttgctccttcacttcccagttccgcaagaaccgtgggcgacagttatggagaagcgtctgcaggaggctcagctgtacaaggaggaagggaaccagcgctaccgggaagggaagtaccgagatgctgtgagtaggtaccatcgagctctgcttcastgcggggtctggatcgagtctgccctctccgttacctaa

SEQ ID NO: 16286 - DNA, 461 bp, Homo sapiens
acgcccgcaacaattcctgagtagggccttgcttgagttcttcggaaagtctcatccacccccacatcgcctctttaggaagtcacttaatgttgggcttcattattcccacatccctttccttactacttgcctgcacttcttgagaaaaagactgcagaaaggagaggtggggctttcagtagaaacaagcaaaccgcagtccctgtggggggactctccaggaagaagggtaatttcctgcctccttaaattggctgctactgtcagttattttgctcccaaccccagagcttcacttgctccttcacttcccagttccgcaagaaccgtgggcgacagttatggagaagcgtctgcaggaggctcagctgtacaaggaggaagggaaccagcgctaccgggaagggaagtaccgagatgctgtgagtaggtaccatcgagctctgcttcagctgcgg

SEQ ID NO: 16287 - DNA, 512 bp, Homo sapiens
gcccactgtcagggttggggggacagagaaagtgatgtgcgccttctaaagcctcgcccagcgccgccgaagcagcttcacctctccaactttctcccaccgactgcttgtcttgaccctgccctccaccctccccagagccacttcgggtgcgcgctcttgggtaaagggggggtcaccggctgtctgggatggcttccaattttaatgacatagtgaagcaagggtacgtgaggatccggagcagacgcctcgggatttatcagcgatgctggttagtattcaagaaagcttcaagcaaaggtccaaaaagactggagaaattttctgatgaacgtgctgcatatttcaggtgttatcataaggttacagaactcaataatgtgaagaacgtatctcgattgccaaaaagcaccaagaaacatgccatagggatttatttcaatgacgatacctccaagacttttgcttgcgaatcaggatcttgaggctgatgagtggtgcaagtactc

SEQ ID NO: 16288 - DNA, 246 bp, Homo sapiens
agcattcatagaacagttatcttgatagttggggaattgtttacagtctagatgacattaggcctggtgacaattcagaaggcagtacctctaatacttaagacttagaccaatattagactaccaaagtcatccttggataattgggagcatagtctaacaagaaaatgagcggtaacactaatagctgaaaaaaaaaaaaaaaaaaaaaaaaaaaaaaaaaaaaaaaaaaaaaaaaaaaaaaaa

SEQ ID NO: 16289 - DNA, 200 bp, Homo sapiens
agcattcatagaacagttatcttgatagttggggaattgtttacagtctagatgacattaggcctggtgacaattcagaaggcagtacctctaatacttaagacttagaccaatattagactaccaaagtcatccttggataattgggagcatagtctaacaagaaaatgagcggtaacactaatagctgaaaaaaaaaa

SEQ ID NO: 16290 - DNA, 198 bp, Homo sapiens
agcattcatagaacagttatcttgatagttggggaattgtttacagtctagatgacattaggcctggtgacaattcagaaggcagtacctctaatacttaagacttagaccaatattagactaccaaagtcatccttggataattgggagcatagtctaacaagaaaatgagcggtaacactaatagctgaaaaaaaa

SEQ ID NO: 16291 - DNA, 249 bp, Homo sapiens
agcattcatagaacagttatcttgatagttggggaattgtttacagtctagatgacattaggcctggtgacaattcaraaggcagtacctctaatacttaagacttagaccaatattagactaccaaagtcatccttggataattgggagcatagtctaacaagaaaaatgascggtaacactaatagctgaaaaaaaaaaaaaaaaaaaaaaaaaaaaaaaaaaaaaaaaaaaaaaaaaaaaaaaaah

SEQ ID NO: 16292 - DNA, 249 bp, Homo sapiens
agcattcatagaacagttatcttgatagttggggaattgtttacagtctagatgacattaggcctggtgacaattcaraaggcagtacctctaatacttaagacttagaccaatattagactaccaaagtcatccttggataattgggagcatagtctaacaagaaaawtgagcggtamcactaatagctgaaaaaaaaaaaaaaaaaaaaaaaaaaaaaaaaaaaaaaaaaaaaaaaaaaaaaaaaah

SEQ ID NO: 16293 - DNA, 222 bp, Homo sapiens
agcattcatagaacagttatcttgatagttggggaattgtttacagtctagatgacattaggcctggtgacaattcagaaggcagtacctctaatacttaagacttagaccaatattagactaccaaagtcatccttggataattgggagcatagtctaacaagaaaatgagcggtaacactaatagctgaaaaaaaaaaaaaaaaaaaaaaaaaaaaaaaa

SEQ ID NO: 16294 - DNA, 259 bp, Homo sapiens
agcattcatagaacagttatcttgatagttggggaattgtttacagtctagatgacattaggcctggtgacaattcagaaggcagtacctctaatacttaagacttagaccaatattagactaccaaagtcatccttggataattgggagcatagtctaacaagaaaatgagcggtaacactaatagctgaaaaaaaaaaaaaaaaaaaaaaaaaaaaaaaaaaaaaaaaaaaaaaaaaaaaaaaaaaaaaaaaaaaar

SEQ ID NO: 16295 - DNA, 217 bp, Homo sapiens
agcattcatagaacagttatcttgatagttggggaattgtttacagtctagatgacattaggcctggtgacaattcagaaggcagtacctctaatacttaagacttagaccaatattagactaccaaagtcatccttggataattgggagcatagtctaacaagaaaatgagcggtaacactaatagctgaaaaaaaaaaaaaaaaaaaaaaaaaaa

SEQ ID NO: 16296 - DNA, 363 bp, Homo sapiens
tttgatggagaaacctggaagcataaatcagattgtctccagcccaaagggaaaaagactgtaagaatagtcttattctctttagaagctggaatttaaaggaaagaaaaagctaggcagtaactagtggaaaacacagggtatagacaagatctttataaagaggggaatgacaagaatatttacaaactgagaggaaagagccacttgagaaggagccatctgcggtgtcggagcagagtgatagtccctgggggcctaaggaactccagaggattacagctcaagagtgggccactttttccaccgagatacgccagtgggaaaatgtgtttggatggtaggggttggggtatagggaag

SEQ ID NO: 16297 - DNA, 575 bp, Homo sapiens
ataagaaaatgaggaaccagagagagatgaaaattttcccaatgtcctaagattatcacactgcatcataactgcccagtaatttttccatctccctcattaacctctagaagccatatgaaggtggttggaaatcccggacccccggtccaccagccttggcctcctgcagatgctaggctcaggatgaagtgcggccgaagactgctgggaaaagaaaagaaagagccctaatgtgccatatcgggcaagccgtggggtggcccactaactgcttttttatgattgtcacttactggctctgatttaaccccacttaaagagtggtggcagcaattgtggagggcctcaaagggagactgatgcaagtgagggcaaagtattattgggaacgaggtcaaatgggtgatgaatgggccattatgaggaggggcaaactgccatcgttagggatgctgcaacaagctggacgttgatctattgtccgctctgagatcctccaacaggccattatggctcccctaatgagattgtcatgcatttctttttatgtagctattaaaatcttgtctaca

SEQ ID NO: 16298 - DNA, 319 bp, Homo sapiens
tttttagtggaaagctgtagcagaggataagggtttgggaatagcgttaaaggtcatgacttatttctcagtttttatggaatttttcagtaaaaagacttgaccgtcaaagaaaaggaaactgctgttatcaagttgagccccatatgggggttggcaggcagcagagaggcccctttcaaggtgttcgggtaaagaactcagtgaaggaactcctgttgcacatccgaagtcataaacagaaggcttctggccaagctgtggatgattttaaagacacaaggtgtgaamattagaacagttccagagaatttgaagg

SEQ ID NO: 16299 - DNA, 491 bp, Homo sapiens
attgacttcagttaggactctagagagatccaggtggcttaatctccattttcggactctggattctgcttgttcatctcagtttgcaaacatccttgtggccttacttgtctttctgccaaactacaaatgcatgatccaatatgtcattatgttctgatctgcaccctggaatgtcatccctttgaccatctgccacactccttcctacttgataatcttaaaatcctggataaatacagtgtccattgtctatttctgctttggattcacaaataatgctgatacaaattataaccatcttaactgattccacctagtatatagaaaaatttatgaaatgccaagaaattctttggctttagaaatttatctttcatgtacccatccgggaacataaaagagaggcatagtgctcattgcaaaaagagaacagatgaagtagctgtgttatgtgctggtatcttgagagttttgccaagaaaatctgg

SEQ ID NO: 16300 - DNA, 474 bp, Homo sapiens
acacccagaaggtggagccccggccgggttacgcggaccacccagctgtctggagaggtaagaactgttcgtctctttattatacagatgaagaaaatgaggttcaaagagatgaagtctcttgcctaaagtcagtgacagaaagtgacagagctgggatgtgaatcctggtctgactctacagtcccacatggtagatggaacctccgagcaacacctaaacaaagggagttgatgcctccgaacagagtaatgtcgctggagacactaagcatcgtcggcccctggcgagctccctaaatatgtgttggatggatggaagaaaggatggatagttcagagtacttcagccttgattcctccgcaacagacacctgaaacttgaccctacattggttcttggccatcgtgatcttccttggacagaatcacctttcagctccggtcatcagactttccagggcctcagaaagc

SEQ ID NO: 16301 - DNA, 449 bp, Homo sapiens
ggttttggctgggatcatccgcggcggccgggctcgtggggcgcctggagtgagggttctggttcccgccggcgaggattgttaaaatgagtcttcggaagcaaacccctagtgacttcttaaagcaaatcatcggacgaccagttgtggtaaaattaaattctggagtggattatcgaggggtcctggcttgcctggatggctacatgaatatagccctggagcagacagaagaatatgtaaatggacaactgaagaataagtatggggatgcatttatccgaggaaacaatggtaacatttcttcgccctacagtacagcattcaaaataagcctttctatttataatccagatcaccaaagaggtttctagataatttaaaagtccacttttaggcttgattattttaaaatgcttatatgtcagatcttcagtttgaccagttat

SEQ ID NO: 16302 - DNA, 585 bp, Homo sapiens
acatgtaggctatatgacacagcccattgctcctaggctacaaacccgtgaagcatgttactgtgctgaatactgtaggcaattttaacacaatggctggtcttgaattcctggcctcaagcgatcttcctgcttaagcctcccaaagtgctggattacaggtgtgagccaagaggcctggccagatgggtatgtcctggactggcatctacaaacaactgctttctatacaatatctatgcaagatctagcagagaaaaatgagatgtgggaaattatttaagcaccatagtagaccaaatgagatggacaagccattaacagaatatggtgggaattagatttaaataaaatcaattctacaatcttgtttggtttttcacatcactaacattttggaagagtgcagaggataacctacgtattttgttggaaacaaaccagatgatcttgaatttgttccaaggccaccagcaaaaagcatgatgaaagaaatgattgaaatggtggctgctacacaaagtccctaagtgactattacaaaaagagatgctgctgaccatgatggacatgcaaggagagcaa

SEQ ID NO: 16303 - DNA, 348 bp, Homo sapiens
aggaagtgtttggatattggraaaacaaaaacaaaaaaaaacctttgttctgtaagacagtatagaaagttgggagaaaggtctactccaggatcaaggaactggaccaacggrcccaagggagagtatcaaaggcaaaacaaaggaaaatgaggacaacccaatactcagaaaaaaaaacgagtaattcatggattcacaacgggcaacaaactagatgactattaggaagagaagagcaaaccttatgatctcaaaatgatttcttgttcatttgcatcctcgcatcaatctagactttaagaaatatgtgatttttaaataaatgggtatatctgcaaaaaaaag

SEQ ID NO: 16304 - DNA, 359 bp, Homo sapiens
acttttcagtccttgcgcaccggggaacaaggtcgtgaaaaaaaaggtcttggtgaggtgccgccatttcatctgtcctcattctctgcgcctttcgcagagcttccagcagcgaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtgaaaa

SEQ ID NO: 16305 - DNA, 300 bp, Homo sapiens
acttcsccgggagccggaagtcscgtstcacgttgcsctggcagcgcgcgaggctggtgagtcggcagccctgtggcagcsggsgggctggtttssatggttgcacgattaggaaccaccagctgctgcatcccatggccaggggtggcgtcsaggtggcagagcagctaggaacgcaaggcctgaacctggggccagacacccctctcccggscatggtcaacgaccctccagtacctgccttactgtgggcccaggaggtgggcsaagtcttggsaggccgtgscgsagstgctgctg

SEQ ID NO: 16306 - DNA, 297 bp, Homo sapiens
aattttgaaaatctgacatcagctgggcagtcgccccctcctcctttcctccctctactctgacacagcacttagcacctgaatcttcgtttctctcccagggaccctccattttccatatccaggaaaatgtgatgcgccacaggtatcagcgtctggatcgbcacttcacgttttagccacaagtgactcagtggaagatccagagtcaacagaggctcgtcaggaagatgtctacagaaaaggtagaccaaaaggaggaagctggggaaaaataggtgtgcggagaccagatca

SEQ ID NO: 16307 - DNA, 495 bp, Homo sapiens
tcaagcctttgttatattggattatcttctctcttaaaatacaactgtattataattgaaatgacagcccaaaattggatggtttaccaaaaccaatgaaagggatttcacacatcaatttttatttctgttttgaatagcacatgctatataataattgctagtagcaactgcagtaaaacaggtgataagttattttctctgaaaagatccagtcctagagcaggattcttcgatcattcatggcagagtgaaaaaggtttgtatggttcttgtccaaataactcagttcttaaaattcttaaaatgatcgtaaaccattatcctttaaaggtttatttgaagatgctgttaaagtacagaattttgtgtacaggtagatttttccgtccctcattaatagtgccttcttaattaatacagactggtgttagctataacaaaactccagtaaggccaaagaatcccaagttctttgtggaaaaaaaaaaaaaa

SEQ ID NO: 16308 - DNA, 457 bp, Homo sapiens
ggaagttccggtgtccgcggcgctgggtcggtggcggaggctgaggagaaggaggagcgggccgtggaggcttcgccgcctaggtactgctataaccagaatttggtagaaaaagratttacttgttggggccctcttgataaaaagagatgtggggggatyctcgacctgctaacagaactggaccttttcggtaagttctcaaatttgaatattgaaattgccagtattttaattataaatgtgtaacattttcgcctactataaatgaagatattttctctgtggagaaatagtttctgattttttaaaaatagaartttggctgggcgcggtggctcacgcctgtartcccagcactttgggaggctgaggcgggcagatcatgaggtcaggagatcgagaccatcctggctatcacggtgaaacccgtctctactwaaaaatacaaaaaaaa

SEQ ID NO: 16309 - DNA, 176 bp, Homo sapiens
agggtgctgtagagaagaatgaagcaggaaggaggaattgggacagttagaactccacagaatgaatatattgaattacaccgtaaacgctatggataccgtttggattaccatgagaaaaagagaaagaaggaaagtcgagaggctcatgaacgttcaaagaaggcaaagaaaat

SEQ ID NO: 16310 - DNA, 248 bp, Homo sapiens
catatgttctcacgtctcctactttttgtttctcgtataaaactttttgatttgaaccaaaacagtgaagatgacaacacacaccaattggatgataattgtagcgggggcggtgggggggagaagtccacgccatccatcatgcaaaattctttcagatgaggtgggaaggccgtgtacatagttatgtaaaaagagattgcttcatgagctaatggttcatatatgcaaaagggtaagatgaaagc

SEQ ID NO: 16311 - DNA, 655 bp, Homo sapiens
gctaagttcaatggcatcactgagaaggaatataagacttacaaggagaactttctgaagcgcttccagcttaccaagttgcctccatatctaatcttttgtatcaagagattcactaagaacaacttctttgttgagaagaatccaactattgtcaatttccctattacaaatgtggatctgagagaatacttgtctgaagaagtacaagcagtacacaagaataccacctatgacctcattgccaacatcgtgcatgacggcaagccctccgagggctcctaccggatccacgtgcttcatcatgggacaggcaaatggtatgaattacaagacctccaggtgactgacatccttccccagatgatcacactgtcagaggcttacattcagatttggaagaggcgagataatgatgaaaccaaccagcagggggcttgaaggaggcgtctagggctttgctcccaagggctgtggctgatgatggtaaataagaacacagaagctgtagctgaacacaggctggctggtgggcttcctaggccagcccagcttgtatgggttctggctacaccagagcaccaagagcccacttgcctgggatggccccacactgtcactcagctgttctttgatcatttttttctagattgat

SEQ ID NO: 16312 - DNA, 542 bp, Homo sapiens
ccttggggttggtgtcaggggcgagccaaccccacctctatgccctgagccctggtagtccagagaccccaactctgccctggcttctctggttcttccctgtggaaagcccatcctgagacatcttgctggaaccaaggcaatcctggatgtcctggtactgacccacccgtctgtgaatgtgtccactctcttctgcccccagccatatttggggaggatggacaactacaataggtaagaaaatgcagccgagcctcagtccccagcagagcctgtgtctcaccccctcacaggacagagctgtatctgcatagagctggtctcactgtggcgcaggccccgggcggagtgcctgtgctgtcaggaagagggggtgctggtttgagggccaccactgcagttctgctaggtctgcttcctgcccaggaaggtgcctgcacatgagaggagagaaatacacgtctgataagacttcatgaaataataattatagcaaagaacagtttggtggtcttttctccttccactgatttttctgt

SEQ ID NO: 16313 - DNA, 505 bp, Homo sapiens
ccttggggttggtgtcaggggcgagccaaccccacctctatgccctgagccctggtagtccagagaccccaactctgccctggcttctctggttcttccctgtggaaagcccatcctgagacatcttgctggaaccaaggcaatcctggatgtcctggtactgacccacccgtctgtgaatgtgtccactctcttctgcccccagccatatttggggaggatggacaactacaataggtaagaaaatgcagccgagcctcagtccccagcagagcctgtgtctcaccccctcacaggacagagctgtatctgcatagagctggtctcactgtggcgcaggccccgggcggagtgcctgtgctgtcaggaagagggggtgctggtttgagggccaccactgcagttctgctaggtctgcttcctgcccaggaaggtgcctgcacatgagaggagagaaatacacgtctgataagacttcatgaaataataattatagcaaagaaca

SEQ ID NO: 16314 - DNA, 415 bp, Homo sapiens
  misc_feature 162: n=a, g, c or t
aacacgggaacacccacctttagagatgagacacaagcaggagaagagggattaaacctgctagttttggaaaaaaaaaaaaggaaagaaaagaaaagaaagaaagaaaaacaaaaaacaacaacaaacagaaaawtgcaaaactgcagaacacgcagkranggttggwttcagaggacatggggatcagtgtgggctgtgctggtcaaggagggcttccagggagaggcaactgrggwttcactgcaattgtyccttgagaagatgaggwtcaggtcgggawttggaaacatctgagggctcaattcaacctggcttctaaaacgaacatggkgaacatagatcaactactgaacttcttttaacctckggvatcctatctgkgaattgtggggrggaaacagggtccacccgy

SEQ ID NO: 16315 - DNA, 166 bp, Homo sapiens
agccaagcttcacttctaaagtgcctacagagacttgtaaatgaaaatgcagctctgcacgagtttgaaaccgtcatacctccttctattaggaatggcatatactgaggtggtcgtaagtcttaacttctaaaattttaaataaaagactttgcacattgaaaaa

SEQ ID NO: 16316 - DNA, 169 bp, Homo sapiens
agccaagcttcacttctaaagtgcctacagagacttgtaaatgaaaatgcagctctgcacgagtttgaaaccgtcatacctccttctattaggaatggcatatactgaggtggtcgtaagtcttaacttctaaaattttaaataaaagactttgcacattgaaaaaaaa

SEQ ID NO: 16317 - DNA, 231 bp, Homo sapiens
  misc_feature 231: n=a, g, c or t
agccaagcttcacttctaaagtgcctacagagacttgtaaatgaaaatgcagctctgcacgagtttgaaaccgtcatacctccttctattaggaatggcatatactgaggtggtcgtaagtcttaacttctaaaattttaaataaaagactttgcacattgaaaaaaaaaaaaaaaaaaaaaaaaaaaaaaaaaaaaaaaaaaaaaaaaaaaaaaaaaaaaaaaaaaaaan

SEQ ID NO: 16318 - DNA, 174 bp, Homo sapiens
agccaagcttcacttctaaagtgcctacagagacttgtaaatgaaaatgcagctctgcacgagtttgaaaccgtcatacctccttctattaggaatggcatatactgaggtggtcgtaagtcttaacttctaaaattttaaataaaagactttgcacattgaaaaaaaaaaaam

SEQ ID NO: 16319 - DNA, 169 bp, Homo sapiens; identical to SEQ ID NO: 16316

SEQ ID NO: 16320 - DNA, 242 bp, Homo sapiens
agccaagcttcacttctaaagtgcctacagagacttgtaaatgaaaatgcagctctgcacgagtttgaaaccgtcatacctcccttctattaggaatggcatatactgaggtggtcgtaagtcttaacttctaaaattttaaataaaagactttgcacattgaaaaaaaaaaaaaaaaaaaaaaaaaaaaaaaaaaaaaaaaaaaaaaaaaaaaaaaaaaaaaaaaaaaaaaaaaaaaaaar

SEQ ID NO: 16321 - DNA, 175 bp, Homo sapiens
agccaagcttcacttctaaagtgcctacagagacttgtaaatgaaaatgcagctctgcacgagtttgaaaccgtcatacctccttctattaggaatggcatatactgaggtggtcgtaagtcttaacttctaaaattttaaataaaagactttgcacattgaaaaaaaaaaaaaa

SEQ ID NO: 16322 - DNA, 171 bp, Homo sapiens
agccaagcttcacttctaaagtgcctacagagacttgtaaatgaaaatgcagctctgcacgagtttgaaaccgtcatacctccttctattaggaatggcatatactgaggtggtcgtaagtcttaacttctaaaattttaaataaaagactttgcacattgaaaaaaaaam

SEQ ID NO: 16323 - DNA, 172 bp, Homo sapiens
agccaagcttcacttctaaagtgcctacagagacttgtaaatgaaaatgcagctctgcacgagtttgaaaccgtcatacctccttctattaggaatggcatatactgaggtggtcgtaagtcttaacttctaaaattttaaataaaagactttgcacattgaaaaaaaaaaa

SEQ ID NO: 16324 - DNA, 242 bp, Homo sapiens
agccaagcttcacttctaaagtgcctacagagacttgtaaatgaaaatgcagctctgcacgagtttgaaaccgtcatacctccttctattaggaatggcatatactgaggtggtcgtaagtcttaacttctaaaattttaaataaaagactttgcacattgaaaaaaaaaaaaaaaaaaaaaaaaaaaaaaaaaaaaaaaaaaaaaaaaaaaaaaaaaaaaaaaaaaaaaaaaaaaaaaaar

SEQ ID NO: 16325 - DNA, 413 bp, Homo sapiens
  misc_feature 378: n=a, g, c or t
ttcctggttttaagcctctgttgggaactgggctctcaggcagatgggattgggtacttttgctacttgctgaataactcttggccagtgactttatgtctggacctcagtttattcatgtgaaaaatggacatgataacaatagtcattagatggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccakacccggattgtggccctgaatgcccacaccttcctgcgtaatggangacactttgtgatttccattaaggccaactgcatt

SEQ ID NO: 16326 - DNA, 389 bp, Homo sapiens
aaaaggaataaatagttccggcgcgggtkttgagagcggtgtggtaggtgttgtagccgctatggtgaagttcgctttgtagcggccccggctagagagttggcctgttccctgcctttgtgacccggagagcttttgggaactggtttgtggcctgtttgattcctgtcagaggtttgactgacccaagacagtatcgaaaatgcatattaagtcaattattctagagggattcaagtcctatgctcagaggaccgaagtcaatggttttgaccccctcttcaatgctatcactggcttaaatggtagtgggaaatccaacatattggactccatctgctttttgctgggcatctccaacctgtctcaggttcgggcttctaatttac

SEQ ID NO: 16327 - DNA, 587 bp, Homo sapiens
atttataaattgtgtgaagcgaatttcccgtttggcaatcatttactgatttgcagtgatgaatatttttatgagaatttaaacttagcaagaatggccatggaggcaaagcttcacccagacccatcccactctcctgtgatccaggtggtccaggagcccaggacaggccttttctgtgggccctggccagacagggttacctggtgaggtgcagagagtccctctagtggccattttgtatggtagttgctaatgcagaacaagttctgtcttgggcttaaattgactgaagactttagggggaaagaatagtaaatgcatgtaaacaaatggggacactctgttcaggagaataatccgactggcatttgtggcagtttttgaaatgtaaatgtattcatgtgtgttcttgtaaatacgtgtcgctcagatgtcctttgaagtgggagggaatcaatccggggataatttcaaatggaatagagtattttgatattgttcattcagagggtgatgtgtacatatctatattgtatatatgtgatgaaaatgcattggctttttggtgcagataacaacctgct

SEQ ID NO: 16328 - DNA, 559 bp, Homo sapiens
atttataaattgtgtgaagcgaatttcccgtttggcaatcatttactgatttgcagtgatgaatatttttatgagaatttaaacttagcaagaatggccatggaggcaaagccttcacccagacccatcccactctcctgtgatccaggtggtccaggagcccaggacaggccttttctgtgggccctggccagacagggttacctggtgaggtgcagagagtccctctagtggccattttgtatggtagttgctaatgcagaacaagttctgtcttgggcttaaattgactgaagactttagggggaaagaatagtaaatgcatgtaaacaaatggggacactctgttcaggagaataatccgactggcatttgtggcagtttttgaaatgtaaatgtattcatgtgtgttcttgtaaatacgtgtcgctcagatgtcctttgaagtgggagggaatcaatccsrggataatttcaaatggaatagagtattttgakattgttcattcagagggtgatgtgtacatatctatattgtatatatgtgatgaaatgcatt

SEQ ID NO: 16329 - DNA, 489 bp, Homo sapiens
ataaaccaacatacaggcttcagatttacttctgagtccaaaacaatttgtgctatccagggtagttaactctgggttaaacaagtacagggtatagattccctcttcaggtctacacaggaatttttaccatagggaaaagtggggagagctcaaacgtattaataaggaaggtaatttgtttttcttttacctaaaagaaaagaaaattccttctgtgactacaggtctctgagaaattatctttcaaaagagatttcattgctcataagagtgttgtggcctattgataaaaacaattttgttcagtttcttgtcttgaaaaaaaagtggccttagctttttgcaatacttgaataaagtgtgtactcgcaaaagaatttctgtagcacagcattagagactcataacttttctgcaagaaatacaaacttacatcttccttttactaccttaagaatactagtgaataaaacattaattcaaaga

SEQ ID NO: 16330 - DNA, 482 bp, Homo sapiens
agaaagatggcggagaagagcaaagaaaaatccctttggttccagaaaatctcctgaaaaagaggaaggcttatcaagccctcaaagccacccaggcaaagcaggcacttttggcaaagaaggagcagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggattgacggcgtgagtttactggtgcagagaaccattgcaagacttcgcctaaagaaaatttttagtggtgtctttgtaaaagtcaccccccagaatctaaaaatgctgcgtatagtggaaccttatgtgacctggggatttccaaatctgaagtctgtccgagaactcattttgaaacgtggacaagccaag

SEQ ID NO: 16331 - DNA, 396 bp, Homo sapiens
  misc_feature 134..135: n=a, g, c or t
acacatcctgtctctgtgtgtggagctggctggaatctctcagcctcacctgccagacaacaccccctccttcctcaccctgtctcctgcattctcctgaaaccttcatccacacaatgcctcccaacctcacnnsctactacssctttgtctcgcagaagaacatggaggactacctgcaagccctaaacatcagcttggctgtscggaagatcgcgctgctgctgaagccggacaaggagatcgaacaccagggcaaccacatgacggtgaggacgctcagcaccttccgaaactacactgtgcagtttgatgtgggagtggagtttgaggaggacctcaggagcgtggacggacgaaaatgccagaccatagtaacctgggaggaggagcacc

SEQ ID NO: 16332 - DNA, 504 bp, Homo sapiens
acagagggtggggcagacgctccgtttccggtggcagggtctggggaagcggcggcaggcgccattgtccggccgcgaaggtggcaagaagaagccactgaaacagcccaagaagcaggccaaggagatggacgaggaagataaggctttcaagcagaaacaaaaagaggagcagaagaaactcgaggagctaaaagcgaaggccgcggggaaggggcccttggccacaggatggaattaagaaatctggcaaaaagtaagctgttccttgtgcctgaggagatggtgaccctttatttcatctgtatttaaacctctctattccctgccataacatcttttgccacgtatagctggaattaagtggttgtcttggagctgttggtacatttaagaataaacttttgtaaaaahaagaaaaatcttacagtggctcatcatctctttagttgttttcactaagtcgttcctaccataactgtgaatttaaaggtaaaaaccagc

SEQ ID NO: 16333 - DNA, 146 bp, Homo sapiens
aagaaaacagctaattatatcaccaagagacccagggcatatggtcactctcagctggcccagcctgtttctacttgctttgcatgattgttctggatttttcaaaataataataactaccaaccaaaaaaaaaaaaaaatgcgaa

SEQ ID NO: 16334 - DNA, 487 bp, Homo sapiens
ttcgggtggttctcctgcctcggcctgccgagtagctgggactgcagtcgcgcgccaaccacccccggctagtttttttgtttttggtggagacgggatttcaccatgtttgccgggatggtctcgatctcttgtgctcataatctacctgcctcggcctcccaaagtgctcggattacagacgtgagccactgcgcccggcccgttggcttgctttctagatactgggaatagatcttgttatagtatgtgataaatagatcttgttatagtatgtgataaaatgccatgatcaaataaattacttatatcctgtttggtgatttttagaaaaacatatttatctacatctaaaatacttattttaattttaaacacttgatggtatgaaatgaaattttgttactttaccattgtaactatgtcataaagtcataaagtacctgtccccaaaaaggcaaccagtaaatatttttgagtaaatgaa

SEQ ID NO: 16335 - DNA, 493 bp, Homo sapiens
gaggagtcccacggtgtggcagatggagacacccaggagaaagaagagggcgaattggaagaggccacccagaaaggacggtgtgtgacactagggagccaagcatggagagccgaggactaacgcttggaaggaaatgtggaccagaaggttccggatgagggaaggactggcggctacactctgccttccgagacaacgaggaataatctcacttcagtcagttcaacccttgtaaaacagctactgtgtgcaagacacggagggaaagctgaagtagagaaaccacagacgctgtcttcaaagggtttaatctaatattagtgatgagaaaaatagggtgcagagcttaaggcatcctggaaaaacgtatgtagcgccacatcgcgaaaatctctcttctgggacccctctcccaaaaacgtttcttcgccctcttctcccccttctgcctccactctttctggacttcagatatcttttgagaagcctg

SEQ ID NO: 16336 - DNA, 442 bp, Homo sapiens
acaaccgaacccaacaccggggcccaacggcaggggcttgggcaggagcaaggtccgagggctgccaggtccacgctgcttttatgagctgtaacactcaccgcgaagatctgcagcttcactcctgagcccagcgagaccacgagcccaccgggaggaacaaacaactccagacacgctgccttaagagctgtaacacttgccgtgaaggtctgcagcttcactcctgagccagcgagaccacgaacccaccagaaggaagaaactccgaacacatctcaacatcagaacggacagactccagacgcaccaccttaagagctgtaacactcaccgcgagttcagcggcttcattcttgaagtcagtaagaccaagaacccaccaattccggacacagtagcatttgggaataataagaattgtagctgggcatggtggtac

SEQ ID NO: 16337 - DNA, 513 bp, Homo sapiens
aagcacaaccgaacccaacaccggggcccaacggcaggggcttgggcaggagcaaggtccgagggctgccaggtccacgctgcttttatgagctgtaacactcaccgcgaagatctgcagcttcactcctgagcccagcgagaccacgagcccaccgggaggaacaaacaactccagacrcgctgccttaagagctgtaacacttgccgtgaaggtctgcagcttcactcctgagccagcgagaccacgaacccaccagaaggaagaaactccgaacacatctcaacatcagaacggacagactccagacgcaccaccttaagagctgtaacactcaccgcgaggttccgcggcttcattcttgaacaatgaatcctccaatgtacctgactctccctttgcgaagagcatctccgtggcagaaatctgaaaatgcccctggggagacacatgcacaagacagtgagtgatgcagccgtttcccacgtatctcacaatgtacttctctggtct

SEQ ID NO: 16338 - DNA, 205 bp, Homo sapiens
gaccttgatgctgatgagctgatctctgccgcctgcgtggtttatgctgagctcatccagaaggatgttcctcagacattaaaggatttcttcctctgaggacaccaaagcccgcagtggactgatgccttcgatgggcaggatgaaggccmakgggcactggagtgagggagtagataaaacagctgcaatataaacagcaaaa

SEQ ID NO: 16339 - DNA, 212 bp, Homo sapiens
  misc_feature 37,153: n=a, g, c or t
gaccttgatgctgatgagctgatctctgccgcctgcntggtttatgctgagctcatccagaaggatgttcctcagacattaaaggatttcttcctctgaggacaccaaagcccgcagtggactgatgccttcgatgggcaggatgaaggccangggcactggagtgagggagtagataaaacagctgcaatataaacagcaaaaaaaaaaaa

SEQ ID NO: 16340 - DNA, 241 bp, Homo sapiens
gaccttgatgctgatgagctgatctctgccgcctgcgtggtttatgctgagctcatccagaaggatgttcctcagacattaaaggatttcttcctctgaggacaccaaagcccgcagtggactgatgccttcgatgggcaggatgaaggccaggggcactggagtgagggagtagataaaacagctgcaatataaacagcaaaaaaaaaaaaaaaaaaaaaaaaaaaaaaaaaaaaaaaaa

SEQ ID NO: 16341 - DNA, 216 bp, Homo sapiens
gaccttgatgctgatgagctgatctctgccgcctgcgtggtttatgctgagctcatccagaaggatgttcctcagacattaaaggatttcttcctctgaggacaccaaagcccgcagtggactgatgccttcgatgggcaggatgaaggccaggggcactggagtgagggagtagataaaacagctgcaatataaacagcaaaaaaaaaaaaaaaa

SEQ ID NO: 16342 - DNA, 210 bp, Homo sapiens
gaccttgatgctgatgagctgatctctgccgcctgcgtggtttatgctgagctcatccagaaggatgttcctcagacattaaaggatttcttcctctgaggacaccaaagcccgcagtggactgatgccttcgatgggcaggatgaaggccaggggcactggagtgagggagtagataaaacagctgcaatataaacagcaaaaaaaaaa

SEQ ID NO: 16343 - DNA, 219 bp, Homo sapiens
gaccttgatgctgatgagctgatctctgcsgcctgcgtggtttatgctgagctcatccagaaggatgttcctcagacattaaaggatttcttcctctgaggacaccaaagcccgcagtggactgatgccttcgatgggcaggatgaaggccaggggcactggagtgagggagtagataaaacagctgcaatataaacagcaaaaaaaaaaaaaaaaaaa

SEQ ID NO: 16344 - DNA, 229 bp, Homo sapiens
gaccttgatgctgatgagctgatctctgccgcctgcgtggtttatgctgagctcatccagaaggatgttcctcagacattaaaggatttcttcctctgaggacaccaaagcccgcagtggactgatgccttcgatgggcaggatgaaggccaggggcactggagtgagggagtagataaaacagctgcaatataaacagcaaaaaaaaaaaaaaaaaaaaaaaaaaaaa

SEQ ID NO: 16345 - DNA, 221 bp, Homo sapiens
gaccttgatgctgatgagctgatctctgccgcctgcgtggtttatgctgagctcatccagaaggatgttcctcagacattaaaggatttcttcctctgaggacaccaaagcccgcagtggactgatgccttcgatgggcaggatgaaggccakgggcactggagtgagggagtagataaaacagctgcaatataaacagcaaaaaaaaaaaaaaaaaaaaw

SEQ ID NO: 16346 - DNA, 239 bp, Homo sapiens
aaaattatttttccctctggggtgattacaaccacacgggagctgtgatgagagatgaaagaactgaccctcaaggagaccaagggataatgaccatgatgatcacatgatagcccagtcaaactggccacttggttctcaaaccctggccttttaagtcaaaattgtattactacactaaatgtaaaatggcatcttaccaaaataaatggaatctttgaagagaaaaaaaaaaaaaa

SEQ ID NO: 16347 - DNA, 314 bp, Homo sapiens
  misc_feature 78: n=a, g, c or t
gagtatgttctagaacttgcttctgtgtttgtgtcttcaaaacagctgctatcaccaataattaaaccataaaaaacngaaattatttttccctctggggtgattacaaccacacgggagctgtgattagagatgaaagaactgaccctcaaggagaccaagggataatgaccatgatgatcacatgatagcccagtcaaactggccacttggttctcaaaccctggccttttaagtcaaaattgtattactacactaaaacctctttccaaaaaaaaaaaaaaaaaaaaaaaaaaaaaaaaaaaaaaaaaaaw

SEQ ID NO: 16348 - DNA, 499 bp, Homo sapiens
aggggatataaaaataatgcattktatgccggaarggataaatctggggctgagtacaagcaaaacaagaccaaaggaagctacctgagcaggtattccagatactcatgtcatacaccaaggttgtaccartgcccctttctctgtgacacatccatccactggraactttcgtacaactagctgaaagaagagraacatcctatttcatgtcactggagccctaatgatcgcagccatttcaggaaatgccatcaattacartgaggagctcattcakaagtgaaagatgagttccattctctgttacttagagctttaccagtacctggcagttctagactacccttcttgaagatctgcccttcttkaagacttaccctatggakttagaaattgctagccagctcctataatcaagttaattaactgatctatatatttaaccaataactattgagcacctactgtgtcatccctacaataatactggacccag

SEQ ID NO: 16349 - DNA, 306 bp, Homo sapiens
gagtatgttctagaacttgcttctgtgtttgtgtcttcaaaacagctgctatcaccaataattaaaccataaaaaacyaaaattatttttccctctggggtgattacaaccacacgggagctgtgattagagatgaaagaactgaccctcaaggagaccaagggataatgaccatgatgatcacatgatagcccagtcaaactggccacttggttctcaaaccctggccttttaagtcaaaattgtattactacactaaaacctctttccaaaaaaaaaaaaaaaaaaaaaaaaaaaaaaaaaaaa

SEQ ID NO: 16350 - DNA, 447 bp, Homo sapiens
aaaarrcarctgctatcaccaataattaaaccataaaaaaccgaaattatttttccctctggggtgattacaaccacacggaaggtttkatgagagaggacaccattcatgtcagattaaragccgctcttctccagtatgatctcatcttaatttagataatgacgtccacaacaatccattgccaagtaaagtcacattctcaggtgctgaagatataccaatgaataaaatagacacaaaagcaacaacaacaaaatacctgctctcaggagctgcttacataccagcagagatgggcaaataaagggcatggctgagaactgcaatgagtgcctttggaaggcccaggggaaccacggtggacgtcacggccaaaagattactgccgaggactgcatctcaaggaatgggcaaggggaagacagaatcaggctaactcagcaa

SEQ ID NO: 16351 - DNA, 304 bp, Homo sapiens
acacatccggtagagttagagcccgtgcggaggcggtgcggasattttcggctctgagcggctgggcgaccggcgcgtcgtgcggggctgcggcggactcccttwaagggaaggtgcaagaggttggcagcttcgattgaagcacatcgaccggcgacagcagccaggagtcatgagcgacasscccgagcagaactacggcgagcgggttaatgttgaagaagggaaatttcggaagtcgtcatttgacaagttttataaatgagtatttggaagctcagggaataagtgaagctgaaatttg

SEQ ID NO: 16352 - DNA, 416 bp, Homo sapiens
acacatccggtagagttagagcccgtgcggaggcggtgcggasattttcggctctgagcggctgggcgaccggcgcgtcgtgcggggctgcggcggactccttaaggaaggtgcaagaggttggcagcttcgattgaagcacatcgaccggcgacasagccaggagtcatgagcgacassccgagcagaactacggcgagcgggttaatgttgaagaaggaaaatgcggaagtcgtcatttgacaagttttataaatgagtatttgaagctcaggaataagtgaagctgaaatttgaaaaaawaaaagaaagaatgcatgctaattatcagaccagaagtcccacttgtagaatattgagcaatttgtgtgaagtggggaagatgaaagaagtcagaatttgaaacggaagaataa

SEQ ID NO: 16353 - DNA, 289 bp, Homo sapiens
agagttagagcccgtgcggaggcggtgcggasattttcggctctgagcggctgggcgaccggcgcgtcgtgcggggctgcggcggactccttaaggaaggtgcaagaggttggcagcttcgattgaagcacatcgaccggcgacagagccaggagtcatgagcgacastccgagcagaactacggcgagcgggttaatgttgaagaaggaaaatgcggaagtcgtcatttgacaagttttataaatgaktatttgaagctcaggaataakgtgaagccaaaaaaaaaaa

SEQ ID NO: 16354 - DNA, 447 bp, Homo sapiens
agtgtagccgggtcagctggacagggtcatcctgagggtgcgactccgccgcgatggtgacccggttcctgggcccacgctaccgggagctggtcaagaactgggtcccgacggcctacacatggggcgctgtgggcgcgtggggctggtgtgggccaccgattggcggctgatcctggactgggtaccttacatcaatggcaagtttaagaaggataattaattacacaaacccttcacagactgctctggtgcctggtggygctagctcctcccacctcagcacctgctgcatctggagcagcccaagcctcaggatggacaagaggaaacccacagctcagcttcaggcttcttatgtttctgaaaacagcttggatattttaatgcacgttgcattaaacctcactgaaacctgctccgtgcccggatgttgatcatgctggt

SEQ ID NO: 16355 - DNA, 436 bp, Homo sapiens
agtgtagccgggtcagctggacagggtcatcctgagggtgcgactccgccgcgatggtgacccggttcctgggcccacgctaccgggagctggtcaagaactgggtcccgacggcctacacatggggcgctgtgggcgcgtggggctggtgtgggccaccgattggcggctgatcctggactgggtaccttacatcaatggcaagtttaagaaggataattaattacacaaacccttcacagactgctctggtgcctggtggygctagctcctcccacctcagcacctgctgcatctggagcagcccaagcctcaggatggacaagaggaaacccacagctcagcttcaggcttcttatgtttctgaaaacagcttggatattttaatgcacgttgcattaaacctcactgaaacctrcaaaaaaaaaaaaaaaaa

SEQ ID NO: 16356 - DNA, 534 bp, Homo sapiens
aagggataaatctggggctgagtacaagcaaaacaagaccaaaggaagctacctgagcaggtattccagatactcatgtcatacaccaaggttgtaccagtgcccctttctctgtgacacatccatccactggaaactttcgtacaactagctgaaagaagagaaacatcctatttcatgtcactggagccctaatgatcgcagccatttcaggaaatgccatcaattacagtgaggagctcattcagaagtgaaagatgagttccattctctgttacttagagggtggatatcctcctccactgaatgcaaactattaagtaatgaaaagacagcactccaagcaatatagatttataggccaacctggcaatcaagggtaactgacatgaaaatggattgcttcacattttaattacaaagatactcttcagtaccataaattgaagaaaacactaactttttgtggctactgtaattgtcaaagtataattacctgtgttttctcacctacgtatttgagatagacaaaac

SEQ ID NO: 16357 - DNA, 474 bp, Homo sapiens
tagaaaaaggagcttacctcccacctttggtcctaagtccctgccccctccccttcacaccataactaggtaacagtttgataactagggaagaaagcagaacagttaagcagccgccacatccccgctggctgggggcctcactccaggaaggggctggactggctgtcctttccagtggcstggctccgctgtgtggatggggagatcggggccagaggcagaaccctggtgagtaagctccagtcctgctctctacccagcccatcttgcctccatggtgcctctggaggcctctgggctctctaacaggggctggtgggcaccaagagccaatggagtagacccctggctggtaagggccaagtcccaccggttgcttctgggaaggggtttctaacactagtctgtgtgctgtggttcctggggtgccctccactgccctctgttcagtaacagggccttgctaatcgg

SEQ ID NO: 16358 - DNA, 473 bp, Homo sapiens
gagtgattccaatggaagcaactgcagaggtggtgtggccgtgccgggacttgcagagcttttctgcttattttcaagtgacgcccgtgttggcaccttagctccaggtgcagagctttaaaggattatggagtctgaagaccaaatgggatgatggagaacagctattcagtggtacaaatgtaaatgctcccaggcccgggcagaaaagagaaaacatttccatggaagaggaaacaggaaattccaacagatcagcaacagttggagtgctaacctgtcactggaatggaaaaaaaaatgctgtcgttgacacatcttttccttgtttttgacacaaattaggctgaagtacagtgatgccatctcgactcactgcaacctccgcctyccaggttcaagtgactctyctgcctcagcctyccgagtagctgggactacaggcatgcggsaccatgcccagctaatttttg

SEQ ID NO: 16359 - DNA, 494 bp, Homo sapiens
agcgagtcagggagtgattccaatggaagcaactgcagaggtggtgtggccgtgccgggacttgcagagcttttctgctwattttcaagtgacgcccgtgttggcaccttagctccagagagccacatggagaacccacatataggtgttggagcagacagcctggcagaggtcccagcaggcggccagcaccaacttgccagctgtgtgcgagtgagctgtcttggaactggagcatccagcttcaggtcaagctgccctgattgataccacatggagtcgaggagcctggtgagtggaggagactgaagatggcgagagagcctggacctcaacatgagcatctggagccatttggcagcattaggctgtgaccgcttagagaaccgaaagatggagtctcgctctgtcgccaggctggagtgcagtggcgtgatctcggctcactgcaamctctgcctcccgggttcaagtgattctcctgcctcagcctc

SEQ ID NO: 16360 - DNA, 432 bp, Homo sapiens
aaatgaagggtaacattcatgtcctcattgtctcatcttagtgagacagaagacctaaaatttctctgaaaatcagaaaactctgcataaaacatggaaggcttcattcataatagtaacccagagaggccagccaaagatgtgctacgttatattttatggaagaaaaatcacttatagaaactgatggcgagaaactcaggactttgttaaatattcaagacctacattacagactgtaaaaagaggagcccactgcccaatggagaatgtttttgaagtccacagataatatcgtctacaatttattttctctgctgaaaaaagaaactcatgcaggaaacattttgaaaccaagtaaataaaacagagatgcccgcaatttcctgcaagtctgactaaaaataggaaactctgcaatcatgaaagtcg

SEQ ID NO: 16361 - DNA, 281 bp, Homo sapiens
aaaaagaggcagagcgcgcgcaggtgtgaggggcggcgacatctgtggggttcagagcgtctgtcagtcaccgacgggctccggcttcacgtgggctctcggcctgtggagtcctcacttctcggtggtcggcgtagtgtcagtgtggggcttgtcaccgggagcggggtctacagcgcccaccctcaggcctttccatctttcacctccggactcgaggcctccagcgttctgtgagggccaatttggccatttattttttccaaaaaaaaaaaaaaaaa

SEQ ID NO: 16362 - DNA, 97 bp, Homo sapiens
cttttcagtccttgcgcaccggggaacaaggtcgtgaaaaaaaaggtcttggtgaggtgccgccatttcatctgtcctcattctctgcgccatcgca

SEQ ID NO: 16363 - DNA, 506 bp, Homo sapiens
taaaatgtttgtgggtaaaagctaatggccaaaatggttccaatcattcatactagttaaaaattatgtgttgaaataagtggaaaagtgcaatccatccacccttatgattaacgtagatgatttttatacctttttctgatgtacctcttgaccttctccttcccttcctaccctttctaagtatttccagaaatacctgattttgaatcattcaacagtagaaaaagaggcatattttcattacttgacaatgtgggatgggtgcaatttattccatcttcactaaaatagaagcaattccataggtaccataaacctattttaggtaccacaaggtgtctttttacacagctcatttgaatacaggtgttctgagaaggggtttctattttaaaattaccatatcaaaataaatgtgccttatttttttataagtcttgttaaatcagtgtccatattactgtttggggaagggggaatgttgtggggtctgggagagggtt

SEQ ID NO: 16364 - DNA, 457 bp, Homo sapiens
tgttttttgaatcatcaattctttctcattctccatttatctgaaggttcttttgcccttattaacctctcaacttttattgctgtattctagtcagaccagaacatacttccactacatcagttacttggcatcatttcacctcagtttattattgccaaataataatttgtgtcagcattttcaactatggttattcatccaacccttggatctctttgagtctactgataatctccactggaaaggtggaattgaaatgtggtccacattttaactagctatttcctggggctgtatttttcagaatatgctgagctacatttgctgcaatctgttgctattcagagtttaagtttcaggagaaaacaggaacaatagaacactctgcctgttatttttgttgtaatcaagcttttccacagttcttgaaaagtactatgtttcaaatttcagg

SEQ ID NO: 16365 - DNA, 438 bp, Homo sapiens
cacctgagtcccgtctccattctaggtatgagaccagcggcatcggggaggcacgggttaaggaggtgctcctggacgaggacgacgacctgtggatagcactgcgccacaagcacatcgcagaggtgtcccagtaagagccccctgcccccttctccagcgaggcgcctctacmcagctgctattgatgatgcgttcactctgggcacctcgcgggggctcatcactgtgtgaattcgttttcttggcagagtcaccaacatgctaacccgtaatgataaawyccttctgttctctgagcttgagctactccgacttcatgaagttagaaaatcaattctgtattagggctgcttttaggattcttggaaaacatatgtagctctctcagaaaaatgcattacaaacattaaaaatttaaagctagttcattctatt

SEQ ID NO: 16366 - DNA, 290 bp, Homo sapiens
  misc_feature 259: n=a, g, c or t
aaccttgggggcctcactgcagccgccgctstgttggagtgggctttgcgagtctgaacgttggcggggctaggctcgttaactgccgagagcctccgggtttgcggtggaggacgctgaggcccgtggggggcaggcacccgggcgccgggcctcccagccgacatgtctctagtggcggaasttcgtctcccagattgcagacagaatctcgctctgttgcctgggctggagtgcagtggcactgtatccggaattngggggttcttggtctcactgacttcaagaat

SEQ ID NO: 16367 - DNA, 519 bp, Homo sapiens
cacttaatatggaatgtttttgtcagactgtcctttgttggaatactttagctgttcagctactttgactcctaggagagaatttagttaaggttcaaagtaattaactggctttgccagtggtgagtcccacaccattattcacttagtagtcatataaatgtttttatttaaacttctctctcttcaatgctgagaataaggctttaaattactgattcacctttaaaggaatgttgtgagaattaatgtaatttctgtttctgtttccatctaaacttctttataaaaagagggattagtttttttgttttggggtaagcacctaatttatccagtaaccaacaaccctaaccattggcatatatagtctttcactcagaaataaacaaaaactgtttggtatatctgtatcattgctaatcttgtgcactttactttttgggcagtaccatacatagtctgaggctattgacttaaaccaataactgtactttatgtaatgactcttaaatttgg

SEQ ID NO: 16368 - DNA, 391 bp, Homo sapiens
actgctctaagctgcagcaagagaaactgtgtgtgaggggaagaggcctgtttcgctgtcgggtctctagttcttgcacgctctttaagagtctgcactggaggaactcctgccattaccagctcccttcttgcagaagggagggggaaacatacatttattcatgccagtctgttgcatgcaggctttttggcttcctaccttgcaacaaaataattgcaccaactccttagtgccgattccgcccacagagagtcctggagccacagtcttttttgctttgcattgtaggagagggactaagtgctagagactatgtcgctttcctgagctaccgagagcgctcgtgaactggaatcaactgcttcagggaaaaaaaaaaaaaaaaaag

SEQ ID NO: 16369 - DNA, 452 bp, Homo sapiens
  misc_feature 132: n=a, g, c or t
cagaggagtcccgcgttcggggagtatgtcaaggccgtgacccgtgtattattgtccgagtggccggaacggagccaacatggcagcggggttcgggcgatgctgcagggtgagagggagcccagcgtgcgntggggctggaacatgggtattgtggtgtcggagcagggggccctgggcaaaaataggtgcggccgggaggagtgggaagtcgggctgaggaaggagccagcctaggggcccccaacctgctttcacgcctcctaccaccggacggaacgtagcctagcgtttcattttccgtatcctcccgtcagcgaccccgttatagccggcatcctctctttagaatatcgtttttctttctctggtaaaccctccaaatatttaccgcgggaatcccacctttttccaaagtgaccccgtctctgtgtcagaaccacgggaaaaag

SEQ ID NO: 16370 - DNA, 478 bp, Homo sapiens
aaaaagagggcctgagtgttacctaacaggccaccatagccacagcctatgtctgcaaactccacttgggcctgagctctcttttctttcttatcctttgggtcatcgtggctctgattttgagtgagtggagcragaactctgggtatagctcagaccagtccatctcctctggcttcacagggctattggaaagaagacataagaagcatgagaaggccctgagcctgtgcgattatttcgagagtcaaaatgtggatttccgaggcaagaagktgatcgaactgggtgcggggacaggcatcgtggggatcttggcagcgctgcagggtgcgtgastggctttttacgggagagagtggggacccaggggcgcggagaaatggtcacttcgtggatctttgggggakaggggagaactttgggcccagtctaaccccttctttttaacaaatttttttttaaaaaaaaaaaaaaa

SEQ ID NO: 16371 - DNA, 406 bp, Homo sapiens
acaagaaattctccaagtttccaagaagggaagatggagtggagggcgcccaccctatctccagtggacatcccctgggctactcctctcctgatgagaaaatgctcacttcagccaagtgcagaatggtcccctttgttttcgtgggtatcagtggagaatgagatccttcatatggaatctccctgtgttgctcaggctgatctcgaactcctgagcccaagcatgcatcagcctctcagtagctgtgattacaggcattgagtcaccactcctgagaaataacaggactttggtgctattctccaagctgaaagccatcctcttcggccctgaggacacagctttttctgccataactcactgtctccactggctcaattagccaattagtggcattgtagag

SEQ ID NO: 16372 - DNA, 542 bp, Homo sapiens
cagttgtttcgggacgcgccgagcttcgccgctcttccagcggctccgctgccagagctagcctgagcccggttctggggcgaaaatgcctgcccttcacatcgaagatttgccagagaaaggaaaaaactgaaaatggaagttgagcagcttcgcaaagaagtgaagttgcagagacmaacaagtgtctaaatgttctgaagaaataaagaactatattgaagaaccttctggagaggatcctctagtaaagggaattccagaagacaagaacccctttaaagaaaaaggcagctcgtagttatttcataaataacttggggagaaactgcatcctaagtggaagaactagtttgttttagtttttcccagataaaaccaacatgctttttaaggaaggaagaatgaaattaaaaggagactttcttaagcaccatatagatagggttatgtataaaagcatatgtgctactcatctttgctcactatgcagtcttttttaagragagcagagagtatcagatgtacaattatggaaataa

SEQ ID NO: 16373 - DNA, 515 bp, Homo sapiens
cccggagagggggagccgcggggacgcagcgacagactcggggtgctggcagcggcasccacgcctcccagggattgcaggcctgggcgccggggttggaccagtctcccgggcatggcacgccctggttattctgtacccgtgatttgtggcggggcaagacgttaagttgggtgacaccgaggtgagccacggtccggcaccagatgaggaaccactgtctcaataagacaccagtgatgctgttaaacaaggacaatccggttcatggattgtgacaacgcacgctgacatcaagcagaccctgccgtcagtacagagggcaccacagtgaccaggaactgctgtcctttcataccaggttttaggaggctttaccagaaggaatggaaaatgctggtgggcagtaagattgaaacagcatctgaggactggttctgcacaaaaccttaaattcttcaaggactttgacatttgtttattcttgtaacaaattaaaacctatcctgtgtgtt

SEQ ID NO: 16374 - DNA, 495 bp, Homo sapiens
aaccttacaccccatctttgactcagttccccacacccaaagatcccagcctagggatggggtacagggactttaaatagtccctaatccctaatttgcactagttaaccctggtcagggtccctgtatttccttccagtgggggagataaatgtttgctcctaattctctttgaaaactgggcctccctgctctgtgattggataaatatttcccatcccacccacctccccccaaaaaatagctcacaaggggagagccagtatgggggagcaaatttgacaaatgggaattagaggagtgcagttttaaaaggaaaagttgctgtcatcaatggcagccttttccccagctactgtttttggggccaagatggctgccctagcagcaatcactgccaagggcaagatcatggcttttggagggaggtgagtttagggagggccaggaccatcctcctacccctcataccctcccagcatatacaaaagggga

SEQ ID NO: 16375 - DNA, 436 bp, Homo sapiens
tagggagggtgtcacccactgtgcatgagcacagtgacacacacctgtcctggraagaattcctgcttttttatttatttawtttawtttawtttawtttawtttawttttactagtctcactgaaggtwvwagatttcttttggaatcaaagtagatttcattttcctttgtgatgtcattagaaatttttagcctttgtgtcaatggaaatggagagaaagaaagttcatgatgacatcacaagattctgttgccttgaggactttgggcaaaactaagtaaaatgcataattcccttgtgtgcgtgtgttccccattctgctacgaagcagtcaaaatagcacatcttatgtcttcccgtgagctacaaggctgtctctcagagccccattgttccataaatgcatgtcagagtctaccacagtctggtctam

SEQ ID NO: 16376 - DNA, 491 bp, Homo sapiens
agggttccgtctgctcatcagacaacagatatttattgaatgttctttgtcatgcgtcttcaagatgtgccatggccattcatgcaagtttcaaggactctgaatctgttgagaaaaagaggttacgttccaattctgctttaattccaacccaaatgctgagaaacactccatggaatttaattacagggcgataactgtgatcttaccaagatttatgaacaggaagatccttggtgattgtagtcagtcaaagggtggctttgacatagcacctatctgttagggcaaatactgccagggaaaaggtgacatttggaatcatctgggattggactcttgatcaatagatgcgaaatgtcaggtggacatgagaactgttggtctttggtacatatgtgttgcaatgagtaaggatgagtaatgtgaaggaaaagtagaatcttgggaccccaaactcactatgccaaagggaaagttaagcgtgggag

SEQ ID NO: 16377 - DNA, 364 bp, Homo sapiens
  misc_feature 283,307,315,320,325,335,364: n=a, g, c or t
cttttctatgtcaattttctggcaacaaagtctgtggccaagaaagaagctaccgactccttcgaccacaaaaagttcttccaaatggtcggcctgaagaaaaagagtgcggatgatgtgaagaaggtgtttcacatgctggrcaaggacaaaagtggcttcatcgaggaggatgagctgggattcatcctaaaaggcttctccccagatgccagagacctgtctgctaaagaaaccaagatgctgatggctgctggagacaaagatggggacggcaaaattnggggttgacgaattctccactctnggtggctngaaanstaangaaggcactngactggcccctgggtcttccacctctctn

SEQ ID NO: 16378 - DNA, 309 bp, Homo sapiens
attctcagcgctgggagccgccgcccccgcagctgccgccgccgccagggcccggactcggacgcgtggtagcctagagtcctggggagcttctgtccacctgtcctgcagaggagtcgtttccagcccggctgccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacc

SEQ ID NO: 16379 - DNA, 424 bp, Homo sapiens
ttcactttattacaatagtggcaatttagcttttcagtattacaggaatttaaaaattggtttcttgtaggggacatctcaactttgggaatatcttcacttaatttttaaaaaatattttcatgctttattgtccagctatacaatatatcgcaaaatcctgacaagttcattgtattaaggtattaactattacatggaaagcaattctgttcatcttttgatgtttgtgttgaaaatgcttatctttgtgttttgatcttccaacagctgagagcttgaactgatttaaacatttgtcaatatacttaagaatgctttaagtaaagaaggggaaaattttaagtaagttttttcccttctaggaagaaaaactatgatgatgttaagaaaatgtcattatagagcttgctcaataatatgt

SEQ ID NO: 16380 - DNA, 400 bp, Homo sapiens
agtcccagcattcccctgggctgtgacttcgttggtctgaaaatgcttgcacaggttgttcccacagcctggaagtctcttccctgacttgttccacgatcaacctctactcacccttcaaggctcggctcaaatgccccttgccccagaaaccttccacaagtcctgaaggcatcactgaaccccatttccaggatgagcccacagcactgcatacaatgagttgagcagtaattatttgtatctggtccaggttcccaatgattaactccttgagagtaggaacactatcacgttcatcttggaatcctcagtgactgacacagagcttgctgtacaagaagccctcaaaaaatgtgtactgaatgaataaaatgcatgtcctagaaaaaaaaaaaaa

SEQ ID NO: 16381 - DNA, 167 bp, Homo sapiens
ccctgggctgtgacttcgttggtctgaaaatgcttgcacagtattgtgtccagaattggttccttccggtgggttcttggtctcactgacttcaagaatgaagccacggacccttgcggttgttcccacagcctggaagtctcttccctgacttgttccacgatcaa

SEQ ID NO: 16382 - DNA, 82 bp, Homo sapiens
aacatgttagaagggtcagagggagagaagttagtccatcagatgtgagagaagactccaaccttgagtcatctcagttgac

SEQ ID NO: 16383 - DNA, 497 bp, Homo sapiens
caagaatgaggaatagggagatgaaaacctgtgttaacagtgacaatgaggccgggcacgtggctcatgactgtgatcccagcacttcaggaggccgaggtggacagatgacttgaggtcaggagttggagaccgcttgggcaacatggtgaagccttgtctctacaaaaaaatgcaaaaattagctgggggtggtggtacatacctctgggcccagctactcaggaagctgaggtgagaggattgcttgggccggggaggcacaggctgcagtgagccgggattgtgccactacgctccagcctgggcagcagagccagacactgtctcaaaaaaaagtgacaatgggacatcggaatggatgtgctttagcaggcaggtaaaaatgtgggactgagctcagttgtgaagtctaagcaacatgtttatatttgggcatcacttgaatgggagtgactgctgataccctgatagtgaatgaagtctaaggaaagcaa

SEQ ID NO: 16384 - DNA, 472 bp, Homo sapiens
  misc_feature 116: n=a, g, c or t
gtagacatgaacattcagaccatagcagtatcttattaagtttttctttacaatttagtaactcagttgttgtaatcagataatttgttacttcttagatcacagtgtaatttctntgaagataacttactctttttggacttctttgaaccttggaagactatagaccctttggccatgttatggtcttttaaaatgtatttttgatttttctaatgaggctgatctttattttgaccatctttttttttctttctttcttttgattgattgattgattgattgagacagggtctcactctgtcacccaggctggagtgtggtggcagagtcatggcccagtgcagcctcgacctcttgggctcaggtgatccttctgcctcagcctcctgagtagctgggaccacagatgtgcaccaccatgcctaattttcttaaattattattggtggatatggggtcttgctatgtt

SEQ ID NO: 16385 - DNA, 346 bp, Homo sapiens
agcactttgggaggccgaggcgggcggatcacgacatcaggagattgagaccatcctagctaacacgatgagtttggtgctttggaaagtgtgaaagctgctagtgaactctattctcctttatcaggagaagtaactgaaattaatgaagctcttgcagaaaatccaggacttgtaaacaaatcttgttatgaagatggttggctgatcaagatgacactgagtaacccttcagaactagatgaacttatgagtgaagaagcatatgagaaatacataaaatctattgaggagtgaaaatggaactcctaaataaactagtatgaaataaaaaaaaaaaaaaaaa

SEQ ID NO: 16386 - DNA, 490 bp, Homo sapiens
ttttggtgacttcgtacgtcattatgaaccgcaattaaggaggaggcttaatggctgttcccaaactcaaatctcagagtgggtatcctagcatctagcaagactgagtggggagatttctcatccgtgtgaaaatgtagagtgaggcctctgactagctaattggtgtattttgtttggtttagtattttctaaatgtttacaaaatattgggctgcatgttcaggttgcagctagagggagcttgggcagattttcaattacgctttcaagatataaccaaaagctgtttctaaatcctaaaattagaatttcaacagagccccctttagaacagtcatataacgcttgtgtgggccaacagaggggctgtgtactctctctggaaccataaatgtcaaataatttataacctgcagtaattgagcaaacttaaaataagacctgtgttggaatttagtttcttgaagaggtagagggataggttagt

SEQ ID NO: 16387 - DNA, 391 bp, Homo sapiens
aacattgggttttactaataggggtatgtgttgagaaaatttcaaagttttagaatatggttcacccacatgttgcttccctgtaaatataatttttaaaaccagattctgggccgggcatggtggctcacctctataatcccaaaacgttgggaggccgaggcaggcgaatcatgaagccaggagtttgagaccaggctgaccaacacggtgaaacccagtctctactaaaaatacaaaaaaaattagctgggcgtggtggcaggtgcctgtaatcccagstamtcargaagctgaagscaggagaattgcttgaacccaggarggcagaggttgcagtgagccaagatcgcaccattgcactccagcccgcgcgacagtgtgagactcc

SEQ ID NO: 16388 - DNA, 490 bp, Homo sapiens
aaaatgaggtttgttaagaatattgttttgaaggaaaacacttctccttatttaattctgaccttgaaacttctgataatggaaacaaaagagggtttacaaattctttaaaattataagtatagtagaatcccaagcacttaagaaatctcctaacaagttttctctccttttcattctttgttagattatctacgaataaatttagtaattggtgaatacatattccctgtactaatgatagaactgataaaagcatttccaaattaatttttatttagaatatttaatgattttctttcattttatcctttttatttcattaaaaaatctaataacacataccattatttcatattttattaagtgtttacacttttctaacatttatattcttcatgaatagaaccaactatcaacatgatttggactaaagttcattagtcttattatatgtaagaactccttacctcttggaaattacaataga

SEQ ID NO: 16389 - DNA, 161 bp, Homo sapiens
cacaggacattctttcaccagagtttcatgaacatttcaataaattgatggccagacctgcagttgctctacactttcaggtaaacttaaattgaaggtttttttttttttttttttttawaaggcaaataartatctcactattttakccttcaaatatt

SEQ ID NO: 16390 - DNA, 440 bp, Homo sapiens
actcagtcctggtggggtcgcacgtaacggtcctgagctatgcatahgccgtttgaccacgcatggagaattttaccacccagagacacgcgatgccctgtgcaagtttcaactgcgcggggggcggggaattccgcagacaggattctagaatttatgtcttgtgtggtaacatttcagccggtgggtggcggggattaggcgtgaagcggttcagcaggcagaggttctcggacgccctccggcgaasacctgttgatgcttttgactttctgtccttgttcctcgtcccatctggagcatttccaattctggttttgcggasagcaggtctgagcttgtccgkcgagggtgggagttggtcccggcggagatccagtgggaagagccggcggctgcccgggcgtctccttgagcctccagaggactcacaacactcc

SEQ ID NO: 16391 - DNA, 456 bp, Homo sapiens
tatcctcagaaaggactaacagcactctcagcagagggagactgagtccttcattcctgggaggtgtctgggaagcacatcgcagtgtsaccgcagcagcaacacaaaatggactaagacacccagcaagccccaggagcatcaaggaagcaggcatgaggtacctgctgggcccaccgtgctcactgctttctcactgcgtctggaggtcctgagttcasaacaatgagaagttttgagctggataaaactgttcatttatggagcatattggaaaaggagggatcacacatgtctcagaaacaatgggatgcatttcctgtttggtagagggaggcttctaaaaggttgattggttacaaaattgcctctctaaaagactcctttctaaaggcaaataaggaaactgaaaagcttaagagatgaattaaagacgaaaataaaatrattatatgg

SEQ ID NO: 16392 - DNA, 407 bp, Homo sapiens
atttgtttagttttgttttagtttttatttttatttttaaaataaatgttatcagatatatccctgatactaaagtgaacgtcatttactagttgctgaaattcacttgttagaaaataggctgggcgtggtggctcacgctttaatctcagcgctttgagaggccaaggcgggcggatcacctgaggtcaggagttggagaccggcttggccaacatggtggaaccccgtctctgctggaaatacaaaaattagctgggcatgatggcatgtgcctgtgatcccagctacttgggaggctgaggcgggagaatcgctggagcccgggaggcgaggttgcagtgagccaggactgcaccattgctctccagcctgggcaacaagagcaaaactctgtctcaaaaaaa

SEQ ID NO: 16393 - DNA, 406 bp, Homo sapiens
gagaaggtgctttagtctgaagatggcggcctcagcagcgcgaggtgctgcggcgctgcgtagaagtatcaatcagccggttgcttttgtgagaagaattccttggactgcggcgtcgagtcagctgaaagaacactttgcacagttcggccatgtcagaaggtgcattttaccttttgacaaggagactggctttcacagaggtttgggttgggttcagttttcttcagaagaaggacttcggaatgcactacaacaggaaaatcatattatagatggagtaaaggtccaggttcacactagaaggccaaaacttccgcaaacatctgatgatgaaaagaaagatttttgagactgcagcctattaataaagttaacataactgacaaaaaaaaaaaaaaaaagc

SEQ ID NO: 16394 - DNA, 376 bp, Homo sapiens
agtctgaagatggcggcctcagcagcgcgaggtgctgcggcgctgcgtagaagtatcaatcagccggttgcttttgtgagaagaattccttggactgcggcgtcgagtcagctgaaagaacactttgcacagttcggccatgtcagaaggtgcattttaccttttgacaaggagactggctttcacagaggtttgggttgggttcagttttcttcagaagaaggacttcggaatgcactacaacaggaaaatcatattatagatggagtaaaggtccaggttcacactagaaggccaaaacttccgcaaacatctgatgatgaaaagaaagatttttgagactgcagcctattaataaagttaacataaccaaaaa

SEQ ID NO: 16395 - DNA, 449 bp, Homo sapiens
agtgagatttcaagggccgggtctggggccccgcgggcgcgcagtgctgcggcgtgtggggagtacggggaggctggagaggagccggccccgggcagtgtgaggtgcggaagcgcggtccagacactttgctgacgggaggccggtccgccagatccgggaggtggggcctcgttctggactgctgaagaaatttgggtacagagacagacaagcaccaagagaagatgatgtgaagaagcacagcgagaacaccatgtgaaaatggaggactggaatgaagcatctacaagccaggaaatgtctgaggctaccagaagccaggagagaggcctggaacagatcctgcactagaaccttcaaagagagcatggtcctgctgacatgttgattttggacttctggcctccagagctgtgagaataaatttcagttgttttaacccaaaa

SEQ ID NO: 16396 - DNA, 611 bp, Homo sapiens
tttttccgctccacggtgacctccgtgcggccgggtgcgggcggagtcttcctcgatcccgtggtgctccgcggcgsgccttgctctcttccggtcgcgggacaccgggtgtagagggcggtcgcggcgggcagtggcggcagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggagtggcccatgtcaagcacctgtctgccagccagaaggcactgaaggagaaggagaaggcctcctggagcagcctctccatggatgagaaagtcgagttgtatcgcattaagttcaaggagagctttgctgagatgaacaggggctcgaacgagtggaagacggttgtgggcggtgcatgttcttcatcggtttcaccgcgctcgttatcatgtggcagaagcactatgtgtacggccccctcccgcaaagctttgacaaagagtgggtggccaagcagaccaagaggatgctggacatgaaggtgaaccccatccagggcttag

SEQ ID NO: 16397 - DNA, 472 bp, Homo sapiens
acgcggtctgtgggagaccggagcgggagacagcggtgacaggagcagcggccgggagcccttagggaggcagacagagcctgcagccaatgccccaggagccctcggttccaaccaactgatgcccctgtgcccactggcccacgccatgcagccccagtccgttctgcacagcggctacttccacccactacttcgggcctggcagacagccaccaccaccctcaatgcctccaacctcatctaccccatctttgtcacgtgagtctccaagaatgggccaggcctctgctctgctggttggggttggggttggggagggagtgttgactgkagcgggcatcagtatggctgggggtggcaaagtgagctgtcagcttgaaattcaaggcactggtaagcaggctacttggattaaggacaggaatcttaggaacaaaacaaactttgaaagaactcattcatcccattt

SEQ ID NO: 16398 - DNA, 419 bp, Homo sapiens
atttgtttagttttgttttagtttttatttttatttttaaaataaatgttatcagatatatccctgatactaaagtgaacgtcatttactagttgctgaaattcacttgttagaaaataggctgggcgtggtggctcacgcctttaatctcagcgctttgagaggccaaggcgggcggatcacctgaggtcaggagttggagaccggcttggccaacatggtggaaccccgtctctgctggaaatacaaaaattagctgggcatgatggcatgtgcctgtgatcccagctacttgggaggctgaggcgggagaatcgctggagcccgggaggcgaggttgcagtgagccaggactgcaccattgctctccagcctgggcaacaagagcaaaactctgtctcaaaaaaataaataaataa

SEQ ID NO: 16399 - DNA, 508 bp, Homo sapiens
acagtcacacgcggcgccccattaaagcggccgtcccgggcgcgcgcctcattcgaggcacgggctccgggccctgatagatggggtgcggggacggagacaaatgacggcctttgggctcggaatacccacctttctggtaatgcagcccagcggtcccagcctcgttttccagccctcactcaaaatggagtcgctctggttcgaacgcctctgacaacccatccttcctgcaggcctttgtcttggtgtcaccctgcctgagctggccccaaccacagtagcaacagtgatgctgatgtgtgactgctgccaggagcctgctcacatgaccgtgtggagaaagttctttccctgaggaccatctggagtggacgcgtgcactacccctctctgaatacaccctccccacgaggccctctggagcatcctgtagagccagcccctacccagagaccctgagcccagagaatgcgctgggtggtgagcctggggacgaatgcagagc

SEQ ID NO: 16400 - DNA, 433 bp, Homo sapiens
atatatggggagatttgctctgctacaagggtttgtgataaaggattaattttcttaattactatactttgcaagaatcgatattattatctttaaagcaaaattaggaatgcctttgttcttcagatatggcgatatctggacactcctaagtccgggtctgttttagtaaacattattaatttgttcccttaaccataaacctctaggggctcggaatacccacctttctggtaatgcagcccagcgggtcccagcctcgttttccagscctcactcaaaatggagtcgctctggttcgaacgcctctgacaagtgtgtacctacgtgtcaggatttgccgggtgctgggccccagaagccagccctcctgacgtgtggcggccgtcctcaccgctccctccttccctgcagcatttccccagcccccggc

SEQ ID NO: 16401 - DNA, 848 bp, Homo sapiens
  misc_feature 710: n=a, g, c or t
aatcaaagaagaggaaagcaaggtattttttcacctcagattctaatatattctagatttgtttctgttttatagatttaattcaatacctccacatagatgtttttatattacatgaatttaataataaactaaatttttttttgtctcccgttattgaaaagtaccaaagcttctttctgttgtgtttgattttactataggggttttgctttttctagagatacttttcatttaacagcttttgttaagtgtcaggctgcactttgctccatataattattgttttcagatttcaacttgtatgtgtttgtctcttaaagcattggtgaaatcacatattttatattcagcataaaggagaataaattccagaaaacacatattctgaaaatggagtgtttgttccctgccatttttcacacctctcttaattttagttctgtttagttgagaggctgtgattttactcttgcctgtgaacctcatgcatgaaagcagcacattaaattgtaaaaatacaacagatcgtgtgatcattcaaggagccagacatgaggtcctgcacgagggtgttgggaggacaccacagattcatctcagacagtgatcaggactgaggatggagttaaatcactcagcccctgggtggggtggggtggttcaaatggatgactgatctcctgagtacactgaagccacaggctggntggccatgttctctgaattgggtgcagaagacaagggcagagtggctgcggcccctattacctttgtagcagccacatcagaaagcagaagaaaacagtatttctgaaggcattgtttgaggttgatctcagcactga

SEQ ID NO: 16402 - DNA, 257 bp, Homo sapiens
ctacttggaattctgaatgtgttgtgacagctgctgttcccatcccagctcagaagacacccttcaaccctgggatgaccacaattccttccaatttctgcggctccatcctaagccaaataaattatactttaacaaactattcaactgatttacaacacacatgatgactgaggcattcgggaaccccttcatccaaaagaataaacttttaaatggatataaatgatttttaactcgttccaatatgccttata

SEQ ID NO: 16403 - DNA, 421 bp, Homo sapiens
aagatttttattcagttgaatatgtagacaaccaccagctaatctctattggcttggattttgtggtttagaaaatactcatcacctgcattgtcctaatgatttatgatgagtgggatcataatttgtgagtgctggtgtcctctgcaggaacacaggcttaacatcttgttcaagggtaccagttggtaagctccagaatttaaacctaggacatggattctactgccttactctgctcttcacgtcacactggagcagaataacttgactcaggatggttggagaaagagaggtggaagaaggctgagaaaaatagtgaagatggaagactttgttttgggatctttcagaatctctactctcaagtggtccattttcttggactactatccagagataagatgagaataaagagaca

SEQ ID NO: 16404 - DNA, 496 bp, Homo sapiens
ttgattttgtataattaaatgtgtcaagcatctgtattaattgatttgatggcataaggttatgaaaataatgtactgccccatgtattactgttccaaaaggagaaagctatgtagaaagatacattaagggtgaaaatagcaatacagtagatttgaataccttgatgttttgcattacttcatttatgtttacatcatgtttagaaatgttttcatttactgtggtctttggtcacttcagctcaaagacctagtgatggatatttctttgaggctttcatttatataattttattttgtacaatgttttttttaaatgtgcaaatactgtattcaagtgaaaaaaatacagtatttgtagataaccatagctactacacagttcttcggtagtcccagtgtagttatatcagtgtttactgaagggaacatcaaaatataatggtatattataaaataaagactttcttaaaggaaaattgcacctatttta

SEQ ID NO: 16405 - DNA, 432 bp, Homo sapiens
atttgtttagttttgttttagtttttatttttatttttaaaataaatgttatcagatatatccctgatactaaagtgaacgtcatttactagttgctgaaattcacttgttagaaaataggctgggcgtggtggctcacgctttaatctcagcgctttgagaggccaaggcgggcggatcacctgaggtcaggagttggagaccggcttggccaacatggtggaaccccgtctctgctggaaatacaaaaattagctgggcatgatggcatgtgcctgtgatcccagctacttgggaggctgaggcgggagaatcgctggagcccgggaggcgaggttgcagtgagccaggactgcaccattgctctccagcctgggcaacaagagcaaaactctgtctcaaaaaaataaataaataaaaaaaaaaaaaaaa

SEQ ID NO: 16406 - DNA, 447 bp, Homo sapiens
ctgagatatgggagggagctggagaaagaaggagggggagagactgccagagaggaagagaaaagaaaggaagaaacattagaaagaaaaaggaaggaaaacggtataaagagagatcaattacccacccttaaatagctagattggggggggaggggggtggaaaagaaagctgtggaggtgtgccccagcacggctgctttgaaaggtttatcatctatccgtttggtttatggagaaaaagaaaatggtaactcagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagag

SEQ ID NO: 16407 - DNA, 180 bp, Homo sapiens
gtaaggsgtggtgggatttgctcctgggttccctaggycctagtgagggsagaagaggaaccatcctctcccttcttacaccgtgagsmaagatsccctcagaaggcaggagtgctgscctstcccatggtgmccgtgcstctgtgctgtgtatgtgaaccacccatgtgagggaataaa

SEQ ID NO: 16408 - DNA, 204 bp, Homo sapiens
gtaaggcgtggtgggatttgctcctgggttccctaggccctagtgagggcagaagaggaaccatcctctcccttcttacaccgtgaggccaagatcccctcagaaggcaggagtgctgccctctcccatggtgsccgtgcctctgtgctgtgtatgtgaaccacccatgtgagggaataaacctggcactaggaraaaaaaaaa

SEQ ID NO: 16409 - DNA, 222 bp, Homo sapiens
gtaaggcgtggtgggatttgctcctgggttccctaggccctagtgagggcagaagaggaaccatcctctcccttcttacaccgtgaggccaagatcccctcagaaggcaggagtgctgccctctcccatggtgcccgtgcctctgtgctgtgtatgtgaaccacccatgtgagggaataaacctggcactaggaaaaaaaaaaaaaaaaaaaaaaaaaaaaa

SEQ ID NO: 16410 - DNA, 569 bp, Homo sapiens
ctggccgccgcccgctctcccggcgcggcactgtctgggctgctgcgcgccgcctaggtgtctgggcgatctatgggcaagagcaagggccacgatgacagattacggcgaggagcagcgcaacgagctggaggccctggagtccatctaccctgactccttcacagcttgattgcacattgatccaaccctcctaacaactagtcttccaaaatataaatggactctcctgataccacattctccttcagtagtgcttcacttgacaaggtcctgctaagtattwtcagaaaatccacccagcttcaccattactgtgacgtctgaggctggagaaaatgatgaaactgtccagactaccctcaagtttacatacagtgaaaaatacccagatgaagctcccctttatgaaatattctcccaggaaaatctagaagataatgatgtctcagacattttaaaattactagcattacaggctgaagaaaatcttggtatggtgatgatttttactctagtgacagctgtgcaagaaaaattaaatgaaatagtagatcagataaaaactt

SEQ ID NO: 16411 - DNA, 526 bp, Homo sapiens
ctgggccgccgcccgctctcccggcgcggcagctgttctgggctgctgcgcgccgccttaggtgtctggggcgatctatcgggcaagagcaagggccacgatcgacagattacggcgaggagcagcgcaacgasctcggaggccctgggagtccatctaccctgatvtccttcacagtatttattcaagaaaatccacccaggctttcaccaattaactgtgacgtctgaggctggagaaaatgatgaaactgttccagaacttaccctcaagtttacatacagtgaaaaatacccagatgaagctccccctttatgaaatatttctcccagggaaaaatctaggaagataatgatgtctcagacattttaaaatttactagcattacaggcctgaagaaaatcttgtggtatgggtgatgatttttacctctagtgacagctgtgcaagaaaaatttaaatgaaatagttagatcagataaaaaactagaagagaagaagaaaagaaacaaaaaaaaaaaaaaaa

SEQ ID NO: 16412 - DNA, 372 bp, Homo sapiens
ctggccgccgcccgctctcccggcgcggcagctgtctgggctgctgcgcgccgcctaggtgtctgggcgatctatgggcaagagcaagggccacgatgacagattacggcgaggagcagcgcaacgagctggaggccctggagtccatctaccctgactccttcacagtattatcagaaaatccacccagcttcaccattactgtgacgtctgaggctggagaaaatgatgaaactgtccagactaccctcaagtttacatacaaaaaaatacccagatgaagctcccctttatgaaatattctcccaggaaaatctagaagataatgatgtctcagacattttaaaattactagcattacaggctgaagaa

SEQ ID NO: 16413 - DNA, 457 bp, Homo sapiens
atttcccatctttcttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggagttcacaacctctgtggtccgtagagccactatgaggagggccctgggaagaatttgccattttcagtggaaaacaagtggtcgttactagctaagatgtgtttgtactttgggtctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtgaaaaaaaaaaaaaaa

SEQ ID NO: 16414 - DNA, 423 bp, Homo sapiens
  misc_feature 150,152: n=a, g, c or t
atttgtttagttttgttttagtttttatttttatttttaaaataaatgttatcagatatrtcsctgatactaaagtgaacgtcatttactagttgctgaaattcacttgttagaaaataggctgggcgtggtggctcacgcctttaatcncngcgctttgagaggccaaggcgggcggatcacctgaggtcaggagttggagaccggcttggccaacatggtggaacccsgtckctgctggaaatacaaaaattagctgggcatgatggcatgtgcctgtgatcccagctacttgggaggctgaggcgggagaatcgctggagcccgggaggcggaggttgcagtgagccaggactgcaccattgctctccagcctgggcaacaagagcrraactctggtctcaaaaaaataaataaataaaa

SEQ ID NO: 16415 - DNA, 402 bp, Homo sapiens
  misc_feature 20,31,139: n=a, g, c or t
ctggccgccgcccgctctyncggcgcggcwntgtctgggctrctgcgcgccgcctaggtgtctgggcgatctatgggcaagagcaagggccacgatgacagattacggcgaggagcagcgcaacgagctggaggccctngagtccatctaccctgactccttcacagtattatcagaaaatccacccagcttcaccattactgtgacgtctgaggctggagaaaatgatgaaactgtccagactaccctcaagtttacatacaaaacaaatacccagatgaagctcccctttatgaaatattctcccaggaaaatctagaagataatgatgtctcagacattttaaaattactagcattacaggctgaagaaaatcttggtatggtgatgattttttacttt

SEQ ID NO: 16416 - DNA, 442 bp, Homo sapiens
  misc_feature 18..19: n=a, g, c or t
ctggccgscgscgctctnncggcgcggcagctgtctgggctgctgcgcgccgcctaggtgtctgggcgatctatgggcaagagcaagggccacgatgacagattacggcgaggagcagcgcaacgagctggaggccctggagtccatctaccctgactccttcacagtattatcagaaaatccacccagcttcaccattactgtgacgtctgaggctggagaaaatgatgaaactgtccagactaccctcaagtttacatacaaaaaaatacccagatgaagctcccctttatgaaatattctcccaggaaaatctagaagataatgatgtctcagacattttaaaattactagcattacaggctgaagaaaatcttggtatggtgatgatttttactctagtgacagctgtgcaagaaaaattaaatgaaatagtagatca

SEQ ID NO: 16417 - DNA, 442 bp, Homo sapiens
ctggccgccgcccgctctcccggcgcggcastgtctgggctgctgcgcgccgcctaggtgtctgggcgatctatgggcaagagcaagggccacgatgacagattacggcgaggagcagcgcaacgagctggaggccctggagtccatctaccctgactccttcacagtattatcagaaaatccacccagcttcaccattactgtgacgtctgaggctggagaaaatgatgaaactgtccagactaccctcaagtttacatacaaaaaaatacccagatgaagctcccctttatgaaatattctcccaggaaaatctagragataatgrwgtctcagamattttaaaattacyagsattacaggctgaagaaaatcttggtatggtgatgatttttactctagtgamagctgtgcaagaaaaattaaatgaaatagtagatcm

SEQ ID NO: 16418 - DNA, 395 bp, Homo sapiens
  misc_feature 20: n=a, g, c or t
ctggccgccgcccgctctcncggcgcggcagctgtctgggctgctgcgcgccgcctaggtgtctgggcgatctatgggcaagagcaagggccacgatgacagattacggcgaggagcagcgcaacgagctggaggccctggagtccatctaccctgactccttcacagtattatcagaaaatccacccagcttcaccattactgtgacgtctgaggctggagaaaatgatgaaactgtccagactaccctcaagtttacatacaaaaaaatacccagatgaagctcccctttatgaaatattctcccaggaaaatctaggaagataatgatgtctcagacattttaaaattactagcatttacaggctgaagaaaatcttggtatggtgatgatt

SEQ ID NO: 16419 - DNA, 400 bp, Homo sapiens
atttgtttagttttgttttagtttttatttttatttttaaaataaatgttatcagatatatccctgatactaaagtgaacgtcatttactagttgctgaaattcacttgttagaaaataggctgggcgtggtggctcacgctttaatctcagcgctttgagaggccaaggcgggcggatcacctgaggtcaggagttggagaccggcttggccaacatggtggaacccgtctctgctggaaatacaaaaattagctgggcatgatggcatgtgcctgtgatcccagctacttgggaggctgaggcgggagaatcgctggagcccgggaggcgaggttgcagtgagccaggactgcaccattgctctccagcctgggcaacaagagcaaaactctgtctca

SEQ ID NO: 16420 - DNA, 403 bp, Homo sapiens
ctggccgccgcccgctctcccggcgcggcastgtctgggctgctgcgcgccgcctaggtgtctgggcgatctatgggcaagagcaagggccacgatgacagattacggcgaggagcagcgcaacgagctggaggccctggagtccatctaccctgactccttcacagtattatcagaaaatccacccagcttcaccattactgtgacgtctgaggctggagaaaatgatgaaactgtccagactaccctcaagtttacatacaaaaaaatacccagatgaagctcccctttatgaaatattctcccaggaaaatctagaagataatgatgtctcagacattttaaaattactagcattacaggctgaagaaaatcttggtatggtgatgatttttactctagt

SEQ ID NO: 16421 - DNA, 371 bp, Homo sapiens
ctggccgccgccgctctchcggcgcggcagctgtctgggctgctgcgcgccgcctaggtgtctgggcgatctatgggcaagagcaagggccacgatgacagattacggcgaggagcagcgcaacgagctggaggccctggagtccatctaccctgactccttcacagtattatcagaaaatccacccagcttcaccattactgtgacgtctgaggctggagaaaatgatgaaactgtccagactaccctcaagtttacatacaaaaaaatacccagatgaagctcccctttatgaaatattctcccaggaaaatctagaagataatgatgtctcagacattttaaaattactagcattacaggctggggaa

SEQ ID NO: 16422 - DNA, 392 bp, Homo sapiens
cagtttagtaaaagccttaaaattacttatacttatgaaataaactttaccagttgactaaaataatgcatgttaacagttggtctgtatttgcatgtaaaagtgggccaccagagaacccttattgattacttaagtgtttacattattttaaagactcctgtttaagagctttcagaattgtactgggtgaatctcatttataaaacttcctaagagactatctgaactctatactccagacagttaggtgggagtataaatctaccccttttgatgaccccaggcttgagtttttaaaatgactacccagaagggcacaagggggaaggaaatggtatttgtatatgtatataaatatgcacctaggagaatgtgctttttttaaaaaa

SEQ ID NO: 16423 - DNA, 464 bp, Homo sapiens
tataatagtctttatcaaaacagggtggtatcatggacataaagatggaaacaatagagactgagcaccagggactatgagagtgggagarggttgaagaactaccagtcggggactgtgctcaccacctggctgatgggatcatttgtacaccgtacctcagtgacttaaatcaagaattacccatgtaacaaatctgcacgtgtacccctgaacctaaaataataaagttgaaagaaaaaacagggtggtggcattattattaaagtaaagccaaagagttctcattagaattttgtatcttagtatgccattttctagaggtcactgggattggcttattttactttgtgctacttttgtcaaataagtaaaatggataggtttaaaaaacataaatactcatagtttattttctaagtaatctaatcttccatattatatggcacttattttatagcata

SEQ ID NO: 16424 - DNA, 413 bp, Homo sapiens
atttgtttagttttgttttagtttttatttttatttttaaaataaatgttatcagatatatccctgatactaaagtgaacgtcatttactagttgctgaaattcacttgttagaaaataggctgggcgtggtggctcacgctttaatctcagcgctttgagaggccaaggcgggcggatcacctgaggtcaggagttggagaccggcttggccaacatggtggaaccccgtctctgctggaaatacaaaaattagctgggcatgatggcatgtgcctgtgatcccagctacttgggaggctgaggcgggagaatcgctggagcccgggaggcggtaggttgcagtgagccaggactgcaccattgctctccagcctgggcaacaagagcaaaactctgtctcaaaaaaataaa

SEQ ID NO: 16425 - DNA, 193 bp, Homo sapiens
cctcccaccccgcgtggactcgctgcgggactgccctcttctcgccccaaccactggtcctccgctctgtccccaggggccctcaccagcttcccgcccggacacgccaggtgtcmagatcccttcccccagctcgccgacccagggcggtggcccgtgactcaggcccctcgtgggactttgggaggaagcg

SEQ ID NO: 16426 - DNA, 317 bp, Homo sapiens
cctcccaccccgcgtgggactcgctgcgggactgccctcttctcgccccaaccactggtcctccgctctgtccccaggggccctcaccagcttcccgcccggacacgccaggtgtcagatcccttcccccagctcgccgacccagggcggtggccgtgactcaggcccctcgtgggactttgggaggaagcggcastgctccgagcggggcccgcccttcccatctcctgccgctcctccctacgcttttgccttctcatctgggtctgtaggtccaaaaaaaaaaaaaaaaaaaaaaaaaaaaaaaaaaaaaaaaa

SEQ ID NO: 16427 - DNA, 504 bp, Homo sapiens
caaatgatttagtatagattaatgacatcttttttagaaatattaaagtgagtattcctcattatgtcatcatttctgataattagagtgctaatttgaatgttagataatgtttccacatctatacctatttctttctagggcacttctgaccctggggcttggggatggcctttaggcacagtagtgtctgtgttaagttcactaaatgtgtatttaatgagaaacattcctatgtaaaaatgtgtgtatgtgaacgtatgcatacatttttattgtgcacctgtacattgtgaagaagtagttkggaaatttgtaaagcacaaaccataaaagagtgtggagttattaaatgatgtagcacaaatgtaatgtttagcttataaaaggtcctttctattttctatggcaaagactttgacacttgaaaaataaaaccaatatttgatttatttttgtaagtatttaggatattattttaaataaatgattgtccattatcaa

SEQ ID NO: 16428 - DNA, 317 bp, Homo sapiens
cctcccaccccgcgtgggactcgctgcgggactgccctcttctcgccccaaccactggtcctccgctctgtccccaggggccctcaccagcttcccgcccggacacgccaggtgtccagatcccttcccccagctcgccgacccagggcggtggcccgtgactcaggcccctcgtgggactttgggaggaagcggcagctgctccgagcggggcccgcccttcccatctcctgccgctcctccctacgcttttgccttctcatctgggtctgtaggtccaaaaaaaaaaaaaaaaaaaaaaaaaaaaaaaaaaaaaa

SEQ ID NO: 16429 - DNA, 295 bp, Homo sapiens
cctcccaccccgcgtggaactcgctgcgggactgccctcttctcgccccaaccactggtcctccgctctgtccccaggggccctcaccagcttcccgcccggacacgccaggtgtccagatcccttcccccagctcgccgacccagggcggtggccgtgactcaggcccctcgtgggactttgggaggaagcggcastgctccgagcggggcccgcccttcccatctcctgccgctcctccctacgcttttgccttctcatctgggtctgtaggtccaaaaaaaaaaaaaaaaaa

SEQ ID NO: 16430 - DNA, 319 bp, Homo sapiens
  misc_feature 292..294: n=a, g, c or t
acytcccaccccgcgtgggactcgctgcgggactgccctcttctcgccccaaccactggtcctccgctctgtccccaggggccctcaccagcttcccgcccggacacgccaggtgtccagatcccttcccccagctcgccgacccagggcggtggccgtgactcaggcccctcgtgggactttgggaggaagcggcastgctccgagcggggcccgcccttcccatctcctgccgctcctccctacgcttttgccttctcatctgggtctgtaggtccaaaaaaaaaaaaannnaaaaaaaaaaaaaaaaaaaaaaaar

SEQ ID NO: 16431 - DNA, 294 bp, Homo sapiens
cctcccaccccgcgtggactcgctgcgggactgccctcttctcgccccaaccactggtcctccgctctgtccccaggggccctcaccagcttcccgcccggacacgccaggtgtcagatcccttcccccagctcgccgacccagggcggtggccgtgactcaggcccctcgtgggactttgggaggaagcggcastgctccgagcggggcccgcccttcccatctcctgccgctcctccctacgcttttgccttctcatctgggtctgtaggtccaaaaaaaaaaaaaaaaaaa

SEQ ID NO: 16432 - DNA, 293 bp, Homo sapiens
  misc_feature 200: n=a, g, c or t
cctcccaccccgcgtgggactcgctgcgggactgccctcttctcgccccaaccactggtcctccgctctgtccccaggggccctcaccagcttcccgcccggacacgccaggtgtcagatcccttcccccagctcgccgacccagggcggtggccgtgactcaggcccctcgtgggactttgggaggaagcggcastgcntccgagcggggcccgcccttcccatctcctgccgctcctccctacgcttttgccttctcatctgggtctgtaggtccaaaaaaaaaaaaaaaa

SEQ ID NO: 16433 - DNA, 292 bp, Homo sapiens
  misc_feature 177,219,221: n=a, g, c or t
cctcccaccccgcgtgggactcgctgcgggactgccctcttctcgccccaaccactggtcctccgctctgtccccaggggccctcaccagcttcccgcccggacacgccaggtgtccagatcccttcccccagctcgccgacccagggcggtggccgtgactcaggcccctcgtggnactttgggaggaagcggcastgctccgagcggggsccgsccnanccmatcttcckgcggktcytccctamgcttttgccttctcatctgggtctgtaggtccaaaaaaaaaaaar

SEQ ID NO: 16434 - DNA, 334 bp, Homo sapiens
cctcccaccccgcgtgggactcgctgcgggactgccctcttctcgccccaaccactggtcctccgctctgtccccaggggccctcaccagcttcccgcccggacacgccaggtgtccagatcccttcccccagctcgccgacccagggcggtggcccgtgamtcaaggcccctcgtgggactttgggaggaagcggcastgctccgagcggggcccgcccttcccatctcctgccgctcctccctacgcttttgccttctcatctgggtctgtaggtccaaaaaaaaaaaaaaaaaaaaaaaaaaaaaaaaaaaaaaaaaaaaaaaaaaaaaaa

SEQ ID NO: 16435 - DNA, 298 bp, Homo sapiens
cctcccaccccgcgtgggactcgctgcgggactgccctcttctcgccccaaccactggtcctccgctctgtccccaggggccctcaccagcttcccgcccggacacgccaggtgtccagatcccttcccccagctcgccgacccagggcggtggccgtgactcaggcccctcgtgggactttgggaggaagcggcastgctccgagcggggcccgcccttcccatctcctgccgctcctccctacgcttttgccttctcatctgggtctgtaggtccaaaaaaaaaaaaaaaaaaaam

SEQ ID NO: 16436 - DNA, 139 bp, Homo sapiens
aattgtgacccggtttaggaacatgctgcttgcccaaaattctccacaatcctccacctccgctcttccatttaggatataaaagagggttttctcagaccttctgccaatgcgcagacagatgaaagacgacacagag

SEQ ID NO: 16437 - DNA, 379 bp, Homo sapiens
ggaagaagaccatttaatttttaaattttttttccatttcaaggactgtattaagtaacttaaaatggcatattttaaagaggctagctgtatattttggaataatagagtgatatgacttttattaaatttttttcatcagcccttttagtttgatgaaataataccaataatgtcctccctctccactgaaataccagtgttatggattatatgtctaaatttatctttatacttttttttttyctttgacagtatctcactcactctatcgcccaggctgaggttgcaktgasccaagatcacaccaccgcattctagcctgggcaacagagcargactccatctcaaaaaaaaaaaaaaaaaaagagattaaata

SEQ ID NO: 16438 - DNA, 384 bp, Homo sapiens
  misc_feature 371: n=a, g, c or t
ggaagaagaccatttaatttttaaattttttttccatttcaaggactgtattaagtaacttaaaatggcatattttaaagaggctagctgtatattttggaataatagagtgatatgacttttattaaatttttttcatcagcccttttagtttgatgaaataataccaataatgtcctccctctccactgaaataccagtgttatggattatatgtctaaatttatctttatacttttttttttcctttgacagtatctcactcactctatcgcccaggctgaggttsmattgaccmaagwtcacaccacsgcattctagcstgggcaacagagcaggmstccatctcaaaaaaaaaaaaaaaaaagggnatwaattcccggg

SEQ ID NO: 16439 - DNA, 505 bp, Homo sapiens
  misc_feature 449: n=a, g, c or t
attggttttaggtgggtcatcatttgtcagaggccacaatacttaaccacttagtttctctgtagctccttgtgttcaaataatcatttataagcacacagtcagtgtacagccatccctctgtagccatgggggattggttctaggaaccccacccccacagataccaatagccacccaagtcccgtatataaaatcgcatggtatttacatgtaacctgtgcaccttctcccatatactttaaatcatctgtagattacttataataccaaatacaatgtaaatgctgtgtaaatagtatactgtattgtttagggaataatggcaagaaaaaaaggtctgttcatgttcaatacagatgcaactatctttttttttttyctgagtatttttgatccatggttsgttgaatctatgaatacagawtgctgactgtgttagmaaaggntgcctattgaaaatctwtaaaaatggccaggcacagtggctcacacctgtaatccc

SEQ ID NO: 16440 - DNA, 424 bp, Homo sapiens
aggaggcgggtgggtcaaggtaactctgggctacagagtccttgctgggggttcggggagcgcttggaccccggcttctgggacgcgtcagttggatcgatcaacccgggaggtggagctgggcttggaatacggatccccgactatgaacctgggcagggcaaagcctgaagtttgaaaatggccagtggatagcagagacaggggttagtggcggtgtggaccggagggaggttcagcgccttcgcaggcggaaccagcagttggaggaagagaacaatctcttgcggctgaaagtggacatcttattagacatgctttcagagtccactgctgaatcccacttaatggagaaggaactggatgaactgaggatcagccggaagagaaaatgaagaccccagagacatttattggggagtag

SEQ ID NO: 16441 - DNA, 474 bp, Homo sapiens
  misc_feature 465: n=a, g, c or t
gtggcgggcaggcggcaggaggcgggtgtgtcaaggtaactctgggctacagagtccttgctgggggttcggggagcgcttggaccccggcttctgggacgcgtcaggagaagggagcactggctttgctttcatcaggccaaagatgcctttctttgggaatacgttcagtccgaagaagacctcctcggaagtcggcatctctctccaacctgcattctttggatcgatcaacccgggaggtggagctgggcttggaatacggatccccgactatgaacctggcagggcaaagcctgaagtttgaaaatggccagtggatagcagagacaggggttagtggcggtgtggaccggaggaggttcagcgccttcgcaggcggaaccagcagttggaggaagagaacaatctcttgcggctgaaagtggacatcttattagacatgctttcagagtccactgccgnatcccactt

SEQ ID NO: 16442 - DNA, 278 bp, Homo sapiens
  misc_feature 114: n=a, g, c or t
aggagcgcggascggagctggacgccgccgccgccaccgccacctgcgcggcagtcatcaagatgtcatggcacccccagtaccggagctccaagttccgtcatgtctttggcnaaccagccagcaaggagaactgctacgactccgtgcctatcacccgcagcgttcacgacaaccacttctgtgccgtgaacccccacttcattgcagttgtgactgagtgtgctggtggaggggccttcctcgtcatccccctgcaccagacagggaagttggac

SEQ ID NO: 16443 - DNA, 489 bp, Homo sapiens
ataggcatttcaggctgggattcagggaggttatgtttgctgtcacagacctcaaaccaaaagagtacatcaaaataagtcactggatttatacatttggcaaattctcaagagaccacatgacagaaggagcaataatctgaacattgcttttagctgtaattctccaatgaagtagatttggggaagcaacatgaggtacttgctttatttttttaaatccattttttttctttgaaaaaccacaagattggacttgacaatctttaaggttatacccagctctaagatatttttgtaattatatggaacaaagatggacatgaaatataccaaacgagagtttctaaatttagattctgacagttcaagtcagaaaacatattaagtgttcaggaaaaacaaatcacaatcttccatcacaaaattcaacaagaacaacaaaaaccactccagaggcagctgtggtattctggaaggaatgctggt

SEQ ID NO: 16444 - DNA, 492 bp, Homo sapiens
  misc_feature 467: n=a, g, c or t
agaatgggatgtgcctaagtttatataaatgacagttaaaaagataactgtcacaatgtttactgatgaggtttccatttctcttaacgtttagaagttaaatgaaaaatggattgtggattatagcctgagcagatttgagcctaaatgtaatataacagcttgtggcaaatggaggtagcaggagagtagagccaactagccaaaaatcccctggaaaggtgaaactgaaatcactcattcattcaaaaagtgtttactgagtagcttcaaagagcaaatattaggttagatgcagtgggtgatgtaaggatgattcagacaactatttctcatggactttgcttactgagccatcmacacacggccacctttttctagatgaagtatcccatcatttgattctggattgagaactctttgagagcagagacgatggsttcacctgaktatccccagagctgacngttagacaaaaatcaactttcactg

SEQ ID NO: 16445 - DNA, 388 bp, Homo sapiens
aggtttctgtttggttgccgccctaacggccagaactaaagcaccttgcaaggaatgaagttggttcttgaagtccgtgctgactggctgggcgcatttgcgatttgcttctctggctgcaaaatggcccgcaacagcactcactaatttgttgctaacttcaggaactgtgcggacaggtctctgaggcttctgagccgcgctatgtccagtagatctgggcgcctcagaacctgtcacagccgacggaagcgtttatctgagtttcttgtttcttcccaaccttttgattttcgcaccattacgcgctcaactatgcctcttcttttgtcctatggtctcaactaattaaaggaagaaaagcaatgctaaaaaaaaaaaaaaaaag

SEQ ID NO: 16446 - DNA, 485 bp, Homo sapiens
caacttgttactagacagccagcgcactaataatggcagttaatatgcgcgcctcggatgggggcgattcgtaaaggttagcttgtctttgaatctttggggtgatcggatgtctgcagggcctaagctttgtgggccttctgtgctttactcttgggtgagttatgaatgaaaagaaggggactccatggaatgattgcatagcagcccgcagcgtagacagcctgttccgtggtgtccttttccttccttgggtgcagactcaaagccctgccttcataggacagggagagctgtgcagcttgactccgtagaggtgtgcccttacaaagctggaggaggtacccaggcccatgcgattaatcagcagcattgccttaccgggctcttatccccatccgaaaacttctgtagggtaaatagaagaggaaactccttcattgagccctttgactatctatgttaatgcttttggacttaaaaaa

SEQ ID NO: 16447 - DNA, 363 bp, Homo sapiens
  misc_feature 284: n=a, g, c or t
ctctctcggtttgtctgggtcatcttgtctgcccgccgctggcctggccccgtctgtctctctcagcagctgtctttctcgcgcccactggccggtctctcctcttccccgcagttgcctccttctctgcctgcctgggtggccgccatgggccggaagcggctcatcactgattcctacccggttgtgaagaggagggaggggcccgctgggacagcaagggggagctggcacccgagctaggggaggagccccagccccgcgacgaggaggaagcggactgnagctgctgaggcagtttgacctggcctggcagtacgggccctgcaccgggatcacacggctgcagcgctggtgtcgggc

SEQ ID NO: 16448 - DNA, 489 bp, Homo sapiens
ttttttttgtcggtagaggcagaaggagaaggtcgggttgtagaagctggggtggccggcagctcgctcatcggtgttcgtgggctttgtcggtccgtgcctcgtctctccctggaaagggagggaggcttcgacgtcgagagggagccgctgccgcgttagttccgagcttgaagtcactaggacttctctcaaacttgtgtgctgaggagactcagatgttggcctcagctcctaggctgaactcagcagatcggcccatgaaaacttctgtattgagacaaaggaagggatctgtcagaaagcaacacttgttatcttgggcttggcagcaaggaagaggacaggtagtggagatcctgcaatctgaaaagcagactgaaaggtgacaaagaagctgaagatgggtggtggagagaggtataacattccagcccctcaatctagaaatgttagtaagaaccaacaacagcttaacagacagaagac

SEQ ID NO: 16449 - DNA, 486 bp, Homo sapiens
  misc_feature 220,409: n=a, g, c or t
mwcwkkyrgsysmkcykkksaacaggtaggtcatccttgckgccttgcggcatgggcagtatccgccgccatcctcttccgtgagcgcgctgagacccggaccggccctcctgagaggatgccggacccgtcgccatgggccgtgtgatccgtggacagaggaagggcgccgggtctgtgttccgcgcgcacgtgaagcaccgtaaaggcgctgcgcctncgcccgttggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaanaaggcccagctcaacattggcaatgtgctccctgtggcaccatgcctgagggtacaacaccatgcctgagggtacaa

SEQ ID NO: 16450 - DNA, 274 bp, Homo sapiens
  misc_feature 123,127: n=a, g, c or t
gtttcctctttcggccgcgctggtgaacaggacccgtcgcyatgggccgtgtgatccgtggacagaggwtagggcgccgggtctgtgttccgcgcgcacgtgaagcaccgtaaaggcgctgcnstwncgcccrttggatttcgctgagcggcacggctacatcaagggcatcgtcaaggacatcatccacgacccgggccgcggcgscccctcgccaaggtggtcttccgggatccgtatcgggtttaagaascggacgggagctggtycattg

SEQ ID NO: 16451 - DNA, 93 bp, Homo sapiens
cagtgtgaaaaacagactcacaaggggcttcttggcctgcagcttcatttgcgagacgccgaggcaggacacagagcacagctgtstggaaag

SEQ ID NO: 16452 - DNA, 355 bp, Homo sapiens
atacttacctggcaggggagataccatgatcacgaaggtggttttcccagggcgaggcttatccattgcactccggatgtgctgacccctgcgatttccccaaatgtgggaaactcgactgcataatttgtggtagtgggggactgcgttcgcgctttcccctgactttctggagtttcaaaaacagactgtacgctaagggtcatatcttttcttgtattggtttgtgtcttggttggcgtcttaggtgttaatcctacagtggagggctggggaataggaagtaacatgtggcctgcacgccataggagaaaaagcgagcatcagccgtatcggctttaaaaaaaaaaaaaag

SEQ ID NO: 16453 - DNA, 175 bp, Homo sapiens
atacttacctggcaggggagataccatgatcacgaaggtggttttcccagggcgaggcttatccattgcactccggatgtgctgacccctgcgatttccccaaatgtgggaaactcgactgcatcaatttgtggtarttggggamtgcgktcgcgctaaaaaaaaaaaaaaaaaa

SEQ ID NO: 16454 - DNA, 203 bp, Homo sapiens
atacttacctggcaggggagataccatgatcacgaaggtggttttcccagggcgaggcttatccattgcactccggatgtgctgacccctgcgatttccccaaatgtgggaaactcgactgcataatttgtggtagtggggtactgcgttcgcgctttcccctgaagagaaaaaaaaaaaaaaaaaaaaaaaaaaaaaaaaaa

SEQ ID NO: 16455 - DNA, 207 bp, Homo sapiens
atacttacctggcaggggagataccatgatcacgaaggtggttttcccagggcgaggcttatccattgcactccggatgtgctgacccttgcgatttccccaaatgtgggaaactcgactgcataatttgtggtagtgggggactgcgttcgcgctttcccctgastttaaaaaaaaaaaaaaaaaaaaaaaaaaaaaaaaaaaaaa

SEQ ID NO: 16456 - DNA, 231 bp, Homo sapiens
atacttacctggcaggggagataccatgatcacgaaggtggttttcccagggcgaggcttatccattgcactccggatgtgctgacccctgcgatttccccaaatgtgggaaactcgactgcataatttgtggtagtgggggactgcgttcgcgctttcccctgattaaaaaaaaaaaaaaaaaaaaaaaaaaaaaaaaaaaaaaaaaaaaaaaaaaaaaaaaaaaaaaaa

SEQ ID NO: 16457 - DNA, 189 bp, Homo sapiens
atacttacctggcaggggagataccatgatcacgaaggtggttttcccagggcgaggcttatccattgcactccggatgtgctgacccttgcgatttccccaaatgtgggaaactcgactgcataatttgtggtagtgggggactgcgttcgcgctttcccctgactttaaaaaaaaaaaaaaaaaaaa

SEQ ID NO: 16458 - DNA, 204 bp, Homo sapiens
atacttacctggcaggggagataccatgatcacgaaggtggttttcccagggcgaggcttatccattgcactccggatgtgctgacccctgckatttccccaaatgtgggaaactcgactgcataatttgtggtagtgggggactgcggaaaaaaaaaaaaaaaaaaaaaaaaaaaaaaaaaaaaaaaaaaaaaaaaaaaaaaa

SEQ ID NO: 16459 - DNA, 374 bp, Homo sapiens
aagaaatggcaaactagggatcttacctgggccttcccagttgagactacgtcaaaatgggctcccatgagactgcctggctcatgcagatggaaggctaacatctttttagaaacaactcgtgctaccctctcctgttccaaaagcctgtctggtcagaatggtgtgatgagccctcctcttcagctaggaaaatgacggtgttcagaaagttaaaacttcttcgctggaaggatttcatcttaaagttgaaacggaagactctggtagcagtccytgaaatcttgrtgccattgstatttyckgcatkgwatkgwatcttcgttttagtagtgctccaataaaaagacctgctactaaaaaaaaaaaaaaaa

SEQ ID NO: 16460 - DNA, 486 bp, Homo sapiens
agattccacagtctccggaagcagggctggggaagaaatggcaaactagggatcttacctgggccttcccagttgagactacgtcaaaatgggctcccatgagactgcctggctcatgcagatggaaggctaacatctttttagaaacaactcgtgctaccctctcctgttccaaaagcctgtctggtcagaatggtgtgatgagccctcctcttcagctaggaaaatgacggtgttcagaaagttaaaacttcttcgctggaaggatttcatcttaaagttgggagactggaagaaattaaagtgttctaaatggaagagcattcaccacatgtgttctgttttgggttgacatttagcttttgtttttattttagaaacggaagactctggtagcaatccttgaaatcttgatgccattgctattttctgcattgtattgtatcttcgttttagtagtgctccaataaaaagacctgctactag

SEQ ID NO: 16461 - DNA, 521 bp, Homo sapiens
acacccggaaactcgactttggccgtttctccatttctcctcacgcactgtctttccttgggccctcgtcactcctggcaccgggggaagggcttccccgcctctggccgggcgctggggcgcgaccgaagcgaggcggcggcgaggaaccttctggaattcggccgtcgggggcaggcgtcgagtttacaggagaaggcgcggtgtcccgggatgagcggagtcgccctcacttaaggagcgagggaggcctcgggggtccccagccggtgatgagccctcctcttcagctaggaaaatgacggtgttcagaaagttaaaacttcttcgctggaaggatttcatcttaaagttgggagactggaagaaattaaagtgttctaaatgggaagagcatttcaccacatgtgttctgttttgggttgacatttagcttttgtttttatttytagaaacggaagactcttggtagcagtccttgaaatcttgatgccattgctattttcttcattgtattgtat

SEQ ID NO: 16462 - DNA, 495 bp, Homo sapiens
aggagcgcaaaatggcggaaccgcgagccccgtgcactgtgtcgctgccgcggcccccaccgccaccgtctcggagaaagaaccgtttggcaagctgcaactctcctcccgggaccctccggttctctgtccgccaagaaggtccggactgaggagaagaaggcaccgcggagagtgaacggagaakggggcagcggcgggaacagcaggcagctgcagccgccggcagcaccttcgcctcagagctatggcagccccgcgtcttkgagctttgcccctctgtctgctgctgcctcggctaacgccaagtcgcgcagacctaaggagaagcgggagaaggagaggaggaggcacggtctcggtggggcccgagataaaatcaaagacaaaattaaagagagagacaaagaaaaagagagagaaaaaaagaaacataaagtaatgaatgagatcaagaaagagaatggagaagtaaagattttgctgaaaagtggg

SEQ ID NO: 16463 - DNA, 454 bp, Homo sapiens
agtttcccaatcaggtagtgagagtggcacgaaccagccgttctcctgagccaccccccgcgcccccggactcctcaatatcccaggtgggaacgctcaccagggacatccagcgcccgtcgccctgtacgtcctgcaccggcgtgggcttgctggctgggttctcctctccactcatcttggcgccgcagctcctgcaggatgagcgagtcgggtcggcccgggagtgttccgaacggagctggctccgccacgcccactcctacccctcgcggcaacaaaggaccgtcccaacgctagcacacccgcggaggacgaaggccgatacagggcgccgctcctctccagggacggaagccttcacttaggaggacaccatggataccagggaccagtctcccagccttttcagcagcctgagaaacctggtcgtgtmcgtcgtcggaagataggc

SEQ ID NO: 16464 - DNA, 473 bp, Homo sapiens
aaagcccagtctagccatttaaagagaacacatggaagtaaaccaagaacccagccaatatccccagaaattgacaagatgatcctaaaatttatctagaaacacacgggacacagaacagccaagataattttgaaaaataagaacgaaggactcatacttcttgatttcaaaactgactacaaagctacagtaattaacactgtgtgagactggcataaggatatgcatatagattgataaaataaaactgagaagcccttgagaaataaaccttatatatatggtcaactgatttttgacaataatgacaagaaaattcaataggaaaagaagttatttcaacaaatggtactgggacaactggatacacacatgcaaaaggatgaagttggaaccttacctcataccatatgcaaaaattaatgctaaatgagtcatagacctatatataagaattagaactataaaac

SEQ ID NO: 16465 - DNA, 441 bp, Homo sapiens
acattccctctcagattccaaccacgatactgaaaaaaccaaagcccagtctagccatttaaagagaacacatggaagtaaaccaagaacccagccaatatccccagttgactgaaactgtggaaagtgaaatcatggataagaagggactactgtgggctgggcgcagtggctcacgcctgtaatcccagcactttgggagaccaaggcgggcggatcacaaggtcaggagtttgagactagcctcactaacacagtgaaaccctgcctctactaaaaatacaaaaattagccgggcttggtggcgcatgctttaatcccagctgctcaggaggctgaggcaggagaatcccttgaacctgggaagcggaggttgcagtgagccgagatcacgccactgcactccagcctgggcaacgtatcaagtctccatctcaaaaa

SEQ ID NO: 16466 - DNA, 489 bp, Homo sapiens
tgcaggaatgcttcagtgtttgaaagggtgaagaaaagaggattcctggctgggcgtggtggctcatgcctgtaatcccagcactttgggaggccaaggcgggtggatcaccaggtcagaagatcgggatcatcctgcctcagcttcccaaagtgctaggattataggcataagccacaacccctggcccaggagcctgcattttgaaacaaacacgccaggctattttgatggcactggttttcggatctgcactttgacagacagacttaaaccttccgtgtgagtattcgagagcaccatcctgctttcctgagatgacagactcctcagggaggcagccagggcttcctgtttctagatggggaaaccaagccaggcagccctctggaggcttgctgtggggtgccccggcaagctagcgamgcccacagccagagggccagccccgggggatggggggggacaaatattaaaaagaatatgcaa

SEQ ID NO: 16467 - DNA, 101 bp, Homo sapiens
ctggatggcccctccttgcaaccaggcagctgagaccagggtcttacctctctgggacctagggggacggggctgacatctacattttttaaaactgaatc

SEQ ID NO: 16468 - DNA, 459 bp, Homo sapiens
  misc_feature 68: n=a, g, c or t
acacccaggagtccagaccccagctcctcctctctcacacccaggagtccagacccaggagtccaggnccccakcccctcctccctcacacccaggagtctaggtcgccccctccttggggccccaccccactgggcctcttctctctggtccttaggccgcaccaggatgtcggacaccgaggagcaggaatatgaggaggagcagccggaagaggaggctgcggaggaggaggaggaagcccccgaagagccggagccggtggcagagcagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttg

SEQ ID NO: 16469 - DNA, 478 bp, Homo sapiens
agcaaggctcagcctcaagattcacagcatctcagacgcagcctaggccgcaccaggatgtcggacaccgaggagcaggaatatgaggaggagsagccggaagaggaggctgcggaggaggaggaggaagcccccgaagagccggagccggtggcagagcagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcgggcgccggtcagagagagccgagcaacagcgcttcagaactgagaaggaacgcgaacgtcaggctaagctggcggaggagaagatgaggaaggaagaggaagaggcca

SEQ ID NO: 16470 - DNA, 392 bp, Homo sapiens
attttctcctggrcaaggagagagtgcggctgctgagagccgagcccagcaatcccgatcctctgagtcgtgaagaagggaggcagcgagggggttggggttggggcctgaggcaagcccccaggctccgctcttgccagagggacaggagccatggctcagaaaatggactgtggtgcggcctcctcggsttycaggctkargcctccgtagaagacagcgccttgcttatgcagaccttgatggaggccatccagatctcagaggctccacctactaaccaggccaccgcagctgctagtccccagagttcacagcccccaactgccaatgagatggctgacattcaggtttcagcagctgccgctasctaagtcagcctttaaagtcca

SEQ ID NO: 16471 - DNA, 529 bp, Homo sapiens
agttccaaaatggcggcaggggtggccgggtggggggttgaggcagaggagttcgaagatgctcctgatgtggagccgctggagcctacacttagcracatcatcgagcagcgcasctgaagtggatcttcgtcgggggcaagggtggtgtgggcaagaccacctgcagctgcagcctggcagtccagctctccaaggggcgtgagagtgttctgatcatctccacagacccagcacacaacatctcagatgcttttgaccagaagttctcaaaggtgcctaccaaggtcaaaggctatgacaacctctttgctatggagattgaccccagcctgggcgtggcggastgcctgacgagttcttcgaggaggacaacatgctgagcatgggcaagaagatgatgcaggaggccatgagcgcatttcccggcatcgatgaggccatgagctatgccgaggtcatgaggctggtgaagggcatgaactttctcggtggtggtatttgacacggcacccacgggccacaccct

SEQ ID NO: 16472 - DNA, 346 bp, Homo sapiens
cttttcagtccttgcgcaccggggaacaaggtcgtgaaaaaaaaggtcttggtgaggtgccgccatttcatctgtcctcattctctgcgcctttcgcagagcttccagcagcgaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctcttggaagtggatcaaactagaactcatatgccatactagatatgtttgtcaataaact

SEQ ID NO: 16473 - DNA, 462 bp, Homo sapiens
caggaaaatcgcgagggacgggcggccccccgacagtccagctcctttcggctcttgcaggaagccctggaggctgaggagagaggtggcacgccagccttcttgcccagctcactgagcccccagtcctccctgcccgcctccagggccctggccacccctcccaagctccacacttgtgagaagtgcagtaccagcatcgcgaaccaggctgtgcgcatccaggagggccggtaccgccaccccggctgctacacctgtgccgactgtgggctgaacctgaagatgcgcgggcacttctgggtgggtgacgagctgtactgtgagaagcatgcccgccagcgctactccgcacctgccaccctcagctctcgggcctgagccgccatgccctcagcctgcctcactgctgggccagggtcatgcctatataagttggcatggcagggacaatggtgggca

SEQ ID NO: 16474 - DNA, 452 bp, Homo sapiens
accaagggaacggaaaatggcgcctcacggcccgggtagtcttacgaccctggtgccctgggctgccgccctgctcctcgctctgggcgtggaaagggctctggcgctacccgaggtacagaagcaagtttgaggtcgggctgaagcagggtcrctggccagccgtgcgtcgcgctcgccagcggctcccccttctcctmggcgggcctgcggttctgatttcgtccctgacgcttcccgaccctgcccagccagatatgcacccaatgtccagggagcgtgcaaaatttgtcaaaagtggccttttattgtaaaacgacacgagagctaatgctgcatgcccgttgctgcctgaatcagaagggcaccatcttggggctggatctccagaactgttctctggaggaccctggtcaaactttcatcaggcacataccactgtcatcatagac

SEQ ID NO: 16475 - DNA, 448 bp, Homo sapiens
  misc_feature 42: n=a, g, c or t
acgcgaggwagatggctgcatcccagcagcaagcttcagcgncttcctcagctgctggtgtatcgggtcctagttcggctggcggcccgggtccccagcagcagccgcaaccgccagcacaactggtgggccctgccagagcggcctcctgcagcaacagcaacaggacttcgatcctgtgcagcgttataagatgctcatcccgcagctgaaggagagtctacagaccttgatgaaggttgcggcccaaaacttgattcagaacactaacatcgacaatggacaaaagagcagtgatggacccatacagcgctttgacaagtgcctggaagagttctatgcactctgtgaccagctggagctgtgcctggtaagaagccttctggacacggggtaacaacagccgtgtcccagtctctggggtcttcagaaacagtcagtcagtcaa

SEQ ID NO: 16476 - DNA, 235 bp, Homo sapiens
attttgcgcacattgaggaccgtggtggcgcatttcctcagcgctttcccgccacttcagcggacagatctggccgcagctaaaccaaggtgtatgttggtaacctgggaactggcgctggcaaaaggagagttagaaagggctttcagttattatggtcctttaagaactgtatggattgcgagaaatcctccaggatttgcctttgtggaattcgaagatcctagagatgcag

SEQ ID NO: 16477 - DNA, 162 bp, Homo sapiens
ctcgttgcgcagtagtgctagcggcttcgcggttcggtcctcgcacccggcagccgccactggtgctgagctgctaggaagcccctatcgccgagctcgttggagcttgaacccattgtcacccctccgactcaccggcccaaaaaaaaaaaaaaaaaagtc

SEQ ID NO: 16478 - DNA, 119 bp, Homo sapiens
gttgcgcagtagtgctagcggcttcgcggtttcggtcctcgcacccggcagccgccactggtgctgagctgctaggaagcccctatcgccgagctcgttggagcttgaacccattgtca

SEQ ID NO: 16479 - DNA, 95 bp, Homo sapiens
gttgcgcrtagtgctagcgcttcsggttcggtcctcgcacccggcagccgccactggtgctgagctgctaggaagcccctatcgccgagctcgtt

SEQ ID NO: 16480 - DNA, 104 bp, Homo sapiens
gttgcgcgtagtgctagcgcttcgcggtttcggtcctcgcacccggcagccgccactggtgctgagctgctaggaagcccctatcgccgagctcgttggagctt

SEQ ID NO: 16481 - DNA, 134 bp, Homo sapiens
  misc_feature 106: n=a, g, c or t
gttgcgcatagtgctagcggcttcgcggttcggtcatcgcacccggcagcsrccactggtgctgagctgctaggaagcccctatcgccgagctcgttggagcttgnaacccattgtcacccctccgactcaccg

SEQ ID NO: 16482 - DNA, 137 bp, Homo sapiens
gttgcgcatagtgctagcgkcttcgggttcggtcctcgcasccggcagcsgccactggtgctgagctgctaggaagyccctatcgscgagctcgttggagcttgaacccattgtcacmcctccgactcaccggccca

SEQ ID NO: 16483 - DNA, 154 bp, Homo sapiens
gttgcgcatagtgctagcstcttcgcggttcggtcctcgcacccggcagccgccactggtgctgagctgctaggaagcccctatcgccgagctcgttggagcttgaacccattstcacccctccgactcaccggcccaaaaaaaaaaaaaaaaa

SEQ ID NO: 16484 - DNA, 441 bp, Homo sapiens
cttttatagcgtcctaaggttggaggcacatttcaatgtttccgaatgcctcctaataacattcaggtagagagcacatcattctgctctgtgttgtgacacaaaattgctcatcatatttcacttctgagaatctttcacccatctgtctcgtgaccaagttataaaacgacagagtaaacttaaaactgcagagagcgggggaatctgttaaactgactattggacagacattgaatgcaacaaacacaagttgaagaaaaaggggtttctccaattttgatccaataattacctgacatttaacagctatattcttagcgttgacctgtgatgttggtcttgagagactcagctgatcttgaacaaatcaactttctctccatgggtgtgatcctcaaccagaacatctaggtcttggacaagatgtctcctgagatt

SEQ ID NO: 16485 - DNA, 108 bp, Homo sapiens
gttgcgcatagtgctagcgcttcgggttcggtcctcgcacccggcagccgccactggtgctgagctgctaggaagcccctatcgccgagctcgttggagcttgaaccc

SEQ ID NO: 16486 - DNA, 154 bp, Homo sapiens
gttgcgcatagtgctagcktcttcgcggttcggtcctcgcacccggcagccgcaactggtgctgagctgctaggaagcccctatcgccgagctcgttggagcttgaacccattgtcacccctccgactcaccggcscaaaaaaaaaaaaaaaaa

SEQ ID NO: 16487 - DNA, 143 bp, Homo sapiens
  misc_feature 18: n=a, g, c or t
gttgcgcatagtgctagnggcttcgggttcggtcctcgcacccggcagccgcactggtgctgagctgctaggaagcccctatcgccgagctcgttggagcttgaacccattgtcacccctccgactcaccggcccaaaaaaaa

SEQ ID NO: 16488 - DNA, 568 bp, Homo sapiens
cctgccgtaagtatacagtgcctccgggtcgcggtcattttgagcccctgtstggatgacttcttgcggckgtctctactcctctcccttccccgcggtaccttgcacttttctccctccctgccccctctacgagtccaccctccgggccttctgcccctgatcgcttggttttccttgcagtcgcctgctgctgtcgtcgggaggtgggtgaggaaagatgaatgggagggctgattttcaagagccgaatgcagaggttccaagaccaaattccccacatagggcctgaattacattccaacagaggaagaaaggagagtcttcgcagaatgcaatgattgaaagcttctggttcagatctgtgcctttggctgcaacaagtatgttgattactcaaggattaattagtaaaggaatactttcaagtcatcccaaaatatggttccatccctaaacttatacttgctttgtatcatgggatactttgctggaaaactttcttaatgtgaaaacttgccaagagaaattcaagaaacttgaaaattccccccttggagaagcttta

SEQ ID NO: 16489 - DNA, 297 bp, Homo sapiens
  misc_feature 42,45: n=a, g, c or t
attttgagcccctgtctggatgacttcttgcggctgttctancsnscccctccccgcggtaccttgcacttttctccctccctgccccctctcgagtccaccctccgggccttctgcccctgatcgcttggttttccttgcagtcgcctgctgctgtcgtcgggaggaaagatgaatgggagggctgattttcgagagccgaatgcagaggttccaagaccaattccccacatagggcctgattacattcsaacagaggaagaaaggagagtcttcgcagaatgcaatgctgaaagc

SEQ ID NO: 16490 - DNA, 419 bp, Homo sapiens
atttttttcctgccgaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcmtttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccsscmttggagaagctttacgatcaggacaagcacgacgatcttcaccacctgggcactattatcaaaagtcaaaat

SEQ ID NO: 16491 - DNA, 297 bp, Homo sapiens
  misc_feature 42: n=a, g, c or t
attttgagcccctgtctggatgacttcttgcggctgttctanccdscccctccccgcggtaccttgcacttttctccctccctgccccctctcgagtccaccctccgggccttctgcccctgatcgcttggttttccttgcagtcgcctgctgctgtcgtcgggaggaaagatgaatgggagggctgattttcgagagccgaatgcagaggttccaagaccaattccccacatagggcctgattacattccaacagaggaagaaaggagagtcttcgcagaatgcaatratgaaagc

SEQ ID NO: 16492 - DNA, 298 bp, Homo sapiens
  misc_feature 42: n=a, g, c or t
attttgagcccctgtctggatgacttcttgcggctgttctanccsdsgsccctccccgcggtaccttgcacttttctccctccctgccccctctcgagtccaccctccggccttctgcccctgatcgcttggttttccttgcagtcgcctgctgctgtcgtcgggaggaaagatgaatgggagggctgattttcgagagccgaatgcagaggttccaagaccaattccccacatagggcctgattacattccaacagaggaagaaaggagagtcttcgcagaatgcaatgatgaaagc

SEQ ID NO: 16493 - DNA, 189 bp, Homo sapiens
  misc_feature 7,10: n=a, g, c or t
gttctanccnscccctccccgcggtaccttgcacttttctccctccctgccccctctcgagtccaccctccgggccttctgcccctgatcgcttggttttccttgcagtcgcctgctgctgtcgtcgggaggaaagatgaatgggagggctgattttcgagagccgaatgcagaggttccaagaccaat

SEQ ID NO: 16494 - DNA, 296 bp, Homo sapiens
  misc_feature 42,45..46,289: n=a, g, c or t
attttgagcccctgtctggatgacttcttgcggctgttctanccnnsccctccccgcggtaccttgcacttttctccctccctgccccctctcgagtccaccctccggccttctgsccctgatcgcttggttttccttgcagtcgcstgctgctgtcgtcgggaggaaagatgaatgggagggctgattttcgagagccgaatgcagaggttccaagaccaattccccacatagggcctgattacattccaacagaggaagaaaggagagtcttcgcagaatgcaatrntgaaagc

SEQ ID NO: 16495 - DNA, 297 bp, Homo sapiens
  misc_feature 45,47: n=a, g, c or t
attttgagcccctgtctggatgacttcttgcggctgttctabccnkncccctccccgcggtaccttgcacttttctccctccctgccccctctcgagtccaccctccgggccttctgcccctgatcgcttggttttccttgcagtcgcctgctgctgtcgtcgggaggaaagatgaatgggagggctgattttcgagagccgaatgcagaggttccaagaccaattccccacatagggcctgattacattccaacagaggaagaaaggagagtcttcgcagaatgcaatrtgaaagc

SEQ ID NO: 16496 - DNA, 298 bp, Homo sapiens
  misc_feature 42: n=a, g, c or t
attttgagcccctgtctggatgacttcttgcggctgttctancccdcccyctccccgcggtaccttgcacttttctccctccctgccccctctcgagtccaccctccgggccttctgcccctgatcgcttggttttccttgcagtcgcctgctgctgtcgtcgggaggaaagatgaatgggagggctgattttcgagagccgaatgcagaggttccaagaccaattccccacatagggcctgattacattccaacagaggaagaaaggagagtcttcgcagaatgcaatratgaaagc

SEQ ID NO: 16497 - DNA, 513 bp, Homo sapiens
ataacattcaggatgtcatcttgaaagcagagaccaaggtcttcaccagagacagtctgccaatggcttgattttgcacttcccagcctatataactatgtactggttcatgaagatgtgcttatgggtttctactctaatgaggtttatataactttccaagacaagggaagttgtgcaaagcctcacagctactaagaggctgggctgggactcaggattaacttcgtgactccaaagcccatgcacctctgcaagccacacgaatcaagcagcttctctaaacctttgaagtcctggaaagtaactcttctgcaaatagaagcaagaatcctgtgagattgggatccatctagtactcttcaccatttggaacaactgcctccagagaatgcttctgacgcatcttggaagaacttggaataacctgaggaaatgggtcgatttgctaaatttaggaaaccaatgttcgatacgtgtgtgatcccaataaagcttatttwacaaaaaagc

SEQ ID NO: 16498 - DNA, 513 bp, Homo sapiens
tgagttctgccctttctgcccctctgctgtctgtgaacataacattcaggatgtcatcttgaaagcagagaccaaggtcttcaccagagacagtctgccaatggcttgattttgcacttcccagcctatataactatgaggtttatataactttccaagacaaggaagttgtgcaaagcctcacagctactaagaggctgggctgggactcaggattaacttcgtgactccaaagcccatgcacctctgcaagccacacgaatcaagcagcttctctaaacctttgaagtcctggaaagtaactcttctgcaatagaagcaagaatcctgtgagattgggatccatctagtactcttcaccatttggaacaactgcctccagagaatgcttctgacgcatcttggaagaacttggaataacctgaggaaatggtcgatttgctaatttaggaaaccaatgtttcgatacgtgtgtgatcccaataaagctattaacaaaaaaaaaaaaatgga

SEQ ID NO: 16499 - DNA, 503 bp, Homo sapiens
ataacattcaggatgtcatcttgaaagcagagaccaaggtcttcaccagagacagtctgccaatggcttgattttgcacttcccagcctatataactatgtactggttcatgaagatgtgcttatgggtttctactctaatgaggtttatataactttccaagacaaggaagttgtgcaaagcctcacagctactaagaggctgggctgggactcaggattaacttcgtgactccaaagcccatgcacctctgcaagccacacgaatcaagcagcttctctaaacctttgaagtcctggaaagtaactcttctgcaatagaagcaagaatcctgtgagattgggatccatctagtactcttcaccatttggaacaactgcctccagagaatgcttctgacgcatcttggaagaacttggaataacctgaggaaatggtcgatttgctaatttaggaaaccaatgttcgatacgtgtgtgatcccaataaagctattaacaaaa

SEQ ID NO: 16500 - DNA, 503 bp, Homo sapiens; identical to SEQ ID NO: 16499

SEQ ID NO: 16501 - DNA, 503 bp, Homo sapiens
awaacattcaggatgtcatcttgaaagcagagaccaaggtcttcaccagagacagtctgccaatggcttgawtttgcacttcccagcctatataactatgtactggttcatgaagatgtgcttatgggtttctactctaatgaggtttatataactwtccaagacaaggaagttgtgcaaagcctcacagctactaagaggctgggctgggactcaggattaacttcgtgactccaaagcccatgcacctctgcaagccacacgaatcaagcagcttctctaaacctttgaagtcctggaaagtaactcttctgcaatagaagcaagaatcctgtgagattgggatccatctagtactcttcaccatttggaacaactgcctccagagaatgcttctgacgcatcttggaagaacttggaataacctgaggaaatggtcgatttgctaatttaggaaaccaatgttcgatacgtgtgtgatcccaataaagctattaacaaaa

SEQ ID NO: 16502 - DNA, 429 bp, Homo sapiens
aagaccagtgagagaacatggcagggtcagatgaggaaagatactctggggaactcacgcacgcagaggaataagaggaagcagtcgttttgcatgtaaagccaggctgatccagagcaggcaggtggcatgcaaaggctgagggactggcaggctggcagcattgcccagaggagctcagtctgggagcacagagacagcgcatctctgggaccagactctgcaggcacagagtgaggaccagcagctctcctctggctgcagcccttgtatataaggctgcaaagctgcaatcatctcgaggaactctgtgcagcagcaggagcttatcccagagggaaacacctggaggaccccgggagtcaggcatcatgggccgcgggtctcagactctgtccaagaagcagtcaggggaagatgccatctttc

SEQ ID NO: 16503 - DNA, 272 bp, Homo sapiens
gaacccagctcttccctacgcggtcggcacatgcgcggcastcttttccttcttcctccacttcccctaccctccaccgtccgggagccgccgccaccgccgccgaggagtcaggaagttcaagatggccgccgcggagacccagtcgctacgggagcagccagagatggaagatgctaattctgaaaagagtataaatgaagaaaatggagaagtatcagaagaccagtctcaaaataagcacagtcgtcacaaaaaaaaaaaaaaaaagg

SEQ ID NO: 16504 - DNA, 305 bp, Homo sapiens
tttttctagggttgttacgaagctgcaggaggaaaatgaaatgaggaggaggaggaggaaaaagaaatggaggaggaaaaagaaacaggaggaggaaaaagaaacggaggaggaagaggaggaggaggacaaagaaacagccaggccggacgtggtggctcacccctgtagtcccagctgctcgggaggctgaggcagaagaatcgcttcaacccgggaggcagagtttgcgtgascgagatcgtgccactgcattccagcctggagacagagtgagactccatctcatctcaaaaaaaaaaaaa

SEQ ID NO: 16505 - DNA, 439 bp, Homo sapiens
  misc_feature 45: n=a, g, c or t
gatcaacttaaaggcaagaagatgaggaagaaggaagcggasagngtgctgcagaagtttgttcaaaacaagtggctgattgagaaggaaggggagttcaccctgcacggccgggccatcctggagatggagcaatacatccgggagacgtaccccgacgcggtgaagatctgcaatatctgtcacagcctcctcatccagggtcaaagctgcgaaacctgtgggatcaggatgcacttaccctgcgtggccaagtacttccagtcgaatgctgaaccgcgctgcccccactgcaacgactactggccccacgagatcccaaaagtcttcgaccctgagaaggagagggagtctggtgtcttgaaatcgaacaaaaagtccctgcggtccaggcagcattagccatcgtgccctgctgaggggctggctgccttgagtd

SEQ ID NO: 16506 - DNA, 484 bp, Homo sapiens
  misc_feature 470: n=a, g, c or t
aggggcccctacaagcggccacaaggatggcaggcttcgcggactcgggctgtcatcgtggctcgtggaacaatgtcggcagctgggtttgaagcagcccacgcccgtgcagctcggctgmwtccccgccatcctggagggtcgagactgcttgggctgtgctaagacaggcagtgggaagacagcagcgtttgtccttcccatcttgcagaagctgtctgaggatccctatggcatcttctgcctcgtcctgacacccaccarggagctggcctaccagatcgcagagcagttccgggtcctggggaagcctctagggctgaaagactgcatcatcgtcggtggcatggacatggtggcccaggcgctggagctctctcggaaaccacacgtggtcatcgccacgccggggcgcctggcagatcacctgcgcaggctccaacacttttagtmtaaagaagatccgcttnctggtgatggatga

SEQ ID NO: 16507 - DNA, 555 bp, Homo sapiens
ggtgacactggattctctccatcatggagggggtgggcctttgcttgggaaaacacaggctttctgcatgtgggttttcctctctatgatcgtgcttttgccggcactattatcccaacattgcctctgattaatgtgcttattgcacagaggacatgcgttgaarggactcaggcccagaggactcaccatactacacctagcttccctctcacccagaagcagctaacctgatgaaacaaatgccctggccttgggaagacttagctatatcctaattggagccaacacccagaaaaaaagaagcactgtcctaaagatagtagatgatttgaatcagcgtgtgatatggggtgctgatttttccaaagcttgaatatatgggtccaggaatcaaggaccaagtgggagtgttttctccactattacacaagatttctcacttacagaatttttatattcttcctctatcaagctctactacctttggttccaacggaaacatgcctgtaccagggccagcascctcgaacagtgactgacaggagctggtat

SEQ ID NO: 16508 - DNA, 477 bp, Homo sapiens
tatccagtgaatcccactccctgggaggtggattcatctctaaattccattagttacttttaccttcagtaaatggtctcagcacaggtactgctccatcccatgagtggccacccaggaattaaaggttcctaattccccaccctctcattgtccctcttcccaaaccacaggtttccatgagcctgggctgttataacaaatctcagtttttctgacaccaagtgagagagtctttcctccccaacacctgtcaatttgtgataccaactggatgcccaacagttcaattcattcctaactgaatgtcagactccacaggtttaagagttcattctcacaagactgtcttcacttctgatgccagccacaaatgaggtatcaggtgtcttggtttatttgtgttactataaaatacctgaggctggttaatttataaagaaaagaagtttggcctggtgcagtggcttacacctg

SEQ ID NO: 16509 - DNA, 362 bp, Homo sapiens
atgcccagaaaatatggtaagctatgttaacaagccatattagatatcaagcattaatatggaaataaaccaggtaactcctgtgtaattgatctttgtggggacttggaggaggggaggtgaatctaaactaggtttagtgtgtgctaaacttaattaatggttaactaaattcattcaaagatatctgtaacttgtggtctgatagtgctggtttttggatatgaatttgtcattaagactacctgggctgactctcttttcggactcagcccacctgcacccaggtgaaataaacagctttattgctcacaaaaaaaaaaaaaaaaaaaaaaaaaaaaammmaaaaaaaaaaaaaaaar

SEQ ID NO: 16510 - DNA, 169 bp, Homo sapiens
aaaagatatctgtaacttgtggtctgatagtgctggtttttggatatgaatttgtcattaagactacctgggctgactctcttktcggactcagcccacctgcacccaggtgaaataaacagctttattgctcacagaaagcctgtttggtggtctcttcacatggacg

SEQ ID NO: 16511 - DNA, 509 bp, Homo sapiens
tacgtttaaatgttgttctagtaaatattcttgaatgtattaaaatggctgaaacaacaagcttgggcttttctagcttgccctccactccctgccgtccctctgacgtcgcataaaccagaacccagctccctcctgggactggctgtggagagaagggcacctctgagccagcctgtggccctaccccaaggcgcacttcctcatgtgggcagatcctgaccaggagtccaggttggcctcccctgggccacagcacatcaccgtgtggcctggggctgtgggacagtgagccctgtaaccactagggttctgtgacagatgccaagaccccagagaccgtggcagagctacccccaggagagcggaagcccctacacagcccagacacatgccttccctgggggctggggagtgtgtctcgaggggttttgtttgttttgaggcatgtatcatcttggaaataattgtcaggatgtataaaatagagaaaaagaaaaaaggtatcc

SEQ ID NO: 16512 - DNA, 421 bp, Homo sapiens
tttatttgttgtttgttttccatgaggttatcggaccatgggctgagctcaggcactttctgtaggagactgttatttctgtaaagatggttatttaaccctcctccaccccatcacggtggccctgagggctgacccggagccagtggagctgcctggtgtccacgggggagggccaaggcctgctgagctgattctccagctgctgccccagcctttccgccttgcacagcacagaggtggtcaccccagggacagccaggcacctgctcctcttgcccttcctgggggaagggagctgccttctgtccctgtaactgctttccttatggcccagcccggccactcagacttgtttgaagctgcactggcagcttttttttkgtctcctttgggtattcacaacagccaggggacttga

SEQ ID NO: 16513 - DNA, 131 bp, Homo sapiens
ctgattgtacttgtaacaatattgtaatgaacggctgtgcagtaggcccagcgctgctgtgtctcgtcagaggaatagcttaccacgaacccctcagcatactgggaatctcttcctgaacaacgaatgta

SEQ ID NO: 16514 - DNA, 193 bp, Homo sapiens
gaaaatggcttctcacctagggagtggaatgttccagcctctgtttcctgcmgtgagtgactctaaaatctaccaagcaatgtagcaacgagactggttcagattatttaccaagggttgggggttttcagcgtaactcacaagagaaataaacttggcagccttgggaaaaaaaaaaaaaaaaaaaaaaaaa

SEQ ID NO: 16515 - DNA, 198 bp, Homo sapiens
gaaaatggcttctcacctagggagtggaatgttccagcctctgtttcctgcagtgagtgactctaaaatctaccaagcaatgtagcaacgagactggttcagattatttaccaagggttgggggttttcagcgtaactcacaagagaaataaacttggcagccttgggaaaaaaaaaaaaaaaaaaaaaaaaaaaaaa

SEQ ID NO: 16516 - DNA, 197 bp, Homo sapiens
gaaaatggcttctcacctagggagtggaatgttccagcctctgtttcctgcagtgagtgactctaaaatctaccaagcaatgtagcaacgagactggttcagattatttaccaagggttgggggttttcagcgtaactcacaagagaaataaacttggcagccttgggaaaaaaaaaaaaaaaaaaaaaaaaaaaaa

SEQ ID NO: 16517 - DNA, 403 bp, Homo sapiens
tttttttttttggcaaggcacagttacggttaaatgattaaggtgggcgtattcgaatgtttatgttttcatcagaatgtaatcaagatgacgcacatttttatagcggctacaatattaaggttttctaaatctttttctcattagaggaccatattcaacgataatattatttatctataacagcgtttttctacaatggacatagctgttcaaatgtttctctttttgtgagagtatcttgggggttttattaatactccacccccatctccattcctaccggcaaaaacagcaaaggcactagaaccttcattgatgactgtctggattggtagtataatgtatttctggaaagtacttcttaaaaaatatttttctactttggatttttttttttttt

SEQ ID NO: 16518 - DNA, 446 bp, Homo sapiens
cttgttctatatgtccatgctctgctccacttctgccccttcactctgcccccacacatcactccagactggccttgtggtcrsagcctggaatgcctrggctgctgggggtctgtggactgcactgggccagaacccctgccgccttcaagactggcctgtagccagcaggtaggtgacttttcccaggccggcctatcccacctttcccctccactcactcacctcccttgcctgggtcaattagagaaagcttgtcggccaggcatggtggctcatgcctgtaatctcagcactttgggaggccgaggcgggcggatcatctgagctcaggagtttgagaccagcctggccaacatggcaaagccccgtctctactaaaaatacaaaaattaaccggatgtggtggtgtgcacctgtgatcccagctactcgggaggctgagg

SEQ ID NO: 16519 - DNA, 382 bp, Homo sapiens
aggaaaaagtgtcctccccttttcagacatgtacacggtgggctccatgggaacttctgtagggagaaggagggattacctaaattaagcccgcagttacagaaacaagagaagtggcactttgtgcttgcctagagacatacccacaactacataagataaggggagttgcacagacagctactaataagagaaactactcaaacagctacagagatgaggggagtttcttataaaagcttttgaattcaactctaaaaacagcaacccactagggctcccctctacactgtgcagaggtttcttcttctgcttattaaactttcgctcctatctcaccctttgcatccacgctccttcggtcgtgagamagcgaactcgg

SEQ ID NO: 16520 - DNA, 465 bp, Homo sapiens
aatgagtttagtgcccttatgaagagaaacatgagagagatgataactttctagacaaaatgggaatacaaggtgaagatagccacctgcaaactatgatgtaggccctcaccagacactgaatcttcctggccttgattttggacttcctagcctctagaattggtcttgctctgtcgtccaggctgaagtgcactggcatgatctcagctcattgcaacctccaccttctgggctcaagcaatcctcttaccttagcctcctgagtaactgagaccacaagcatgcaccaccataccaggtaagaagaaaaagttagcactacaatgctatagtcacatttatgtttttgttttcacacgcacttcatatctaagactcagtgggcctcaccaagaaacaaagaatttgctctatcctcaacgttgcaaaatgtctgggcataggctgtgttgcatttctcac

SEQ ID NO: 16521 - DNA, 426 bp, Homo sapiens
agttacggcgcaggcgcaagataagctaggagccgcgcgagtcgtagtgtcgctgtttgcgggtctccgcgcgggaccggggcgcasggggtcgctgaggcgagggtgtcatgtcagacaacgaggacaattttgatggcgacgactttgatgatgtggaggaggatgaagggctagatgacttggagaatgccgaagagttttagtagtgacggggttcaccgtgttagccaggatggtctcgatctcctgccttgtgatccgcccgcctcggcctcccaaagtgctgggattacaggaaggccaggagaatgtcgagatcctcccctctggggagccgaccgcagccaaccagaagcgaatcaccacaccatacatgaccaagtacgagcgagcccgcgtgctgggcacccgagcgctccagat

SEQ ID NO: 16522 - DNA, 178 bp, Homo sapiens
aagctaggagccgcgcrtgtcgtagtgtcgctgtttgcgggtctccggcgggaccggggcgcmgggggtcgctgaggcgagctcatcatcaccgactgagctggagtcatcttcctgcccttgccccatgcccaattttcattctcactttatatgtgtaaataataaaatattcaac

SEQ ID NO: 16523 - DNA, 193 bp, Homo sapiens
caccttggagcccactcacctggtcctgttgttttaccccatcccttctctcgcgcgcctattgatttgtttctgaggagagtacaccgttcactattgtagagtaacccctgtgactcaatattaccatagtgcgatgtcgttttgtgctattttgaacaattaaaagactttttttgaaaaaaaaaaaaaa

SEQ ID NO: 16524 - DNA, 457 bp, Homo sapiens
attttcccatctttcttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggagttcacaacctctgtggtccgtagagccactatgaggagggccctgggaagaatttgccattttcagtggaaaacaagtggtcgttactagctaagatgtgtttgtactttggatctgcatttgctacacccttccttgkagtaagacaccaactgcttaaaacataaggatgtttcagttcctccatttaacagatatgaagagcattttaagaggtgcagctctggaagtggatcaaactagaactcatatgccatactagatatgtttgtcaataaacttatgacgtgaaaaaaaaaaaaaaa

SEQ ID NO: 16525 - DNA, 413 bp, Homo sapiens
aacgaagtcctgtcggtccctaccggcacatcacacactcctggaagcatgatcttcactcccttccttccacctgctgacctgaatgtgaaagggctgcaaaacgaccctgaggaatgggtggctgtgtctgacgccacggaggacccatccggtggcacaggcttgcccagggaacctgctcttctgcgagggtcttggaggagccggttccagagagccctggcatgtttcaccaagtgtttcaggggaggataccgggcactcggaatctgagaccaccggagccacagacacagagccatgaacggtgaccaagccccttctgctgctccatgcccctgctcgccgcagtgtcccagtcaccaggcctgaaataaatgctggcacgcttgactgttaaaaaaaaaaaa

SEQ ID NO: 16526 - DNA, 538 bp, Homo sapiens
gagaggattgttgtagcaggaaataatgaggatgtttcattttcaagaccagcagatcttgaccttattcagtcaactccctttaaactcctcgcactaaaaacagcacctcgtgtacttaggctaagtgaaagaccactagattttctggatttagaaagacctcctacaacccctcaaaatgaagaaatccgtgcagttggccgactaaaaagagagcggtctacgagtgaaactgctgttcgccaaaatggacagctggtcagaaatgattctctttatggcatttcaaatacagatacaacaattgaaggaacatcagatgacctgactgttgtagatgcagcttcactaagacgacagataatcaaactaaatagacgtctacaacttccggacgaggagaacaaagaacgtgctaaaagagaaatggtcgtgtattcaattactgtagctttctggctgcttaatagctggctctggttttgccgctagagatactgctgtggtctgggagcaaagtctttgaagacttacc

SEQ ID NO: 16527 - DNA, 69 bp, Homo sapiens
gattgttacagcagagaacaacggagacattctgttttgaagaccagtggattttgactttattcagtc

SEQ ID NO: 16528 - DNA, 439 bp, Homo sapiens
tacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattttgtcactcagctgtattcacgtctgagcagttctgcagtaacacctgcttaaaattctccctttgcat

SEQ ID NO: 16529 - DNA, 430 bp, Homo sapiens
aacgaagtcctgtcggtccctaccggcacatcacacactcctggaagcatgatcttcactcccttccttccacctgctgacctgtctgtctttcagaatgtgaaagggctgcaaaacgaccctgaggaatgggtggctgtgtctgacgccacggaggacccatccggtggcacaggcttgcccagggaacctgctcttctgcgagggtcttggaggagccggttccagagagccctggcatgtttcaccaagtgtttcaggggaggataccgggcactcggaatctgagaccaccggagccacagacacagagccatgaacggtgaccaagccccttctgctgctccatgcccctgctcgccgcagtgtcccagtcaccaggcctgaaataaatgctggcacgcttgactgttaaaaaaaaaaaaaaaaa

SEQ ID NO: 16530 - DNA, 470 bp, Homo sapiens
tacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattttgtcactcagctgtattcacgtctgagcagttctgcagtaacacctgcttaaarattctccctttgcatgttttgtaaataggctccagttttgttttt

SEQ ID NO: 16531 - DNA, 503 bp, Homo sapiens
tacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattttgtcactcagctgtattcacgtctgagcagttctgcagtaacacctgcttaatrattctccctttgcatgttttgtaaataggctccagttttgttttttaaaaggaatttattttttgcctcatcagtcca

SEQ ID NO: 16532 - DNA, 350 bp, Homo sapiens
agtggatgctttggcaagatggcggggagcggcgtccscaagctacttaccgccagcaccttcgtgaagcccattttcagtcgggacatgaacgaggccaagcggagggtgcgcgastctaccgcgcctggtatcgggaggtgccgaacactgtgcaccaattccagctggacatcactgtgaaaatgggacgggataaagtccgagaaatgtttatgaagaatgcccatgtcacagaccccagggtggttgatcttctggtcattaagggaaagatcgaactggaagaaacaattaaagtatggaagcagcggacacatgttatgcggttcttccatgaaacaaagcgc

SEQ ID NO: 16533 - DNA, 422 bp, Homo sapiens
aacgaatcctgtcggtccctaccggcacatcacacactcctggaagcatgatcttcactcccttccttccacctgctgacctgtctgtctttcagaatgtgaaagggctgcaaaacgaccctgaggaatgggtggctgtgtctgacgccacggaggacccatccggtggcacaggcttgcccagggracctgctcttctgcgagggtcttggaggagccggttccagagagccctggcatgtttcaccaagtgtttcaggggaggataccgggcactcggaatctgagaccaccggagccacagacacagagccatgaacggtgaccaagccccttctgctgstccatgcccctgctcgccgcagtgtcccagtcaccaggcctgaaataaatgctggcacgcttgactgttaaaaaaaaaa

SEQ ID NO: 16534 - DNA, 159 bp, Homo sapiens
atattgtttagctgcttggagagttttttgtcatccacaacttggagtatgatggtacctgtctcacgggttgccatggggttcacacaagctaacccggtactcactagggccaagcacatagtaactgctcagtaaatggcatcatcggcggtgaaa

SEQ ID NO: 16535 - DNA, 193 bp, Homo sapiens
atattgtttagctgcttggagagttttttgtcatccacaacttggagtatgatggtacctgtctcacgggttgccatggggttcacacaagctaacccggtactcactagggccaagcacatagtaactgctcagtaaatggcatcatcggcggtgaaaaaaaaaaaaaaaaaaaaaaaaaaaaaaaaaaaaa

SEQ ID NO: 16536 - DNA, 213 bp, Homo sapiens
atattgtttagctgcttggagagttttttgtcatccacaacttggagtatgatggtacctgtctcacgggttgccatggggttcacacaagctaacccggtactcactagggccaagcacatagtaactgctcagtaaattggcatcatcggcggtgaaaaaaaaaaaaaaaaaaaaaaaaaaaaaaaaaaaaaaaaaaaaaaaaaaaaaaaa

SEQ ID NO: 16537 - DNA, 194 bp, Homo sapiens
atattgtttagctgcttggagagttttttgtcatccacaacttggagtatgatggtacctgtctcacgggttgccatggggttcacacaagctaacccggtactcactagggccaagcacatagtaactgctcagtwaaatggcatcatcggcggtgaaaaaaaaaaaaaaaaaaaaaaaaaaaaaaaaaaaaa

SEQ ID NO: 16538 - DNA, 185 bp, Homo sapiens
atattgtttagctgcttggagagttttttgtcatccacaacttggagtatgatggtacctgtctcacgggttgccatggggttcacacaagctaacccggtactcactagggccaagcacatagtaactgctcagtaaatggcatcatcggcggtgaaaaaaaaaaaaaaaaaaaaaaaaaaaaa

SEQ ID NO: 16539 - DNA, 187 bp, Homo sapiens
atattgtttagctgcttggagagttttttgtcatccacaacttggagtatgatggtacctgtctcacgggttgccatggggttcacacaagctaacccggtactcactagggccaagcacatagtaactgctcagtaaatggcatcatcggcggtgaaaaaaaaaaaaaaaaaaaaaaaaaaaaaaa

SEQ ID NO: 16540 - DNA, 190 bp, Homo sapiens
atattgtttagctgcttggagagttttttgtcatccacaacttggagtatgatggtacctgtctcacgggttgccatggggttcacacaagctaacccggtactcactagggccaagcacatagtaactgctcagtaaatggcatcatcggcggtgaaaaaaaaaaaaaaaaaaaaaaaaaaaaaaaaaa

SEQ ID NO: 16541 - DNA, 165 bp, Homo sapiens
atattgtttagctgcttggagagttttttgtcatccacaacttggagtatgatggtacctgtctcacgggttgccatggggttcacacaagctaacccggtactcactagggccaagcacatagtaactgctcagtaaatggcatcatcggcggtgaaaaaaaaa

SEQ ID NO: 16542 - DNA, 188 bp, Homo sapiens
atattgtttagctgcttggagagttttttgtcatccacaacttggagtatgatggtacctgtctcacgggttgccatggggttcacacaagctaacccggtactcactagggccaagcacatagtaactgctcagtaaatggcatcatcggcggtgaaaaaaaaaaaaaaaaaaaaaaaaaaaaaaaa

SEQ ID NO: 16543 - DNA, 168 bp, Homo sapiens
atattgtttagctgcttggagagttttttgtcatccacaacttggagtatgatggtacctgtctcacgggttgccatggggttcacacaagctaacccggtactcactagggccaagcacatagtaactgctcagtaaatggcatcatcggcggtgaaaaaaaaaaaa

SEQ ID NO: 16544 - DNA, 410 bp, Homo sapiens
  misc_feature 122,146,152: n=a, g, c or t
gtcttcaacgaakcctgtcggtccctaccggcacatcacacactcctggaagcatgatcttcactcccttccttccacctgctgacctgtctgtctttcagaatgtgaaaggkctgcaaawngaccctgaggaatgggtggctgtntstgwngccacggaggacccatccggtggcacaggcttgcmcagggaactgctcttctgcvagggtcttggaggagccggttccagagagccatggcatgtttcaccaagtgtttcaggggaggataccgggcactcggaatctgagaccaccggagccacagacacagagccatgaacggtgaccaagccccttctgctgctccatgcccctgctcgccgcagtgtcccagtcaccaggcctgaaataaatgctggcacgctt

SEQ ID NO: 16545 - DNA, 173 bp, Homo sapiens
atattgtttagctgcttggagagttttttgtcatccacaacttggagtatgatggtacctgtctcacgggttgccatggggttcacacaagctaacccggtactcactagggccaagcacatagtaactgctcagtaaatggcatcatcggcggtgaaaaaaaaaamaaaaam

SEQ ID NO: 16546 - DNA, 191 bp, Homo sapiens
atattgtttagctgcttggagagttttttgtcatccacaacttggagtatgatggtacctgtctcacgggttgccatggggttcacacaagctaacccggtactcactagggccaagcacatagtaactgctcagtaaatggcatcatcggcggtgaaaaaaaaaaaaaaaaaaaaaaaaaaaaaaaaaaw

SEQ ID NO: 16547 - DNA, 168 bp, Homo sapiens; identical to SEQ ID NO: 16543

SEQ ID NO: 16548 - DNA, 170 bp, Homo sapiens
atattgtttagctgcttggagagttttttgtcatccacaacttggagtatgatggtacctgtctcacgggttgccatggggttcacacaagctaacccggtactcactagggccaagcacatagtaactgctcagtaaatggcatcatcggcggtgaaaaaaaaaaaaar

SEQ ID NO: 16549 - DNA, 442 bp, Homo sapiens
ataattttcagagccagccgggagtgcaggagggagaactttcctgtggacgtcctgtgttctccagacgcagagaaccctcatcaaccgagggggaggtcacttccgaatccacagatggcgtgtgagtgcatggcgagcgcctccaggacacacttactgttcccttgctctggccagacgccagccggaccctgtgtgtgcgcgccgtgctgctctttgcagctgcctgcaagggttcctgcgaagaccagcaccttggggaagagcctgcgctgaacttgaactcgcagctacctgagtcagacctgtgctttttcacctctacggaagatgtcagagcgtttccctagcaatgttttagaagttacttctgtctggaaaaaaatggaaaaaatggcaaattatgttatgtataatttgataattttaaagaattaat

SEQ ID NO: 16550 - DNA, 235 bp, Homo sapiens
  misc_feature 50: n=a, g, c or t
aactgcaggccgggaccgactgtcttgacgttcacgacccccgcccaagnggaaagcggccaagcttccgcgggccccaaggggcmaaaggctcaccagatgtaagaccctgaagacctgagatgtccacggagcccttaactccacggaagaataaaccaccaccgctcaccgaaaaaaaaaaaaaaaaaaaaaaaaaaaaaaaaaaaaaaaaaaaaaaaaaaaaaaaaaaaaw

SEQ ID NO: 16551 - DNA, 201 bp, Homo sapiens
aactgcaggccgggaccgactgtcttgacgttcacgacccccgcccaaggkgaaagcggccaagcttccgcgggccccaaggggchaaaggctcaccagatgtaagaccctgaagacctgagatgtccacggagcccttaactccacggaagaataaaccaccaccgctcaccgaaaaaaaaaaaaaaaaaaaaaaaaaag

SEQ ID NO: 16552 - DNA, 192 bp, Homo sapiens
aactgcaggccgggaccgactgtcttgacgttcacgacccccgcccaaggggaaagcggccaagcttccgcgggccccaaggggcaaaggctcaccagatgtaagaccctgaagacctgagatgtccacggagcccttaactccacggaagaataaaccaccaccgctcaccgaaaaaaaaaaaaaaaaaaa

SEQ ID NO: 16553 - DNA, 184 bp, Homo sapiens
aactgcaggccgggaccgactgtyttgacgttcacgacccccgcccaaggggaaagcggccaagcttccgckggccccaaggggcaaaggctcaccagatgtaagaccctgaagacctgagatgtccacggagcccttaactccacggaagaataaaccaccaccgctcaccgaaaaaaaaaaa

SEQ ID NO: 16554 - DNA, 539 bp, Homo sapiens
  misc_feature 502: n=a, g, c or t
acagagaggaaagacagtggcagatggagacgtataaagcagggatcctgttatgaaaagccctaaaaaatagggtatagagtttgggccatatttcagaggtaataagaaagcattctgcatttttaaagtaaggtttaaaaatgtttctaattagagatacagcaaagttggtgtgagaggataaagactgatatacataatctgaggagttcatgaaaattccatgtaaagcctgtagtatgaattggtcctaggagacagacagcttcaggggcatagagaactttaagcacttttccaagaagagtgaagggctggagaataaattgtgaactaaaatatattttgtgtttgagaacatgaagtacttgagagtgattattacacggttttaagaaaaaactagttcttttaaataaaacttttttttagctgagcacagtggctcacgcctgtaatcccagcactttgggaggccgaggcaggcggatcacctgangggtccggggagtcgagatcagcctgaccaacatggg

SEQ ID NO: 16555 - DNA, 179 bp, Homo sapiens
  misc_feature 24: n=a, g, c or t
aactgcaggccgggaccgactgtnttgacgttcacgacccccgcccaaggggaaagcggccaagcttccgckggccccaaggggcaaaaggctcaccagatgtaagaccctgaagacctgagatgtccacggagcccttaaactccacggaagaataaaccaccaccgctcaccgaaaa

SEQ ID NO: 16556 - DNA, 231 bp, Homo sapiens
  misc_feature 16,50: n=a, g, c or t
aactgcaggccgggancgactgtcttgacgttcacgacccccgcccaagnggaaagcggccaagcttccgcgggccccaaggggcaaaggctcaccagatgtaagaccctgaagacctgagatgtccacggagcccttaactccacggaagaataaaccaccaccgctcaccgaaaaaaaaaaaaaaaaaaaaaaaaaaaaaaaaaaamaaaaaaaaaaaaaaaaaaaaaw

SEQ ID NO: 16557 - DNA, 234 bp, Homo sapiens
aactgcaggccgggaccgactgtcttgacgttcacgacccccgcccaaggggaaagcggccaagcttccgcgggccccaaggggcmaaaggctcaccagatgtaagaccctgaagacctgagatgtccacggagcccttaactccacggaagaataaaccaccaccgctcaccgaaaaaaaaaaaaaaaaaaaaaaaaaaaaaaaaaaaaaaaaaaaaaaaaaaaaaaaaaaaw

SEQ ID NO: 16558 - DNA, 182 bp, Homo sapiens
  misc_feature 50: n=a, g, c or t
aactgcaggccgggaccgactgtcttgacgttcacgacccccgcccaabngsaaagcggccaagcttccgcgggccccaagggchaaaggctcaccagatgtaagaccctgaagacctgagatgtccacggagcccttaactccacggaagaataaaccaccaccgctcaccgaaaaaaaam

SEQ ID NO: 16559 - DNA, 233 bp, Homo sapiens
aactgcaggccgggaccgactgtmwtgacgttcacgacccccgcccaaggggaaagcggccaagcttccgcgggccccaaggggcaaaggctcaccagatgtaagaccctgaagacctgagatgtccacggagcccttaactccacggaagaataaaccaccaccgctcaccgaaaaaaaaaaaaaaaaaaaaaaaaaaaaaaaaaaaaaaaaaaaaaaaaaaaaaaaaaaar

SEQ ID NO: 16560 - DNA, 472 bp, Homo sapiens
gattaaaggagaaaccaccatattaagagatttagaaacattatagacagctgtaaaacaaaagtcagaataataaatttgcttaggtacaggtgagcttgttggagcttttaaaaaatgcttgacatgtcaagtgaataataaattattttcagtattttattggtattttgaacatcacatttctatgaatttcaagcaagtttgtaactgcattgagatcatatttttataggtagaacaacaaaagtatatagagctcaacaaaagtatatagagctcaggggcagcttttgaagtcagagacggagaaaaatctttgtttatcaaaatagacgtatatgatttatttttaatttttaaaaagtatctattstgttgytattatttttttttagagacagggtttcactctgttgcccaggttggagtacaatggcatgatcattgcttactgcagccctgaactctt

SEQ ID NO: 16561 - DNA, 903 bp, Homo sapiens
ataaatccattcaggtgacaaccatcatcaaaattacaaattttctgattgaactcatctgaatcatcagttccttgatggagagagagaaggagatggaatgtgtctggtaaccccaaatggagtacaagtagcctttgttttcctgcataaatggacttgttgaatgcagaacgaatatatgcaattcatatacttttggagatgaacgtagatatgtgtgtcagctttgagatggtgtgtcctggattaatactttgtctcccaatatcacagaaaaatacatgccagtgactcttgaggttaaggtagttgggatgaaatggcctcaggcaatttcacattccctaattacctggaaagttctacagtaattaatatgcagctaactcctgttgccctcacaagagcatcagccttctagaatcggagctccggagtgtgaagattcagtattgatatgatatgtataccaaactccagccaacttactgccatttttcataatctgagtggctgccttgcttatcctaagctgtggttgcagaaaccgtggccatttatataagctataacatcaaatcagggaaaaatgaggaaaaaaaatagattctgaaccatttattgttgaataagtagagaaaatcatcaataaatatttattacattctgacagggtgtgtggcattgtgttctatgccagagtgacaaagttgattcacccctttttggggaccttaatatattttttaagggatgtgcctatgcattgatgcctgaaaaatatgtataaagaaatgaggttgactcttctgagcagttcatcttttccagaggtaagggtaggaggccaacttcagggtctgggtctgagcccgtgggcaagccctggccgagtgagct

SEQ ID NO: 16562 - DNA, 436 bp, Homo sapiens
aatgtttatgccctatcgccatggtgacgggattagggatctcctgctcttggtcctaagagccactgtctgtgctgtgtttttcaaaggtcagcacagattgaacctttgtggttttattatccctgagtttgatttttctcatggggaacctgtgttgctgctttgaagccgttggacctcacaatgtggattgtgccctcaccctgcaatgtttatgccctatcgtcatggtgacgggagtagggatctcctgttcttggtcttaagtgccaatgtctgtgctgtgtttttcaaagctatgtttccagtgtcctctgggtgtttccaagagcaacaagaaacgaataaatctctgctctggggccaagctgcatcacaatggaaatcatggagccacaggaagaatccactcagctttgcaacatgctgccca

SEQ ID NO: 16563 - DNA, 438 bp, Homo sapiens
  misc_feature 381,389: n=a, g, c or t
taaaatgggagggggagacgcaagatggcggcasccgaactccggctctagctcccgctgttcgactgcccaacctgggcargtaagccccctcccggtttacatctggatgtagtcaaaggagacaaactaattgagaaactgattattgatgagaagaagtattacttatttgggagaaaccctgatttgtgtgactttaccattgaccaccagtcttgctctcgggtccatgctgcacttgtctaccacaagcatctgaagagagttttcctgatagatctcaacagtagcttagaacctgacagagttcaacactgcccacaacaagcggatttctacccttaccattgaggagggaaatctggacattcaaagacnaaagaggnaagagcaagaactcacgggtgacattcagtgaggatgatgagatcatca

SEQ ID NO: 16564 - DNA, 417 bp, Homo sapiens
aaaaaaatgggagggggagacgcaagatggcggcascgcgaactccggctctagcctcccgctgttcgactgcccaacctgggcaggtaagccccctcccggtttacatctggatgtagtcaaaggagacaaactaattgagaaactgattattgatgagaasmaagtattacttatttgggagaaaccctgatttgtgtgactttaccattgaccaccagtcttgctctcgggtccatgctgcacttgtctaccacaagcatctgaagagagttttcctgatagatctcaacagtacacacggcactttcttgggtcacattcggttggaacctcacaagcctcagcaaattcccatcgattccacggtctcatttggcgcatccacaagggcatacactctgcgcgagaagcctc

SEQ ID NO: 16565 - DNA, 222 bp, Homo sapiens
tcctccgcggctccgccaccatcgcggaggtgccgctgttcccacagacgctcgcgagcaaccctccgcgctccggagcctcctcagcctcccgcacaccccgagacgctcgccccgctgggcctcggtccccgcctcctcccccgtccttttcccctctctcgctccccacattgtctctgcctcattttctctcctagttgaggawwaaaaaaaaaaaaa

SEQ ID NO: 16566 - DNA, 431 bp, Homo sapiens
ctttcgccagccttacgggcccgaaccctcgtgtgaagggtgcagtacctaagccggagcggggtagaggcgggccggcacccccttctgacctccagtgccgccggcctcaagatcagacatggcccagaacttgaaggacttggcgggacggctgcccgccggccccggggcatgggcacggcctgaagctgttgctgggggccggcscsgtkgsctacggtgtgcgcgaatctgtgttcaccgtggaaggcgggcacagagccatcttcttcaatcggatcggtggagtgcagcaggacactatcctdgccgagggcttcacttcaggatcccttggttccagtaccccattatctatgacattcgggccagacctcgaaaaatctcctcccctacaggctccaaagacctacagatggtgaatatct

SEQ ID NO: 16567 - DNA, 112 bp, Homo sapiens
ttggaggcctgaaaccaccggaacgaggtggggcacttgtttcctgagtccgggctggaaatctcggagttaccgattctgcggccgagtagtggagaaagagtgcctggga

SEQ ID NO: 16568 - DNA, 606 bp, Homo sapiens
  misc_feature 590: n=a, g, c or t
agtagtagagggggctatggtggtggtggaccaggatatggaaaccaaggtggtggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggctacagttcttagcaggagagagagcgaggagttgtcaggaaagctgcaggttactttgagacagtcgtcccaaatgcattagaggaactgtaaaaatctgccacagaaggaacgatgatccatagtcagaaaagttactgcagcttaaacaggaacccttcttgttcaggactgtcatagccacagtttgcaaaaagtgcagctattgattaatgcmatgtagtgtcaattagatgtacattcctgaggtcttttatctgttgtagctttgtctttttctttttnccttttcattacatca

SEQ ID NO: 16569 - DNA, 161 bp, Homo sapiens
actctggttactggggccgcgccgcgctggcgagagccgccgcccgcgagggatgctggtgaggaagccgtcgggagccgccgccgccatctgagggaggtaccctggaaaccaccttttatcggtggggaagtgcagtcgcggtgggcggctctgggggc

SEQ ID NO: 16570 - DNA, 469 bp, Homo sapiens
ctaatcgaaaaagagccgccgcccgcgaggatgctggtgaggaagccgtcgggagccgccgccgccatctgagggaggtaccctggaaaccaccttttatcggtggggaagtgcagtcgcggtgggcggctctgggggccagcgaaacgggaggcctctaaatctttaggttggggctgcattgccctggagccgcactcttgagtccgaggccatcttttgttggagaaggcgtcggcgttggcgttttcccgaggttgggctgtacagtgtctccgtccgcggaaaaagaagcctctgaacccgcgccggcccgcagcccccgtgccttccggccgctgctcgccgtcgccagaggctaggccacgtttcccccagtgccgaggtgtttctgtgaccctccctccactcccattcccttctgaaagggcacctgctcttggtgagaaaagaaattatagcacgaaga

SEQ ID NO: 16571 - DNA, 484 bp, Homo sapiens
acttttcctggctgtagagcgctttccccctggcgggtgagagtgcagagacgaaggtgcgagatgagcactatgttcgcggacactctcctcatcgtttttatctctgtgtgcacggctctgctcgcagagggtgagagcgggtatttctcagacgtttgatcagtccccgggaggaagggccccggggtcccctgtgccaccaggggaaagatcgcgagccttacttgcttgagaggctcatctactccacttcagggaatctctgggcaactcgtgaacaggagcaggaggggagtatggagtcgattgccgagttttctttggtctcaggcataacctgggtcctggtttacaggacagacaagtacaagagactgaaggcagaagtggaaaacagagtaaaaaattggaaaagaagaaggaaacaataacagagtcagctggtcgacaacagaaaaagaaaatagagagacaagaagag

SEQ ID NO: 16572 - DNA, 461 bp, Homo sapiens
taactagaaaaacagcagcatgaagtgtggattggagtacttaatggtggcacctgggcaaattattctaggcatgtctgcacagacctcaaatgatggaggagtttccctacacaagccctctctttgcctggtgccatccaagtaagacgtgagttacttctccttgccttccgccatgattttgaggcctccacagctacatggaactctgccatgtcatgggcagcactatggagcaatacacgtgacaagccttttgccaacaaccatgtgagctgctgagtctccttagaagagccaagaagccttctcagaagtggatctatactggctgtatagcatcctgccccgctactgtatgtcacaccacctcaaacagtcccttttgttggaatttaaattccagtttttcaaaataataactggcacaataaaaatagtgcaaattaaaaaaaaaa

SEQ ID NO: 16573 - DNA, 222 bp, Homo sapiens
gaacagaggaagaatctgttgtcagactaaattattctggttcaaaatgggctgttttttgagatttcagtggagaggaaaaaaagtgtttaagtattttcaagagaggtaacctcgctcggtgagccccgcccgcgatccacgctctctgggagctaggaggggcgcaggagccggggtctctgccctgcccgcctggcttccagatgtggtgcagcgcca

SEQ ID NO: 16574 - DNA, 495 bp, Homo sapiens
agctgggctctcaggcgctgccggagagagaaatgccccaggctctccggggcacacaaagcgcaggcgcasgggttgggtggcagcagcatcgagtagcggccgcttaggcagcaacatccgcaacaagtgtagacaaggtcccgcctgactccgctctggaaagtccttttgaagaaatggccctggtgaggggcggctggctgtggagacagagctccatcctccgccgctggaagaaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagaggccggagccgagatggcctgctgactgtgaacctacgggaaggcggccgcytgsacctctgtgcggagaccaaggatgatgccctagcatggaaagacagcactgctggag

SEQ ID NO: 16575 - DNA, 471 bp, Homo sapiens
aaaagcgcaggcgcasggggttgggtggcagcagcatcgagtagcggccgcttagsagcaacatccgcaacaagtgtagacaagctgtacattggaatcatctgaggatctttgaagagtatcagggcttgcctcctgccctcagacattctgatttaattgttacggagtgtggcctggtatcggaagttctcaaagctcctgccggcataacggtttgaagccaggactgctgggtcccgcctgactccgctctggaaagtccttttgaagaaatggccctggtgaggggcggctggctgtggagacagagctccatcctccggctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcag

SEQ ID NO: 16576 - DNA, 396 bp, Homo sapiens
actcagtccacagcattctctggtggcagacgctcaggaggagataataatccctgtgttcctgggcgagtcagtgccacccgagatgttggcggccactttggctgagctggacggatgcttgcagctgctcgaggacaagttcctgcgggaccaggccttccttactgggccccgtatctctgtggctggcttggtggcaatcacggagctgaggcatgagagtgccatggggtgcggtggcccgctgggcagtggtgtatccgggaagggagctgacatcccagctcatgttgtctttttctggctgtgggaccctgtgtgagtcacttctccttctgagcctcagtgtcctcatctataaaatggggctttacaaacccctcaccgcagcta

SEQ ID NO: 16577 - DNA, 403 bp, Homo sapiens
  misc_feature 396: n=a, g, c or t
actcagtccacagcattctctggtggcagacgctcaggaggagataataatccctgtgttcctgggcgagtcagtgccacccgagatgttggcggccactttggctgagctggacggatgcttgcagctgctcgaggacaagttcctgcgggaccaggccttccttactgggccccgtatctctgtggctggcttggtggcaatcacggagctgaggcatgagagtgccatggggtgcggtggcccgctgggcagtggtgtatccgggaagggagctgacatcccagctcatgttgtcttttctggctgtgggaccctgtgtgagtcacttctccttctgagcctcagtgtcctcatctataaaatggggctttacaaacccctcacgcacgatcnaaaaaaa

SEQ ID NO: 16578 - DNA, 458 bp, Homo sapiens
  misc_feature 356: n=a, g, c or t
aaacattatcctccttttcagaaggcaagctaaggttcagagaggctgtgatccctccaaggccactcagtccacagcattctctggtggcagacgctgcaggaggaggtgtcccaaactggtgggaacttgactggaaggctggggttaaggatgaactttctgccgtccagactgtcccctgcagagcagctgctgccagacagcgggagctcccacttcgtgcacaggatgggggcagggagcccgcagccgcggaggcaggaatgactgtccgggaacctcctttcttctccctgaatcccagccctggcatctcaccagggggcacagtgatggtccagggctgggcccgngactctagctgaatctttcagagtatcccatccctctggccagtggccaagcgagtgaaccagaatgcttccttgggagttttgaaactggaactggagaga

SEQ ID NO: 16579 - DNA, 508 bp, Homo sapiens
tttaggatcagatctgtgagcacgttggcgaggaaaaacaaaacaaacaaaaaaaagaaccttgtgtctgtctggtgaaaaaaagaaaaacaaattggaagagaggaccatgagaattttaataaaacagaaggaaactaatggaccttccaggatttattgtggacggatgtggatatattctgtacaggaacaacacatatggaagtggactgaagcctatgtagaaacacacacacactgaacattgttattcattttgtaaaatactagtctttattttcattttttgtaaaatttaaacatcgtatgcgcataaagaaaaaggaaacaagaattaggggaaaataacattttccaaataattataaaaaattgtcctgtgtctatgtatctatatctgttttgtatttttttctggttccaaaccagatttcctgtgattctatactaataatttttgatataaccctttgcttcttataatgagtgcgatatatgttgtcga

SEQ ID NO: 16580 - DNA, 342 bp, Homo sapiens
  misc_feature 319: n=a, g, c or t
gctatcctccactggttacccgggttccccggcttgctaccgggctgctccgtgcatctttccccccaggcgtcaggaactgcgccctcatggcggaggtgaaggtgaaggtgcagccgcctgacgcgatccggtcgaaatagaaaacaggattatagaattatgtcaccagttccctcatggaatcacagaccaagtaattcagaatgaaatgcctcatatagaagcccagcagcgggcagtagccatcaataggttgttgtctatgggtcagttggatctcttaaggagcaatacgggccttttatatagaataaangactctcagaatgctggtaaaat

SEQ ID NO: 16581 - DNA, 356 bp, Homo sapiens
  misc_feature 230..231: n=a, g, c or t
atatctcgtttctacttaaatgtagtgcttagggttaattttttgtactgaagtctttattggtgggtgcatgctactgggaacaagtttttgtacaaaagcttcaatcagaatcactgtgcattactgagactctgtttatcactagccttctgtccctcccgcagaagactgttggattgaacaaaataatatgtattttgatttacttaaagtgcttgtaaatttannagggacctgccacttttgactgtggatcagttgatgtacacttgtattattaaagcactcaataaatcactgtggctgaaaaaaaaaaaaaaaaaaaaaaaaaaaaaaaaaaaaaaaaaaaaaaw

SEQ ID NO: 16582 - DNA, 382 bp, Homo sapiens
tctctttaaagaatcagtatgtcagtatgttcaattctttgccttctacttgtaaacttaacttcctcataaagcaacctttttcrattacctgctccatcctgactcattccgatttcctgctctgccataaccatttttcccgccaaaccactcaccctgtcactctctttaaattagccagttggagttagtttggcctgtgtggtctaaccctagccaataggggaatgacacagcagcaggggccatgtgcatcagggataagaaccctttcccctcccttgtccaggtgtgcactcaaccattgctccatctgtaagggcgcacccttctgtagaagtacattgacttgctgagaattaaaaagaaaatttcaaaa

SEQ ID NO: 16583 - DNA, 488 bp, Homo sapiens
ggtattcctacaggaaatggataaccattttaactgtattttttgcagcccgtaccttcttgggaatacaattgtctaactttttatttttggtctggctgttgtggtgtgcaaaactccgtacattgctattttgccacactgcaacaccttacagatgtggaagatgtgaaatttgtcatcaattatgactaccctaactcctcagaggattatattcatcgaattggaagaactgctcgcagtaccaaaacaggcacagcatacactttctttacacctaataacataaagcaagtgagcgaccttatctctccttcgtgaagctaatcaagcaattaatcccaagttgcttcagttggtcgaagmagaggttcaggtcgttccaggggtagaggaggcatgaaggatgaccgtcgggacagatactctgcgggcaaaaggggtggatttaatacctttagagacagggraaattatgacagagg

SEQ ID NO: 16584 - DNA, 448 bp, Homo sapiens
attttcccatctttcttttcattccttgcgcaccggggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtagagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgcaaaaa

SEQ ID NO: 16585 - DNA, 447 bp, Homo sapiens
aaaaaaaagaagatgawttagtagagcatgaagaataatgaatgagttgctaggtaatttgccattccctctgcctggatgccttttcctccaattgccagttagttttaaggccaccctyctctgaaataacatagtactttgtacttgggtcatggtatttatcacagacttccttttattatagttaattctgtacatgtttaatctttcttacttgattctaaactctttaaggacagggtccacatcttatcttcatttccttcttcsagctcttaacaatctgtgatgttaagcatatttgaaaatagacattgttagagattatgtycttttagtgaaaaatcggccaggtgctgtaatcccagcactctgggaggttgaaacagarggattgcttgagcccaggagtttgagatcagcctgggtaacatggtgaaacct

SEQ ID NO: 16586 - DNA, 157 bp, Homo sapiens
  misc_feature 96,115,118: n=a, g, c or t
agaaaaaacttgtgcggggccatttttggggcagtaagatcgagcgaggagcccaagagckagcgcgcagcacgaagctcgagccgmctccgccgngcgaccccacctcggrcgncgncgsctgsgccgsgagatccgccccggvctccccgagagc

SEQ ID NO: 16587 - DNA, 365 bp, Homo sapiens
acaggcctctctggctccactacaataagcaagaagaaactgccatctctttgtacacctaattgtagaagtgatattccattacttttgccatgttctattagttagaagtgaatcactaggttcagcctacattcaagaggaagggatcacacaaagatctaggaggcagctactcctcacctcctgactacgacagccaagtccaggctgcagtatctcttgcctggactctgctgcaatagccttctatcaaggttcctgctcctgcttcccttccccagtgtattctacagccagccacagccatctcttagaagggtaagtccgccgtgcctctcctctgctcaaagcctactttgctg

SEQ ID NO: 16588 - DNA, 381 bp, Homo sapiens
aactaaatgatgtgctgtaaatatctttccaagttagtatatatagatctgccttaagttctttttaattgttttgtatggatgtgtcacaatttatataataatattccaccggataaaatttaaattgtttttattattttacaatgaataccacatatatttcttggacattagtgcaaacttttaaaagtataattcttagaaatgtattactggaaaaaagatctaggaggcagctactcctcacctcctgactacgacagccaagtccagsttgcagtatctcttgcctggactctgctgcaatagccttcwwcaaggttcctgctcctgcttcccttccccagtgaattctacagccagccacagccatctctt

SEQ ID NO: 16589 - DNA, 499 bp, Homo sapiens
taaagcagtggcaggagctgctgtctgatgacttcccacctcaagtccattttgtccctcacatctcttttactaagagttcttgaatctctttctctgcttttcctgaaaacaggccaaggttgagaccactggacttccatctgatttgagtgttctgcactgagatacagctgtggttagagctgctgtgggaagcacagccatcagttcctatggagcggcacccattcttgtggtagaagacttgcggcatccatgtgcctgctttgttatgctgttatggtccttgattctatgaaatagccaacatgaaattatgatcagttaaggtaacagaaatggggctttttcactgaaatagaaagaggattctagcagagtcagaaactgctggtgatttctgcaaatatggtagggaatagggaatatgtggctgtttcaagagcacaaattaaatgacagtactgcttccatgcagcgtgttgacagattgaga

SEQ ID NO: 16590 - DNA, 421 bp, Homo sapiens
gagttcagtgaccccctgctttcctctgcccctcccttcccaaggcattgaagctgaatgtgccaactggcagttagaagcgaaagatggcattgggagaaattttagagagctttcaaactctttattctcatgttccacatggtctaattttaacataaataatatgscttcacactggattgtaaaaggcatgtgatttttgagattttattttgtgatgtattgtcttctgcagtattaaagggaaagaggtattaatgtgcattaccctatcttgtttttgaagccagggtagttgtatgattttgttaccagcagtgctaacctgaatgtgacctggttaccttggaaatgcaggaacttatatgaatgtactataaaataaaatgcggactgattcccaaaaaaaaaaaaaaaa

SEQ ID NO: 16591 - DNA, 515 bp, Homo sapiens
acatttcccagaatgcagtgagggtagcgaccgggctacacagtagaaaccctatctctactaaaagtacaaaaattagccaggcatgggggtgggcacctgtattcccaactactctggaggctgaggcagaagaattgcttgaacccaggaggtggagattgcagtgagccggaatgcaccactgcactccagcctgggtgacagagcaagattccatctcaaaaaaaaccatactctgttaccattaggcaagagataatcataataaatgttccaatagccaaactctaggctccaaaaattataataaaattataaaaatggttcacaataacaaaaatgtaacacctaatgcattgtacaatctgaactgtataaagacaccgttaatttagtacataattgtcaaaccacttctataagttaggtttggcaaattgcaggagacaaagatggaattgacatagtttttgtctttaaggtgctcataatagaatatagataactattta

SEQ ID NO: 16592 - DNA, 506 bp, Homo sapiens
  misc_feature 22,387: n=a, g, c or t
atctttgttgggggcagccagnctggstcgagatgccgaagtcgtgcgcggcccggcagtgctgcaaccgctacagcagccgcagaagcagctcaccttccaccggtttccgttcagccgcccggagctgctgaaggaatgggtgctgaacatcggccggggcaacttcaagcccaagcagcacacggtcatctgctccgagcacttccggccagagtgcttcagcgcctttggaaaccgcaagaacctaaagcacaatgccgtgcccacggtgttcgcctttcaggaccccacacagcaggtgagggagaacacagaccctgccagtgagagaggaaatgccagctcttctcagaaagaaaaggtcctccctgaggcgggggccgnagaggacagtcctgggagaaacatggacactgcacttgaagagcttcagttgcccccaaatgccgamsacgtaaaacaggtctcgccacggaggccgcaagcaacagaggctgttggcc

SEQ ID NO: 16593 - DNA, 187 bp, Homo sapiens
tatttataaagatctggcctgttcctgcgtctgcggasggcccttgtctcccagctatctataaccttagctagagtgtcgccttgtgggttcctgttgctgagacttcctggatggagccgccctcaccgccgggcccgtggctgcgcggastgtgtccaataaagttcttggatgtgaaaaaaaa

SEQ ID NO: 16594 - DNA, 106 bp, Homo sapiens
tcakggctskttactggatgkktatttataaagatctggcctgttcctgcgtctgcggagcggcccttgtctcccagctatctataaccttagctagagtgtcgcc

SEQ ID NO: 16595 - DNA, 510 bp, Homo sapiens
attctattcttagttttccatgtcacctcattggaagagacgggaagaatgtgaaaataatgggattgcagacatctggaagaattttactctaaccatgaaggattcaaagcaagtgtttccattagaaaacactacatgaacaccaacacaaaaagattacaggtgtgagccatggcaccccacaaatgcatgtacatgttttaaatgcagatacctgattcctttccacatccacacccctactccaagacctacaggaataatctccagagatggaacccaggcatatgtacttttaacaaaattgctttgtgattccaatttataccaaagtttaagaatcagtggacaccactgccctgttgctccagaaattgttttcttaggagtgataatgattcaaaagcttctgactagttttctctctttccctcccaaatcatgcctgacacttgtgccacctgattctttgtgacgggagattttttaagatagatgtggtatgga

SEQ ID NO: 16596 - DNA, 422 bp, Homo sapiens
caggctattgttagaattaaatgcgtttgcgagtgaggaatagatttaagagttatttcaattcagaccgtggaacatctcttcacaaaatgggttagtttggattggcagtatacttttaaatctgccttcgatcactcagaatttgtccagtctgtatttattaacatcagtttgtttatttattcagtaaatattgaatgcctgttctgtgtaggtcattgtcttggcagttattttgagctcttgctacctgctgaattatatcttaaaatgaagraatttacatgatagagtgatatttawtcatcygtgcygaagattaaagtgagaagtatgtggcargcgcggtggctcacgcttgtgatcccagcactttgggargccgargtgggcggatcatgaggtcaggggatcgagac

SEQ ID NO: 16597 - DNA, 574 bp, Homo sapiens
aattttctcttgctgctaccatggaagaagcgactttcgcctcccgccgtgattctgaggcctttccagccatgtcaaactcaaaatgtgactgaaaaacagaagcatttggaatacgtaacagaagtcattaaaaagaggagatgtcccagtttcttaattcacggaataaaaaaaatcaagccatcttattctgtcatgatacccttatcttctttcagccgtattacaagtgtttccacatattccaaatccccatggggtgaaggaataaaagaagaaagtcactccatatatttcaggcttctccttttgttgaagaacagtttgtcttgattaaatcagcagtctactgatttggtcatcttctccaatgttgcctgccaacaatgcactattttcacttttgctaaagtaatagttctaagaatgagaaatttagacagctctgtcagaagagatcactgtccattaagtggaagtggtggacaaggggagaaacagttggtgttttcaagtaagagtaccagaaaggcagaaaggagagacctacttaaataaagaagaagaagaa

SEQ ID NO: 16598 - DNA, 355 bp, Homo sapiens
ataaagtacctggcggactatttctggaggttacagttttgttattaaaaaaaaatacacaaataatgggtctggaagaggaagcataataaatttgaggactcagaagtgatgctaaatttggacatttgaagaaggggcacaggaaagcaattcaaaggcacttgagttatcaacgtgcacagaggaaattaagtaggaggcatgttggaaaggcacccactgatatcgacctggatggaagcccctgaagtcgcagttcctccacagcatgggctttgaactcctgcgcttgggtctggcttccacaaagatgaactcagaatggaaaaattaaaaaaaaaaaaaaaaaaaa

SEQ ID NO: 16599 - DNA, 404 bp, Homo sapiens
tctctcggcatccacctccttcccctcctcctgctcattcactctttccctcactttctcccctcctcctcggcttctrccccgcgccccgccagccctcgcgctctcccactccctctgcctgtsctccccggtcccctcctcccgctcattccactcgcccctctcccttctccactctctcmccctgtctcctttcttcttcttctttcaccctccgtctctcasaccccctccattcccctgtctcctttctgacactgcactgcagctgctcctcagccctgccccctccccagtgagaacaaaccagcaacattgctttttttcctaaagagatttatattgatccgattaaaaaaaaaaaaccttaagaaaccccaaacrcaaaaagaaaaaaaaaa

SEQ ID NO: 16600 - DNA, 442 bp, Homo sapiens
gatccggacccggagccagcgcggasacctgcgcccgcggctgacaccttcgctcgcagtttgttcgcagtttactcgcacaccagtttycccccaccgcgctttggattagtgtgatctcagctcaaggcaaaggtgggatatcatggcatctatctgggttggacaccgaggaacagtaagagattatccagactttagcccatcagtggatgctgaagctattcagaaagcaatcagaggaattggaactgatgagaaaatgctcatcagcattctgactgagaggtcaaatgcacagcggcactgattgttaaggaatatcaagcagcatatggaaaggagctgaaagatgacttgaagggtgatctctctggccactttgagcatctcatggtggccctagtgactccaccagcagtctttgatgcaaagcagctaa

SEQ ID NO: 16601 - DNA, 487 bp, Homo sapiens
acctgagcggcgcatcctcagggcctgggcctggcctccttgcctgtgagatggcactgtgacggtgcccacctcgtggggtgtgtgagggccgagtgaaatcgtgcatttgcggaaatgcccatgaccttcatcgcagcagcgtatgtgcgttggtcttctccagggatgccgaaagtagacatacagggagtcgcagtacggataccaccagtgccagcctgacctcacaagagacgtcttgtgtgactggccctgccgtcacagctgggccagtaaagtaccttccaggaggctccagttgctacctgactcacaaccttctaatcccatgatcttttagttctagtttccttatcttgtctgagcaaatggctcattttaaagatgacttgcagacaaatgtagagatcatcccaggggaaagtgccccaagaaaggagagtccaagaccacctgcccctcccagttctgcggctggagtggg

SEQ ID NO: 16602 - DNA, 275 bp, Homo sapiens
ccatccaaaatggtgtttaatctttattttggctgcaacttaaatgctttgacaccgcagcacctccttcctcttgggcytgattcatcaggtgctcctggaaacaggtaatcctgcagcttcacaccagccctgtcagtgaggctgtggccatcagaggtaaagaactcctccttctgggtccttccaaaatcaccttgactttctctctttacattgaaacctagtacaagaccataaaaatgtgtcctgtaattttctctctctcttttttt

SEQ ID NO: 16603 - DNA, 343 bp, Homo sapiens
agccgactcttactcctcctccccgcaatcgtcgggtggttagttgcacagcctcgcgcatgggcacttttgttatttttcattatgtagtctgcagctgctggaggaaagacaagaaaaaaaaagaagggacaaaacgattaaagttttggggtgaaaactccagatcctttaatgatttttcctctcgaatcgcaaaccagccagggcgtgaactgagggcggtgagggggtacgggcatctccctgcatgcaacgcggtttttgtataaactacaaatcccagcatgccactctctctctctctctttttttttttttttttttttttttaaaaaaaaaa

SEQ ID NO: 16604 - DNA, 468 bp, Homo sapiens
aacatargactgtttagggagacacagttcagttttcatagcagtcatggtagatggttgcctgttcatttgtttccaaatagacttaagtttcttaatcttaaattccttcattggggcttggagacctagatacaaacaccattaattttgtgaagaagttatctctggsytactcccttcaaaggcattattattatgaaaccaagggttgaccatttctccaactgtcgtcccgaagaacaaaccctgattttcagccattaccctagacagtgccagcttaaacctgattatgtaaagagacacatcagcactgtcttgtagcactttctgtgctgatatacacggcctataaaatggtttatgaaatctgcactgtctaatacagttgccattagctacattcagctattaagcacttgacacttgaccactgtgactgaggaattgtattttttattttat

SEQ ID NO: 16605 - DNA, 244 bp, Homo sapiens
gtaatagagcttcgacggccgccattttctttctttcttagctgttagctgakbaggaagtctctgaacaggcggcagcggctcttatagtgcaaccatggcagactattcaacagtgcctcccccctcttctggctcagctggtggcggtggtggcggcggtggtggtggaggagttaacgacgctttcaaagatgcactgcagagagcccggcagattgcagcaaaaaaaaaaaaaaaaggc

SEQ ID NO: 16606 - DNA, 399 bp, Homo sapiens
atatacctgggcccagctcacaaccacaatgatgactctcttacctggacacagacagtgggagatattttgacttttgtagccaggcttaggccataggtggtttggtgactctcgaaccatgattcggcagacctgtgaggctgtgagttccctattggaacacaatctgcaggttgtattgtgccatatacctgggaccaaattacaagcacaatgatgaattttttacctggagtcaagacatgtgcaggatggtggaacttatcactggacctttccacagtgttattatgacatataactttgtccaacatgtgagtaatttgactctccagatggcccagttcacaaataaaattggacagatacctgggccaagawaaaaaaaaaaaaaaw

SEQ ID NO: 16607 - DNA, 352 bp, Homo sapiens
gaggcgaggcggggagcgcaascggcggccactgccacgtattcccggcagtggtggcggcggcggcggcggcgccgcgrgcaggaataactcaagtcacctgtactggaaatcagtttgctgaaattaatcaacgattcttgaagttgaagaaaaggaggttccagccttggcaagaggagtgtggcccttcctggaatccctctggacacaccctcctagcatcctctaggaaagatgcggcagctcaaagggaagcccaagaaggagacctccaaggacaagaaggagcggaagcaagccatgcaggaggcccggcagcagatcactacagtggtgctgcccaygctgg

SEQ ID NO: 16608 - DNA, 348 bp, Homo sapiens
atttgggctgtgttctcgctgcgaggaggaagccaggttacctctgttggacctgcctgctcccagcatctccagcaacaagctgtctctgccggaataactcaagtcacctgtactggaaatcagtttgctgaaattaatcaacgattcttgaagttgaagaaaaggaggttccagccttggcaagaggagtgtggcccttcctggaatccctctggacacaccctcctagcatcctctaggaaagatgcggcagctcaaagggaagcccaagaaggagacctccaaggacaagaaggagcggaagctaagccatgcaggatggcccggcagcagatcactacagtg

SEQ ID NO: 16609 - DNA, 377 bp, Homo sapiens
gaggcgaggcggggagcgcaascggcggccactgccacgtattcccggcagtggtggcggcggcggcggcggcgccgcgagcaggaataactcaagtcacctgtactggaaatcagtttgctgaaattaatcaacgattcttgaagttgaagaaaagttgttctctctacaggaggttccagccttggcaagaggagtgtggcccttcctggaatccctctggacacaccctcctagcatcctctaggaaagatgcggcagctcaaagggaagcccaagaaggagacctccaaggacaagaaggagcggaagcaagccatgcaggaggcccggcagcagatcactacagtggtgctgcccaygctggssgtkttcgt

SEQ ID NO: 16610 - DNA, 224 bp, Homo sapiens
ctctcctctctcctttctcttggaccctttgctctggggaaaccagctgctacatcaccatcagccttgtgaccatgccacatggtgttccacagacatcctacatgcatgacattgattcactcttacatttgacaggattgcaggagctcctcagacaagatctgtggcaacagtaacaataaaagcatcccatgcggaccaaactcctgctgcaaaaaaaa

SEQ ID NO: 16611 - DNA, 276 bp, Homo sapiens
ctctcctctctcctttctcttggaccctttgctctggggaaaccagctgctacatcaccatcagccttgtgaccatgccacatggtgttccacagacatcctacatgcatgacattgattcactcttacatttgacaggattgcaggagctcctcagacaagatctgtggcaacagtaacaataaaagcatcccatgcggaccaaactcctgctgcaaaaaaaaaaaaaaaaaadaaaaaaaaaaaaaaaaaaaaaaaaaaaaaaaaaaaaaaaar

SEQ ID NO: 16612 - DNA, 440 bp, Homo sapiens
tacttctgtcccaggtcacccaaacattgacctgtgtcggttccccactaggaacaaaatgtaactgaggacgttgtcagatgcttgtcctcgtcaccctgagcttgttggctgctatctaattcttattctttcattttcttgcccgcacgttcttgatagcagatcactgacaacagccattggaagcttaggaaaagggtatgtgccgggcgcggtggctcacacctgtgatcccagcactttgggaggctgaggtgggcggatcacgaggtcaggagatcgagaccatcctggctggcacggtgaaacgtctctactagaactacaaaagttggccgggtgtggtggcggtcgctgtagtccagctactcgggaggctgaggcaggagagtgacgtgaacccgggaggtagagcttgcagtgagcagagatcatgc

SEQ ID NO: 16613 - DNA, 467 bp, Homo sapiens
caaacaaaaaacccgtatgttgacagtgcactaaaggggtaagcctggaaaagtggagaggattttacagaaaggggaatcttttttattattttaatatattttttaaagccagtcaaatggagcagtagggggttgtatactgacaccgagaaggggagtcttgggttgggtcttgaaatcaatgttagttctccttcaagacagggttacactaacataattttagattcttatcccaagtctgccttacttgattctaggtgactggagttgcagcttagtaggtgggctctagaaatgtgatcatttggccaaggttggaagasgtagtggagctgctgtgattattttgkcgttctttcttcgatatgatagcagatgagctgtaaagatgcttgtgtaatgtaacactttattatgcaatagccagtttaagaaattagagaattttagatgttagtaat

SEQ ID NO: 16614 - DNA, 523 bp, Homo sapiens
actaatcaacaaaccagctttcggggtctgacgcgatccttgcctcaggcctctcgaggtccagacagccgcccagcccgctctgcgacgcagcagtgaatagtgtggtacctccttgtctcggttcaggtccagacctccccgtcttccggctgccctgaacgtcaggcgacctcaggaccctgtgattggcgcctgcgcggcggaccgtgaccgaggaaacccctggaggacttgggcattccttgggctccgtgcctgttcttcgtgctcctttcggtaaaggcaaggatctcacattatcagtctttgaccgacacagaatgcctggcatttgataaatgttgtgttgaacttgaagagacatatggacaatgaatctgcaaagctcaggcccagaatcagcagcagacagaaggtgtaaaaactgaagagagtgaacctcttccctcgtgccctgggtcactcctctccctgatgactcatgcstttagattgtaagaatccaatgcacattccagat

SEQ ID NO: 16615 - DNA, 493 bp, Homo sapiens
aagaagcgcttccggcggtcttagatcactaatcaacaaaccagctttcggggtctgacgcgatccttgcctcaggcctctcgaggtccagacagccgcccagcccgctctgcgacgcagcagtgaatagtgtggtacctccttgtctcggttcaggtccagacctccccgtcttccggctgccctgaacgtcaggccacctcaggaccctgtgattggcgcctgcgcggcggaccgtgaccgaggaaacccctggaggacttgggcattccttgggctccgtgcctgttcttcgtgctcctttcgggcaaggatctcacattatcagtctttgaccgacacagaatgcctggcatttgataaatgtttgttgaacttgaagagacatatggacaatgaatctgcaaagacctcttcttttcttattccaaaatgttgagatactggggagagataccaatatcatcaagccagaccaacagaagttccttcg

SEQ ID NO: 16616 - DNA, 434 bp, Homo sapiens
caaagttgcctctttaaaaaacatgtattgttctagatttatattataatagcatgtgtgtatgtgtgtatatattccaatgcaacgtgtaagtaaacaaagatggcgtatcatagataatcagaacttgtggtagcactgaattattttattgggtatgcagaagctgtaagcaaataatatagttaaagggtagcttatacatttatacagtaaaataatgttctgaaactagaataagttagaaagtaagggaagggccaggcgcagtggctcacttctgtaatcccagcactttggtgggccgaggtgggcagattgcttgaggccgggagttcgagaccagcatggccaacatggcgaaaccccatctctactgaaaatacaaaaattagccaggcatggtggcatgtgcctgtggtcccagctactcc

SEQ ID NO: 16617 - DNA, 298 bp, Homo sapiens
aagaaaccattgtgtggcagggaaggaggtggctcttggcccaggcctaaaccaggaaagcctgggaaactgggacccacaggtgggcatgaaagggccgcagcaggggctcccagcagtgtgtaagaccgggagctggtctggcaccactgccctggtccttccagctgcctgtcactggtatgatggccccggtgcattgtgccaccagcaggccacagctgtggatcttggaaggcctctggggtcccccgggagcaggggagtgggtgtgggggggaacggatggtggtgagag

SEQ ID NO: 16618 - DNA, 469 bp, Homo sapiens
aatctagaatgtcactgttcaagttaaagatggtcaagggaatcaaggctcatacttcataaattcttataagtcatttccctgtgttttgattcctcctaggaatcccacatacaccattaaatgtattggtaaagtccgaaaatcacactatttatctttccttaagatcttttcttgccttttcaacattccttctaaagttgaggctacagctacaggtcacgagaatggaatattggcatgagtatgtgccaatgtaaaacgatgaaatggtaaagcctgaaaccaagatggaaaaatctctgtattacttttttctaaaatctaaaaattatctttcacattactctttgctatgcagttaaacaaaaaaaactttgaactctgtgctttatttttatgtgacatcaacgtgctgcattattctgccttaatatttccttttttttttttttaaaamaaattc

SEQ ID NO: 16619 - DNA, 452 bp, Homo sapiens
cttgttctctctcccgctctcggaagctttcgtctcgtgggtgcgaaaggtaaccgaagcggctcaggaaggcagctgtcactgagcccctggaacagagcgagagtatcgtagtgggcagcagtcagtgacaggtgtaactctgtggatgacagcaacagttactggaggatacgggggaagagtgccacagtgtgttagaggggaaccccatcaagtgtggccagcccatccggctgacacatgtcaacactggccgaaacctccatagtcaccacttcacttcacctctttctggaaaccaggaagtgagtgcttttggtgaggaaggtgaaggtgattatctggatgactggacagtgctctgtaaatggamcctactgggtgaragatggtgaggygcggttcaaacastcttccactgaggtactgctgtctgtcacaggagaaca

SEQ ID NO: 16620 - DNA, 529 bp, Homo sapiens
attttcttgttctctctcccgctctcggaagctttcgtctcgtgggtgcgaaaggtaaccgaagcggctcaggaaggcagctgtcactgagcccctggaacagagcgagagtatcgtagtgggcagcagtcagtgacaggtgtaactctgtggatgacagcaacagttactggaggatacgggggaagagtgccacagtgtgtgagaggggaaccccatcaagtgtggccagcccatccggctgacacatgtcaacactggccgaaacctccatagtcaccacttcacttcacctctttctggaaaccaggaagtgagtgcttttggagaacaatatggtcgacctatcagtgggcaaaaagaggtgcatggcatggcccagccaagtcagaacaactactggaaagccatggaaggcatcttcatgaagcccagtgagttgttgaaggcagaagcccaccatgcagagctgtgaatctagaggctctgagccactgttaacgcacatgttcacagacatctgttgctg

SEQ ID NO: 16621 - DNA, 491 bp, Homo sapiens
aaagaacagaggcaagcctccagccaggagctcatgaaatcatgaactgaggcctcagtgcaatagctcatgaggaaatgaattatttcaacagccagttctggaagttggaagtacaagatcagattgccagcatcatcaggtactcatgagggccgtcttccagcttgcagactgccaacttctcattgtgtcctcaggtgagtaaaaagtgatgacgctgcaaatgacaaccttaactagtctctccattgaaaagcctcataaatgtctaatagccacaattttacttggctacttcagatggactgaaattggaacttgaagacccttgtataagaaaaagaaccgttgtaaaccattgcaaatctcagccaagacaaaatggcctttaaacatttacaataaatgcactgaatatctgtggaatcacataactcaaaaataagaacagacatatttttctataactttgatatcattttgtaagc

SEQ ID NO: 16622 - DNA, 431 bp, Homo sapiens
atcacttgattattaagttagtatgtttaaggatgttgactgctgcctttctgggggagaatacagttgggatttataaaagcttgcttgaatgaaactgcctcttaagtgattgttaataatgaatggctccagttgacttctaatataccttctgcaattagcatggtggattttacaataggaaaaataggactattgagtattaatggtaacagatttttttaattttaatttttattttttgaagccctgtctctactgaaaatacaaaaattagcctagcatggtggcgtgtacctataatcccagctactcaggaggctgaggcaggagaattgcttgaacctgggaggcggaggttgcagtgagctgagatcgtgccaccgcactccagcctgggtgacagagcaagactgcatttcaaaaaa

SEQ ID NO: 16623 - DNA, 60 bp, Homo sapiens
agcgcaaagatgtccgcgcccgctgccgggagsgaggtgagtctttgatcgtaaccacca

SEQ ID NO: 16624 - DNA, 458 bp, Homo sapiens
  misc_feature 430: n=a, g, c or t
atgcattttgatgtgaaagatgttataataatttctagaagacaatttggtgtatcacaacatgcatgtctatttttttttagttttaagtcctataggactatgagtctctaagttatttgtttcagaaaattattctttttttatgtgataaatcatatgatttaagtgcatgaataagcattttcccacacaatgaacatttgaactgtgtttatgaaaattttctggtttgcaccatgaatttgtcaaatggatatttataggaatatattcactactttgtatactttgcaaatttgtctctctggctttacccaagttctgaatgcattgtaattaaaatttaagtttttcttttcccccattagtaaacatttagtgctacatatgataactgcccaatatttattctatttacttagctaanctatttgcattcttgtaaccttctatgg

SEQ ID NO: 16625 - DNA, 488 bp, Homo sapiens
acattgtgtaatttgtaaagattcacgtgtagttctttattatagtgattttgggctttgtacccactgaatgccattttttgtgtttttaaattattttctttatcttgttacaaaaactgagatgtggggttttttttttttcagttcacttatcattagaatgtctgaacttttatgtaacatttttgtgtgcatctctcaatgctaacaccacatgtttgcctatgacaagtttatagagtgaaaggtatcttctgggttgaaataattcacaaattggtgaatgtcatcttgcaacacaccctgtacagtcttccttaaaggaacactacagtatatttttagtatctacatgctgaatgactgaatacagacctaggcacagcagtggtcctggtacagtatttaagtgtcggcatacacaggcgtaatccctgtataaagtagtgccaaactgatttcagttgtgtamtagtttaaaaccc

SEQ ID NO: 16626 - DNA, 473 bp, Homo sapiens
aaaaagaacagaggcaagcctccagccaggagctcatgaaatcatgaactgaggcctcagtgcaatagctcatgaggaaatgaattatttcaacagccagggttgctctgaagactaaagccctgggatcattcattttaaaagaaaagaacggtgactcatcatttcaagcttttcaaatatgaagtattacagtaaaaaggatttcactaaaaaaaatcatctaccatacagacactatagaaggcttggaaaagacattgtaatataaaagatatattttaaattgtgtctatccctggaactctattaaaattcaatattaagaaagtcacaaaggagtctaacttgcctttcaaattctggaagttggaagtacaagatcagattgccagcatcatcagaggaaaatttggctcgtggtgatagtcttggatatcaccttcatcccctcggatgtttgtagataatcc

SEQ ID NO: 16627 - DNA, 490 bp, Homo sapiens
attaaatcctgtgcttctgtggagggagagcgaaggaagagtgtggacagtgggggccaggaagttctcaggtagcccagcaggccacgcagaagtcaaggggtgtgtaggtacaggaggggccgtctccacagggagacgcctggatccatactccatccaggcttcatctgcagagaccaggggtggacacctcgtttgtgggggccgtcacagctgatgccccagctcaggatgtccaccagaaaccaggagtcaccatcctcttaagggtggtgcctgtcctccagagagcatatcactgggttcaaaccccagctcctaccggcaaagccggggcctccacctgggtgttcccatccatgaagcggggatacacagtgtggagcccttgggaggttggggagtgtgcctgccctcaccgcgcatcagctcataaatacaacaacagttgccttcacgtgctgatgctcagtgagcaggtggcgca

SEQ ID NO: 16628 - DNA, 334 bp, Homo sapiens
acaattccctgagctctcaactccaagttgtagatttggtgtcttccttgttcttactttaaaaagtcatgtgttaatttkkkkkttctgcctgtatttgtatgcaaaatgtcctctatctgctattaaagaaaagctacgtaaaacactacattgtaaccttctaagtaataataaataaaaagaaatatattgcagtaacaatgggaagtaagtatgtagttcttttgaaatatgtggtaaagaaataatcacagactatcatctaatctggttacatattgtatttttcatcctgaataaaagtaattttaacacaaaaaaaaaaaaaaaa

SEQ ID NO: 16629 - DNA, 325 bp, Homo sapiens
attcctgaagctgacagcattcgggccgagatgtctcgctccgtggccttagctgtgctcgcgctactctctctttctkggcctgrrggctatccagcgtgagtvtctcctaccctcccgctctggtccttcctctcccgctctgcaccctctgtggccctcgctgtgctctctcgctccgtgacttcccttctccaagttctccttggtggcccgccgtggggctagtccagggctggatctcggggaagcggcggggtggcctgggawkggggaaaggggtgcgcacccgggacgcgcgctacttgcccctttcggcggggag

SEQ ID NO: 16630 - DNA, 381 bp, Homo sapiens
gtaggtaaagattccagcatcttggaagcaagtgctccactggaaaataaaagccacgtggagcacttgattagactccagaaacagaaactgcagctgctcccaccacccccaccaccacaggccctgccckrggcacagccaaccacacaagtgcaagtgcagccgtcacccgcctaccacagcagagcccccagctcaccacagtcacggccccgagacacagagccctgttgatgggcaccaccatggccaacctccagactcgagtttccacctcccacctgcaagcccaagactgacgtcagcgctgacgtaccagatggcccaggttgctgtggccasgccccctgtggtgtctgtcctggcagttgtggtgct

SEQ ID NO: 16631 - DNA, 340 bp, Homo sapiens
gtaggtaaagattccagcatcttggaagcaagtgctccactggaaaataaaagccacgtgtctttttaaaagcatgagtgaagaaagacataaacttccggatttgcgtaagtgagcttgccaactaaggaaacacatgagtattatctgtatcttcaggagcacttgattagactccagaaacagaaacygcagcygctcccaccacccccaccaccacaggccctgcccggggcacagccaaccacacaagtgcaagtgcagccgtcacccgcctaccacagcagagcccccagctcaccacagtcasggccccgagacccagagccctgttgatggg

SEQ ID NO: 16632 - DNA, 239 bp, Homo sapiens
tgggtattgatcatgtccaacctgctggagccccttcacatggtggatgatgccccatgaccctgtagaaattgaatcctgctcacaacattgttggccttcttactaaccttggaccgtgattgagcccaagaaaccagggacttacgcatttggccaatgtcaaaagaacagaactttgcccactgcacaaaaaaaaaaaaaaaaaaaaaaaaaaaaaaaaaaaaaaaaaaaaaaaa

SEQ ID NO: 16633 - DNA, 433 bp, Homo sapiens
aagtcggcaagcccagattctagtggcaagttcacagactccatctcttggtgggggtgtggcaaagccacattacagaagagcaaatggaatggaaaatgtctgcgagaaagtgaccaattctgtatcctccgagctgcaaccttatttccagactctgscagtwatkgacccaaaatagattcygtgggccctggaatcamctatggyctggtggcacctccagcaaccacggctgagaccctggatgtacagatgaagtgatggagtttcccgctgcccatgaccgcatggtatacctgggcctctcagactacttcttcaacacagccgggcttgtataccaagaggctggggtcttgaagatgacccttagagatgacatgattccaaaggagtccaaatttcgactgacaaccaagttctttggaac

SEQ ID NO: 16634 - DNA, 182 bp, Homo sapiens
aatcaggcgcgggctgagctctacgaggcggacggggcggtggcgacggcgatgggaccccagctagagatctgcagctaggctggctgcacttgctccacgggtcaggggatcggagggggattgaagaatgcgccattaaaaggaaagatcaaggagtaaaccaaaaaaaaaaaaaaaaa

SEQ ID NO: 16635 - DNA, 399 bp, Homo sapiens
attagacttaactagggttgtaatcttgccaagtgagtacgaacaattgatgagggcagaggaagttggggtaaaaggaaaggagtgattgtaataactgattatagaatttacattgggcaaggaaggcagacagacatcatggggatgaaggacagagaaaattagtagatcatcagactgtaggtcctcctgcagtggtttacagattctgggtgtagtgtagtataagagatcttgagtgagctggaaagtggaagggtgcatgaaatcaagattatggagggtttgtggtaattggtaatgacagagaccaggctagatctcatgagagtgagaggccaagatgaggagttcaaagaactgtgaggccaaggtgttggaaggatctttgaaggc

SEQ ID NO: 16636 - DNA, 460 bp, Homo sapiens
atttcccatctttcttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtaggagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgkcaataaacttatgacgttaaaaaaaaaaaaaaaa

SEQ ID NO: 16637 - DNA, 443 bp, Homo sapiens
aaacttaaggaagaagtctctcctgaagtcacgagctgcattgtctggggttcgggtagctgtgaasaagcactcccttggccactccagctggtgtctcactagccttgccagcgccttatgatttctgacttttgaagaatagctactctgactaagagatgagtaaaaggaaatccaaagtggaggtctcagtttcattggtgtgtttgttgcctacattcacatatgtttaatggcaaaccaagtctagacagaaggctttctcaagacagcagaaatttatttatcatgattttggaggccagaagcccaacatcaggatgccatatggtcaggtcttcatgaggactttcttcctggcttgcaggtgacaccttcatcctgtatcctcacatggcagagaagtacaatatcctcactgaatcaggtctttgagttct

SEQ ID NO: 16638 - DNA, 480 bp, Homo sapiens
tgtgttgcagccctgtgcattgggggtgggatgggaatagcaatgtgtgttcagagagaatgaattgcttaaactttgaacaacctcaatttctttttaaactaataaagtactaggttgcaatatgtgaaatcagaggaccaaagtacagatggaaaccatttcctacatcacaaaaacccaagtttacagcttgtactttactttaatgtgtaatactcaactcaaggtacaagacaattgcatttaacattgttataaataaaaggaacatcagatcaatcattaagggctccagagtgaacagcatcttcataacttccatgtttatcatctttactttctggatgtaatttaataagatcatcaattcgaagaatggtgattgcagcttctgttgaaaatttcaaactcttaactttaactatggttggttcaaacacccctgcttgtttgttgtctcgaggtttacattgctca

SEQ ID NO: 16639 - DNA, 367 bp, Homo sapiens
attttagaaaatgtgaatctgcctgccattcttggaagtaacctctgtgactggaagatggaagaactgccccaggctcaggtgttgactttgaagaggggcttgagcagagagaatgcttagaggctaagcgatgggcaagtgagagggaaagagccgcgacagatagagctggctgcctaggggtctcagaggcttcatcctgcaggcggcaggcggcaggacaaagggaccttcggactccagatcaagattccaaggagttaaacgctaccacgcagcccgacctggatgggatttgctcctgggtacaaaacgggacactgatcaaaatcaacttggacaagtgacaaaaaaaaaaaaaaaa

SEQ ID NO: 16640 - DNA, 392 bp, Homo sapiens
tgtgtaactgttgaatctggaaattgatcagcattaaagggcacatgaagcagtgtctgcaggcgttcagtgctgcggasctgttaaaggtcactcagatgtgcaggtgttaatcttctctaaaagcctggtgatacagctctggctttctgagcacactacggatctggaaaatactaggaaaatgtgatacttagaatactttggctgctaaggaaacttcctctccattgcagaatagctgagccaagtgagtgagtttgcagaaagcaggtggtgagctcctgcctgctggaggttgccatggagggccattcctgcccggcaacagcaccgtcctgcagggagcmasttggcagaaagggtgcagggctgctggtgtcagagcaaga

SEQ ID NO: 16641 - DNA, 482 bp, Homo sapiens
aaaaagatcctggtcccttggattctgaagcggaaggagagctgtctcctccagctggtggaaactgcttcctatcctcctcctggagagcccaactcccagagcagatggcagaggagacctttagatggggcggtcacatgtcccagctggccttataacaactgtcccagggaactattaatagatctaccttacacacatctggactttcagatctgaaacgccctggtttggatgacagattatatggtgaacctacttttagagtgtagttcaactcatttgtcacatggatgagaaaatcagtccataaagggtttgctggggccaacaccagcctaagtggagagtaagcgtccattctcctagaccggcacttaaagcctggctgtcacccagccatcccgtctctgtgctggatkgacaccaaaccccaaggccctcatctgcctttgtcccaactactrtccagtgcttca

SEQ ID NO: 16642 - DNA, 464 bp, Homo sapiens
ataaaaaaaataagccaagtatagaaggacaaatactgcatgatgtcatttgaatgtggaatctaggagctgaactcacagaagcagagagtacgatggtggctaggggtaaggggtcaggagtacagactgaagagatgttggtcaaaagatacaaaatttcagttagatgtgaagaataagttcaagagatctattgtacaacatagtgactatagttaataacaatgtattataatcctgaaaattgcccagagtagattttaagtattttcaccacaaaaatgataaatatgtgaggttatacatatgttaattagcttgagttagtcatttcacaatgtatacatattttataatgtcgtatatgataaatatatacaatttttatttatcaatttaaaaaagaaaaaatattctgtctttttaaaccataattaatcagcttctctttcttctgagat

SEQ ID NO: 16643 - DNA, 135 bp, Homo sapiens
aacccactaggggatgagcccgaactagggatgtgacagagcgcgagacccagcctaaagagagcccggagccagcgtgggaggccgctgccgtcgcgcgccttggtttttctgttccttttttttttttttttt

SEQ ID NO: 16644 - DNA, 348 bp, Homo sapiens
  misc_feature 237: n=a, g, c or t
atgagatgtaaaagtgggtgggagagggcgtggcaggagagccagggaatggattgagagtgggttcccagtggaggggtgcatatgcagagtcctaaatgtgatcaggagcgggagagtaggggtaggagaggaaaagagtcaccaatgatgaaacgggagaggaaagtggcaattttagatgaattaaatgcttttcaccagagaacaaccccctttgactgtaattgtccactncccacccaaatcctataaaacagccccacccctgtctcccttcactgactcctttttcagactcagcctgcctgcacccaggtgaaataaacagccttgttgctcacaaaa

SEQ ID NO: 16645 - DNA, 414 bp, Homo sapiens
gctatgtagcaagaaatgagatggtagagactgagtatagatggttccttgcagaatcgcttatgactggaaggggcacacagtgggggaagaagcagaataaagagtagtttgtagtattttcatttttaggctgcaasttgagcatgtttagaagctaaaaggaagagctaggtgaaagggggaaactgaggtgtggagagaagcagattcaatacccaatagagccaggtctgcagtagatgggaagatgggtctggagaagaggggacaggacgaaccaaggaccagaggggtgtggaagcctcaagacaagaggaatcacagagaagacagatgcacaatattcacacctgtgtatgctccgggagttgctttgcttctcgtgcagtttgttaaattaggtgaatttca

SEQ ID NO: 16646 - DNA, 488 bp, Homo sapiens
ctttatgatgtgatctctccttaccttcttagtgcatcttccattaccttcctttcccaaccccttactttgtactccacccattctaaaatcactcgagaatcggtcttgtacttttttttcctctggattcctacccagatatggtgtttctaccgggaataatttccctcaactcttccactgaactgacttttggtcaacctttagcacttagctatcatcttctctgggaagcctgtgacttctccagtctggactggatttctgaagcactttgatcataactctgagtcttagagtttgaaagagtctatcttgataatctccccagtgcatccatgtatgagcgcagttacatgcatagagatgttatcacccatgtggtatgcaccaaaacagattttattattactgccagtcatgatggacatgtcaagttctggaaaaaaatagaagagggattgaatttgttaaacattttcgta

SEQ ID NO: 16647 - DNA, 373 bp, Homo sapiens
atataaaagtctcctggggtggagacaaagaagtcattgtattcaaagaagaataagcaagaaagaaaagaaggaaggaagagaggtagacagatacaagatgaaatcctgtcaaaaaatggaaggraaaccagaaaatgagagtgaaccaaagcatgaggaagagccaaagcctgaggaaaagccagaagaggaggagaagctagaggaggaggccaaagcaaaaggaacttttagagaaaggctgattcaatctctccaggagtttaaagaagatatacacaacaggcatttaagcaatgaagatatgtttagagaagtggatgaaatagatgagataaggagagtcagaaacaaacttatagtgatgcgt

SEQ ID NO: 16648 - DNA, 466 bp, Homo sapiens
agtttaagaaacagtcagtggccaacggtgtggagatatctgtgcctgtacccagcgatgccgactcccccagattcaagaccagtgtgggcagcgcaagtatgtgccggagagaaacgtcgtgatttggagtattaagtctttcccggggggcaaggagtacttgatgcgagcccactttggcctccccagtgtggaaaaggaagaggtggagggccggccccccatcgggtcaagtttgagatcccctacttcaccgtctctgggatccaggtccgatacatgaagatcattgagaaaagtggttaccaggccctgcctgggttcgctacatcacccagagtggcgattaccaacttcgtaccagctagaagggagaagagatgggggcttgaacacggggcttccttacagcccggatgcagattttagagggagggcaggtgcgggctgtgtgtgtctgtgt

SEQ ID NO: 16649 - DNA, 359 bp, Homo sapiens
  misc_feature 222: n=a, g, c or t
wtgragatgtaaaagtgggtgggagagggcgtggcaggagagccagggaatggattgagagtgggttcccagtggaggggtgcatatgcagagtcctaaatgtgatcaggagcgggagagtaggggtaggagaggaaaagagtcaccaatgatgaaacgggagaggaaagtggcaattttagatgaattaaatgcttttcaccagagaacaaccccctttgnctgtaattgtccactacccacccaaatcctataaaacagccccacccctgtctcccttcactgactcctttttcagactcagcctgcctgcacccaggtgaaataaacagccttgttgctcacaaaaaaaaaaaarr

SEQ ID NO: 16650 - DNA, 381 bp, Homo sapiens
atgagatgtaaaagtgggtgggagagggcgtggcaggagagccagggaatggattgagagtgggttcccagtggaggggtgcatatgcagagtcctaaatgtgatcaggagcgggagagtaggggtaggagaggaaaagagtcaccaatgatgaaacgggagaggraagtggcaattttagatgaattaaatgcttttcaccagagaacaaccccctttgactgtaattgtccactacccacccaaatcctataaaacagccccacccctgtctcccttcactgactcctttttcagactcagcctgcctgcacccaggtgaaataaacagccttgttgctcacaaaaaaaaaaaaaaaaaaaagaaaaaaaaaaaaaaaw

SEQ ID NO: 16651 - DNA, 516 bp, Homo sapiens
accgcrcgggaggggcggggcctgccgccgcaaccgcctcagggaagaggaaggaggccgcggcttcgcgtcccgcctctcgcctggctggccgtkkgrggcctggacgcatggcctcccgaatctcccaggaccctaatatcgcccgaggatgctgggaggaacgctgagccgacctctccgttaggctgaagattgcacaaaccatgctaatggccagcatggatggagggagcgtgtgagatgtttggggcagcgtgctgcatctcagccaactccaggagccagttgatgtgatggactaccttaattgatttttgaatgttgagccagccttatgcatgtgggataaacccctgttgatcatggtatgtatttcattttatacagtgtcagctttagtttgctggatttttaaaatatgaaatctcttttataatttcatcaggatattggaataaaaaagatgtagatgcatatattcagtcattccttttgaaccagttatatttctaa

SEQ ID NO: 16652 - DNA, 436 bp, Homo sapiens
aaaaacttgggacgactgcaaatcaacatgaatacctgttgaatgttagaacagaaggtctgaccatggactcaagagctgacgttaggaatgtcagcaccatcctgctctccaaggactcctcatcttcaacagactcctcatcttcaaaggaaagggtggaaactgcaacttgtgccatgatccctgcgtgagaaaagtagtaagaaatcctacccgaccatagaatgttagaacakraggtctcaccgtggactcaagagctgacatgaagaatgtcaccaccatcctgctctccaaggactcctcatcttcaatggactcctcatcttcaacggactcctcatctacaacgggcakggtggaaactgcaacttgtgccatgatccctgcgcaagaaaagtagtaagaaattgagtggtagaaatccagtgtc

SEQ ID NO: 16653 - DNA, 518 bp, Homo sapiens
actttctgaagctgagagggagccggaaaggaagggactcaggggatctaatgggagccagaagggcccagacttaggatccgaaattgtgcctatgagagtgagtcagtgtcttggtctgtcacccgggctggagtgcagtggtgcaatcgtggctcgctgcagcctcgaccttcytaggtttaagtgatcctcctgcctcagcctcctgagcagctttggactacagtcctgtgcaagatcctcttgttggcaaactctaacctgggagcatgaggaagaggactgcggggaacggtttccagccctacgtagacatggtggtggtgacgtgttgacacatgggggctccgcttcggacttcgcaatgaataaggccagggaactgcagctgatggctgggtcatccgagagaccttcaatctttactttctataatgacagagcaaaccattctatttgctatttactttcctgatgtatcttcaagaaacttctggaaataggtctttgtgtcc

SEQ ID NO: 16654 - DNA, 375 bp, Homo sapiens
ttaacagaattgctgcttccacctccttgtaatgaggtggggtaggaaagccttcagaaaccattctcactgtctgctgtcctgatggtgagccactctctcgtgaattttgcaggctgcttgccataaggaaagacatgtgtctcagaaggctgtttccttcatccatgacatactgacagaagtcctcactgactggaatgagccacctcattttcacttcaatgaagcactcttccgacctttcgagcgcattatgcagctggaattgtgtgatgaggacgtccaagaccaggtcagtgtgacatggtcatcagcgtcatagctggctcttactgagtgacagagcgagactctgtaaaaaaaaaaaaaaaa

SEQ ID NO: 16655 - DNA, 367 bp, Homo sapiens
acaaagttgggggttttttaaaaaattaagaaaaaggaaagctattctgtattgcaccttttcacaatttaatacattttcttacattttcctgtgattttcgaaactaaaccattgtgtgtcctgtagtgtcctggttgagctgccgctcagcagcttcctcggggggatttggaacacctgtgtctgtcgccgcactgcctgtgggaggggcccagaggstgctgggactggcgtctgtacacacttgtttggccttttctgtagttgatgctgtaaactctatggctttttaaaaacgatttcatgtttttatttagtattggaaatccaatacacttttttaatccaaaaaaaaaaaaaaaaa

SEQ ID NO: 16656 - DNA, 430 bp, Homo sapiens
gagatctacgtgccagtcagcctgggcttctgccmmcmmmrsccywmcsggrrscsgramccyyykkkgscsramccccytycyksccssykgsyttkrammwkrrscytysrrrmyyywrsywmmrsmwkgsccccsggscykkkkkgkkgsccmrsywmccyyykrarrmmwkggscmmytkrmmrrmccccmrrrsmrrrrmcmwkgsytycyksssmmcmarrwkrargkkrmccytkgggrmmrkyccmrkkgrracctgttcacctgccgtgtctgccagaaggccttcacctaccagcgcatgykramcsscmmmwkrarkkkymmmamsrmskymarrrgsmmcyyyksmmskwmykssggragggcttcaatgacaccttcgacctcaagagacacgtccgaactcacactggcgtgcggc

SEQ ID NO: 16657 - DNA, 914 bp, Homo sapiens
aaaaggagtagctattagccaattcggcagggcccgctttttagaagcttgatttcctttgaagatgaaagactagcggaagctctgcctctttccccagtggcgagggaactcggggcgattggctgggaactgtatccacccaaatgtcaccgatttcttcctatgcaggaaatgagcagacccatcaataagaaatttctcagcctggccgaaaatggttggccccacaagccacgacaactggaggcaaagagggttgctcaacgccccgcctcattggaaaaccaaatcagatctgggacctatatagcgtggcgaggcggggcgatgattgtcgcgctcgcacccactgcagctgcgcacagtcgcatttctttccccgcccctgagaccctgcagcaccatctgtcatggcggctgggctgtttggtttgagcgctcgccgtcttttggcggcagcggcgacgcgagggctcccggccgcccgcgtccgctgggaatctagcttctccaggactgtggtcgccccgtccgctgtggcggaaagcggcccccagaaccgaccacaccgtgcaagaggacccagaacccgaggacgaaaacttgtatgagaagaacccagactcccatggttatgacaaggaccccgttttggacgtctggaacatgcgacttgtcttcttctttggcgtctccatcatcctggtccttggcagcacctttgtggcctatctgcctgactacaggtgcacagggtgtccaagagcgtgggatgggatgaaagagtggtcccgccgcgaastgagaggcttgtgaaataccgagaggccaatggcttcccatcatggaatccaactgcttcgaccccagcaagatccagctgccagaggatgagtgaccagttgctaagt

SEQ ID NO: 16658 - DNA, 121 bp, Homo sapiens
agcaccatctgtcatggcggctgggctgtttggtttgagcgctcgccgtcttttggcggcagcggcgacgcgagggctcccggccgcccgcgtccgctgggaatctagcttcttcccccvg

SEQ ID NO: 16659 - DNA, 457 bp, Homo sapiens
atatatatcttctgattcaaccaagtgaaaatgtggcttcagaggaggtgacaaagtgtgaccatacccaaaggctgtcaaggtaatgttggaagcgagtgtatgtatatgggtagcagtaagcaaactgccaagttctgcaacttgactctgagagcctgctgtctccactgaatttgattatgtgctatcaggagaatccatctactgcctgcagctgtcgagctcctctcctgggtgagccgggatgcctaacctgattagcagacaaagtagagctaatgggctctagggcaatcattcagggaaactgagatgctgttcagggcttagattttctagactttcccaaggatacaaacagaaatctatttgaggagggctcagcaggcaaaattcaagactttcaagtaatgcaaagaataaagcaaagggggctgaaactaaaaaaaaaaaa

SEQ ID NO: 16660 - DNA, 463 bp, Homo sapiens
  misc_feature 447: n=a, g, c or t
tgtatagcttcttgcttggccacactccctggtgagctggctggttctctacctgggggttggtgggggcacgcagagggccagagckccctccccgctccgccctccgccctccaccctcacctgtgtttgacttgctgcttagctgctccttgggatctgataaactgaacttggaccgtggtaaagtcagcctgggcttctgccaccacagccctaccgggagccggaaccctctgtggccgaacccccttcctgcccgctggctttgaacatgagccttcgagactctagctacagcatggcccccgggcctgtgtggtggcccagctgccctctgaagacatgggccacttgacagacccccagagcagagaccatggcttcctgcgcaccaagatgaaggtgacccttkgggacagtcccagtggagacctgttcacctgncgtgtctgccagaagg

SEQ ID NO: 16661 - DNA, 475 bp, Homo sapiens
aatcgcagccatggcgtcgttactgtggggaggcgacgcaggggcggcggagagcgagcggctgaacagcacttttcaaacctcagccaaccccggaagaacctttggggtattaagagtactgcagtccgaaacatagatggttctattaataacatcaatgaagatgatgaagaagatgtagtggatttggcagctaattcactcttaaacaagttaatccatcaatccttagtagaatccagtcaccgtgtggaagttttacagaaggatcccagctctccactttactcagtaaagacatttgaagagctgcggctaaaggaagagttactaaaaggaatctatgcaatgggatttaataggccatctaaaatccaagagatggctctccctatgatgctggcacatccaccccagaacctcatagcacagagccagtctggaacaggaaagacagcggcatttgtgttgg

SEQ ID NO: 16662 - DNA, 452 bp, Homo sapiens
agtcctttcccttccctatctctcccctctccttccttcccctcctcttctctctctaatcttcattattctttcttatcctcaaactcatcttccggtatcatgttttcctcaattcttgctgatcctgtttttaattctttgttccttttccctcttgcccacccactcccagctccctgaccttggtgttgctccttttctggcctcgtctcctctgagcctagctcttggtgccctgttttcctgcagactcactctgtggagacaccatacggctctgtcactttcactgtctatggcacccccaaacccaaacgcccagcgatccttacctaccacgatgtggactcaactataaatcttgcttccagccactgtttcagttcgaggacatgcaggaaatcattcagaactttgtgcgggttcatgtggatgcccctggaatggaa

SEQ ID NO: 16663 - DNA, 475 bp, Homo sapiens
aaaaaaggcaagtgaaggtggaagcggccgcggcggcagcagaccccagagtcagaaggagtgagaaccctgacccctaatcccactgcatccagccaataggagcccagccaccatggcggastgcaggaggtgcagatcacagaggagaagccactgttgccaggacagacgcctgaggsgccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatccttgcgtcctgcagtaccta

SEQ ID NO: 16664 - DNA, 285 bp, Homo sapiens
aagtgaaggtggaagcggccgcggcggcagcagaccccagagtcagaaggagtgagaaccctgacccctaatcccactgcatccagccaataggagcccagccaccatggcggastgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcaccccaaacccm

SEQ ID NO: 16665 - DNA, 504 bp, Homo sapiens
aggaaaggaacaagggaaagagccggtgaaggggcagaacaggcaggttccctcgacccaggaccccctgttcccaggctatggcccccagtgccttktagacctggcaggccccccgtgcttgcgacccctatttgggggtctgggtggctactggagggccttgcagaggggcagagaaggcaggaccatgacatctagggcctctgaactttctccggggcgcacgtgacggctggcatcatcattgttggagatgagatccttaagggacacactcaggacaccaacaccttctttctgtgccggacactgcgctccctaggggtccaggtttgccgagtctcagttgtacctgatgaggtagccaccatttgcagctgaggtcacttctttctccaaccgcttcacccatgtcctcacagcagggggcatcggccccactcatgatgatgtgacctttgaggcagtggcacaggcctttggagatgagctgaagcacac

SEQ ID NO: 16666 - DNA, 488 bp, Homo sapiens
gaaaggaacaagggaaagagccggtgaaggggcagaacaggcaggtgagagtctaagagggctcagtaatctgaagcttggtgggaagaagggattctgggctagaaagggtgcagaagcctgaagtagaaagagacgggattttggtccggggtggagagcgaatgcattgaaaagggccaaggcccaggataaggtagacatttaaaggggtacggatgcccaaggtagagcagacacttgaggagaccagctcagcaaacggaagacacttaaagtggtaggttctcaagagagaagaagtttttaagactagagctaagcaagacatttaaaaggacatgggttgggatttgggaacacgtttattccagaggcaggaacaaaggagtcgcttgtcaaggatctggttagagaagactagggtcttcctcgaaggaagcacgcgcacgcctgctctctcccattgtcttttctggcttctccag

SEQ ID NO: 16667 - DNA, 528 bp, Homo sapiens
tccatttttttccatttattcagcaatacttactaagctattttattgtatcccaggggctggctggactctgtggggaatacaaaaggaccagaaatagtccctgcccacagtgaacttaaaatttgcttacggaagagcagctttatacacagataaccttgaactagggttgaaagtgatgaaagttttgagagtgctgtgaactttgcacagaaagagagagtttaagttcagcattgggagttagggaaggcctgagctggaaatgaaaaatggtttaggaaacagacctgtgtccgggtgcagtggcttacgcctgtaatccaagcactttgggaggccgggtcaggtggatcatttgaggccaggagtttgagaccagcctgggcagcatggcaaaaacccatctctactaaggatacaaaaattagccaggcatggtgccacacacctgtagtcccagctactctgggaarctgaggcactagaatctcttgagcccatgaaggtcgaggctgcagtgag

SEQ ID NO: 16668 - DNA, 472 bp, Homo sapiens
caatatcagctaggacaacatagcaagatcccatctcaacaaaagaaaaattaaaaaaaattagccaggggtggtggcacacacctgtagtcccagctcctcgggcagctgaggcaggaggatcacttgagcccaggaggtcaaggctacagtgagccatgatcacaccactgcactccagcctgggtgacagagcaaaatcctgtctcaaacaacaacaacaacaaaatgtagctgtgggagatgcagagctcctggcatatgaaccagcatgctccaaggccctgaagcaggtatgagtgagtcacttttaaggaactgagaaaacttgtgtgactttacctgtcacttaactgatcagtgactctcatttgggaccctaataacttgtcttccagagggtaagggcatggtccttactgccctaagtgccatgaatctgtttataaaagtcacccaggctgggctcggt

SEQ ID NO: 16669 - DNA, 435 bp, Homo sapiens
caatatcagctaggacaacatagcaagatcccatctcaacaaaagaaaaattaaaaaaaattagccaggggtggtggcacacacctgtagtcccagctcctcgggcagctgaggcaggaggatcacttgagcccaggaggtcaaggctacagtgagccatgatcacaccactgcactccagcctgggtgacagagcaaaatcctgtctcaaacaacaacaacaacaaaatgtagctgtgggagatgcagagctcctggcatatgaaccagcatgctccaaggccctgaagcaggtatgagtgagtcacttttaaggaactgagaaaacttgtgtgactttacctgtcacttaactgatcagtgactctcatttgggaccctaataacttgtcttccagagggtaagggcatggtccttactgccctaagtgccat

SEQ ID NO: 16670 - DNA, 550 bp, Homo sapiens
accatcgcgctgggggttagggcttcaacatatgaatattgcggggacacagacattcaatccataatagcaagtttcagtggatttcagaagcccctaaggcagaaaagcaaaagcaccttattttttgtccacttgacctgtgtcttatgttggactgaaatgtaggtctcctaattttagtgtagttttgtatatttctccctatatatctttaactttctgatatataaagatgtgaatcatgttttttgtttcttgatctctgcggttttttcaagtacgcgtattcattttgtgaaaattcaatgagctctacactttatatgtagctgaaatacaacatcataatttttactggaaaatagccacaatgaaggaacaccacaatttcaccatgaaaaccagcacaaccttacacagatkacaaacatttcccctcaaaacttgttaaactgtatttgggctgaccaaattaaccagagttattctatttatgggggagcaggaagtaacttgataaaatgctttgagtttatatatcatgtca

SEQ ID NO: 16671 - DNA, 519 bp, Homo sapiens
ctgaaarattccatctgtaaataccatcgcgctgggggttagggcttcaacatatgaatattgcggggacacagacattcaatccataatagcaagtttcagtggatttcagaagcccctaaggcagaaaagcaaaagcaccttattttttgtccacttgacctgtgtcttatgttggactgaaatgtaggtctcctaattttagtgtagttttgtatatttctccctatatatctttaactttctgatatataaaggtagctgaaatacaacatcataatttttactggaaaatagccacaatgaaggaacaccacaatttcaccatgaaaaccagcacaaccttacacagatgacaaacatttcccctcaaaacttgttaaactgtatttgggctgaccaaattaaccagagttattctatttatgggggagcaggaagtaacttgataaaatgctttgagtttatatatcatgtcaaataaatagcataattttaaagkaaaaaaaaaaaaaaatg

SEQ ID NO: 16672 - DNA, 479 bp, Homo sapiens
aaacatatgaatattgcggggacacagacattcaatccataatagcaagtttcagtggatttcagaagcccctaaggcagaaaagcaaaagcaccttattttttgtccacttgacctgtgtcttatgttggactgaaatgtaggtctcctaattttagtgtagttttgtatatttctccctatatatctttaactttctgatatataaaggtagctgaaatacaacatcataatttttactggaaaatagccacaatgaaggaacaccacaatttcaccatgaaaaccagcacaaccttacacagatgacaaacatttcccctcaaaacttgttaaactgtatttgggctgaccaaattaaccagagttattctatttatgggggagcaggaagtaacttgataaaatgctttgagtttatatatcatgtcaaataaatagcataattttaaaggaaaaaaaaaaaaaawtkcgaaasc

SEQ ID NO: 16673 - DNA, 529 bp, Homo sapiens
aawtamytyctgaaarattccatctgtaaataccatcgcgctgggggttagggcttcaacatatgaatattgcggggacacagacattcaatccataatagcaagtttcagtggatttcagaagcccctaaggcagaaaagcaaaagcaccttattttttgtccacttgacctgtgtcttatgttggactgaaatgtaggtctcctaattttagtgtagttttgtatatttctccctatatatctttaactttctgatatataaaggtagctgaaatacaacatcataatttttactggaaaatagccacaatgaaggaacaccacaatttcaccatgaaaaccagcacaaccttacacagatgacaaacatttcccctcaaaacttgttaaactgtatttgggctgaccaaattaaccagagttattctatttatgggggagcaggaagtaacttgataaaatgctttgagtttatatatcatgtcaaataaatagcataattttaaagtaaaaaaaaaaaaaaatgs

SEQ ID NO: 16674 - DNA, 527 bp, Homo sapiens
cgggattactgttcggaagaagaggatatcacatagcaccaattttaccactcaaaccaggagctactactgtgtaaataggttacaccccagttgaaatctttgcaaaggtcggttctattcagcgaacagcactatagcaaaagaagatcgttccatattgtacgccccattaaattacagtgtttcttaatgaacttgcaaaggaatattgctaaaaacaaacaaaaaaaactgttatctaactttctttgttgctgctagttaaaacttgttgcaacttttcacttctcttgtgtccaggtatgcagcaaaattctgcaatttcaccttaaagatactgttggttttacagatgctctccaacctattttctataagatgaggtagtggtgaactcagataacaaacttctcttctaaactggttctgcttctaagacaagcatctcctgccctctctccttcctccccatctctcgcacgcagtctagagatggactgagccttgcttctcactggcagtgt

SEQ ID NO: 16675 - DNA, 395 bp, Homo sapiens
  misc_feature 332: n=a, g, c or t
ctccaggctttgtcatggcggctgctgctgcacgctggaaccatgtgtgggtcggcaccgagactgggatcttgaaaggggtaaatcttcagcgaaaacaggcggcgaacttcacggccggagacagccgcggcgcgaggaggcagtgagcgccctgtgttggggcaccggcggcgagacccagatgctggtgggctgcgcggacaggacggtgaagcacttcagcaccaaggatggcatattccagggtcagagacactgcccggkbyggggagggcatgttccgtggcctcgccaggccgacggcaccctcatcacatgtgtggattctnggattctcagagtctggcatgacaaggacaaggacacatcctctgacccactcctggaactga

SEQ ID NO: 16676 - DNA, 609 bp, Homo sapiens
  misc_feature 569..570,573..574: n=a, g, c or t
agtttgggaaacgtttttcctacaatttttgggggcaattataacaattcttcacaggagttagaatgtaagtacaattatttctttttaatgtggttaaaggaaaagcatatttaaagattatataatgaaaatgaatttttaatttttgaatgcaattgtaaacgagatataaaagttattattttattattagtcaaaaatgctgtgatctttggtaacataattttatagacctttttatgactaccttcttaaaactttaccttgtacagcaagtatgctacctaaccactcactctctgtgtcattttagatatggttcgtatattttcagcacaaatttctcttaaatcccatgtacctcaagcgactgcatttcgtttttttgtaaacatttaggttcaggggtacatgtgcaggtttgtcacataggtaaaattcatgtaacggggatttgttgtaaagattatttcatcctccaggtaataacgctggtacccaagttattttttctggttctcttcctcctcccaccctccaccctcaaataggtcacagtgtttganncwnnccttctttgcgtccaagagttcttatcatttagct

SEQ ID NO: 16677 - DNA, 387 bp, Homo sapiens
aacaattagagatactttatttatttatttatttatttgagatggagtcttgctatgtcacccaggctggagtgcagtggcacagtctcagctcactgcagcctctgactccggggttcaggcgattctcctgcctcagcctcccgagtagctgggattacaggcgcccgtcaccacgcccggctgatttttttgtattttttggtagagatggagtttcaccatgttggccgggctggtctcgaactcctgaccttaagtgatctgcccgcctcggcctctgaaagtactgggattacagcataagccactgcacccagccagacaattagagatattttagaggagagtacaagggaaaactttcagagtggaaggatggttgtc

SEQ ID NO: 16678 - DNA, 394 bp, Homo sapiens
aacaattagagatactttatttatttatttatttatttgagatggagtcttgctatgtcacccaggctggagtgcagtggcacagtctcagctcactgcagcctctgactccggggttcaggcgattctcctgcctcagcctcccgagtagctgggattacaggcgcccgtcaccacgcccggctgatttttttgtattttttggtagagatggagtttcaccatgttggccgggctggtctcgaactcctgaccttaagtgatctgcccgcctcggcctctgaaagtactgggattacagcataagccactgcacccagccagacaattagagatattttagaggagagtacaagggaaaactttcagagtggaaggatggttgtcccaaaga

SEQ ID NO: 16679 - DNA, 216 bp, Homo sapiens
atatactcgagcacaaaagactttatatggagcaggaagagggaggcccacccgcagaagggagctacccactgtgagtctcttctccactgagagctggacactcattaggacgacctgcctttggaaagaactacccactttgggtctcccgagaactgttctgtcactcaataaatctctccaccttgttcatccgaaaaaaaaaaaaaaaaa

SEQ ID NO: 16680 - DNA, 374 bp, Homo sapiens
cttttcagtccttgcgcaccggggaacaaggtcgtgaaaaaaaaggtcttggtgaggtgccgccatttcatctgtcctcattctctgcgcctttcgcagagcttccagcagcgaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctcttggaagtggatcaaactagaactcatatgccatactagatatgtttgtcaataaacttatgacgtcaaaaaaaaaaaaaaaaagg

SEQ ID NO: 16681 - DNA, 531 bp, Homo sapiens
agatgtgggctctgtagataaggactggcaggaaagttgtttactgaaactaaaacagggaggcacaaaggataaggaagttagtttggctttggaagtagggaacaaagaacaaggacactgaacaagctaaatctttgaagaggaacttcttttgtatctgacaaaggtcttcaaggaagaagggagagagtgacctttctaggttttatggttgatgctggtggagaggagttctagtttctaagatttaccttgaggaagaagaactgtagtttctgtggcttgcagacaagcaaagcaaagctgataagcatcattagcatccattttaaatttaagcaaactgaactccaagaggttaagaaacttgctccaagtgacacagctggcccacccgcagaagggagctacccactgtgagtctcttctccactgagagctggacactcattaggacgacctgcctttggaaagaactacccactttgggtctcccgagaactgttctgtcactcataaatctctcca

SEQ ID NO: 16682 - DNA, 571 bp, Homo sapiens
  misc_feature 550: n=a, g, c or t
taaaatatggttatcactgcgttcctatctaaagagacgggggccacagcgttcagttgatgtggttgtatcctcggttttcctactgacactttcgattgctttcatttgttgtgctcaggttctccaaggacataaaactttcctgaatgatgcttataactgggagtttttgatctgggaaacagctttactactttttttattgcgtctggcctcactggggtctgaaaccaataagaaatacagcaatgtttcaatattacttacagaacaggtattgatcagtcctgtcaattgggtttagtggttaggggtagcgtaatacgctgtaaggttcctgcagaggattcagggtttaatcactgtctagctgtcactttctagctacaggacctcacaagtcagtttgctgctctgtagttgcttatccctaataaaatggatgtaatatctcctcctgctctgtgagaattaagatctaatggattgaaaagactttgtatactatggagagatttttattggtggtaatggagcatgcttttantctcatattctatgtcagtat

SEQ ID NO: 16683 - DNA, 100 bp, Homo sapiens
aactaccaattaacgagcgaggaaacagggccagagaattggaacaaaatacaaggctgcctctgaaaggtcatgttcaagctaaaaaaaaaaaaaaaaa

SEQ ID NO: 16684 - DNA, 361 bp, Homo sapiens
aactaccaattaacgagcgaggaaacagggccagagaattggaacaaaatacaaggctgcctctgaaaggtcatgttcaagctaatttattggttattttgctctacccaaacccaattattctgattgatttccacccatataaatctactgtaaccagttcagacttctgtatgaagaatatccagaaaagtagaattttatattttggagaaattttcaggattagttttttttttttttaaaayccttttgctcactcagtgasatttttcagttattatctttgtatttatgtaaacatttgggcggcagtacatgtaattaaaggtgtgagttctagcaaaaaaaaaaaaaattg

SEQ ID NO: 16685 - DNA, 112 bp, Homo sapiens
aactaccaattaacgagcgaggaaacagggccagagaattggaacaaaatacaaggctgcctctgaaaggtcatgttcaagctaaaaaaaaaaaaaaaaaaaaaaaaaaaaa

SEQ ID NO: 16686 - DNA, 146 bp, Homo sapiens
aactaccaattaacgagcgaggaaacagggccagagaattggaacaaaatacaaggctgcctctgaaaggtcatgttcaagctaaaaaaaaaaaaaaaaaaaaaaaaaaaaaaaaaaaaaaaaaaaaaaaaaaaaaaaaaaaaaar

SEQ ID NO: 16687 - DNA, 107 bp, Homo sapiens
aactaccaattaacgagcgaggaaacagggccagagaattggaacaaaatacaaggctgcctctgaaaggtcatgttcaagctaaaaaaaaaaaaaaaaaaaaaaaa

SEQ ID NO: 16688 - DNA, 145 bp, Homo sapiens
aactaccaattaacgagcgaggaaacagggccagagaattggaacaaaatacaaggctgcctctgaaaggtcatgttcaagctaaaaaaaaaaaaaaaaaaaaaaaaaaaaaaaaaaaaaaaaaaaaaaaaaaaaaaaaaaaaav

SEQ ID NO: 16689 - DNA, 120 bp, Homo sapiens
aactaccaattaacgagcgaggaaacagggccagagaattggaacaaaatacaaggctgcctctgaaaggtcatgttcaagctaaaaaaaaaaaaaaaaaaaaaaaaaaaaaaaaaaaaa

SEQ ID NO: 16690 - DNA, 118 bp, Homo sapiens
aactasccaattaacgagcgaggaaacagggccagagaattggaacaaaatacaaggctgcctctgaaaggtcatgttcaagctaaaaaaaaaaaaaaaaaaaaaaaaaaaaaaaaaw

SEQ ID NO: 16691 - DNA, 145 bp, Homo sapiens
aactaccaattaacgagcgaggaaacagggccagagaattggaacaaaatacaaggctgcctctgaaaggtcatgttcaagctaaaaaaaaaaaaaaaaaaaaaaaaaaaaaaaaaaaaaaaaaaaaaaaaaaaaaaaaaaaaaa

SEQ ID NO: 16692 - DNA, 164 bp, Homo sapiens
aactaccaattaacgagcgaggaaacagggccagagaattggaacaaaatacaaggctgcctctgaaaggtcatgttcaagcttaaaaaaaaaaaaahkgtawaaaaaaayaaaaarraaaaaaaaaaaaaaaaaaaaaaaaaaaaaaaaaaaaaaaaaaaaaw

SEQ ID NO: 16693 - DNA, 108 bp, Homo sapiens
aactaccaattaacgagcgaggaaacagggccagagaattggaacaaaatacaaggctgcctctgaaaggtcatgttcaagctaaaaaaaaaaaaaaaaaaaaaaaaa

SEQ ID NO: 16694 - DNA, 111 bp, Homo sapiens
aactaccaattaacgagcgaggaaacagggccagagaattggaacaaaatacaaggctgcctctgaaaggtcatgttcaagctaaaaaaaaaaaaaaaaaaaaaaaaaaar

SEQ ID NO: 16695 - DNA, 146 bp, Homo sapiens
aactaccaattaacgagcgaggaaacagggccagagaattggaacaaaatacaaggctgcctctgaaaggtcatgttcaagctaaaaaaaaaaaaaaaaaaaaaaaaaaaaaaaaaaaaaaaaaaaaaaaaaaaaaaaaaaaaaaa

SEQ ID NO: 16696 - DNA, 127 bp, Homo sapiens
aactaccaattaacgagcgaggaaacagggccagagaattggaacaaaatacaaggctgcctctgaaaggtcatgttcaaggctaaaaaaaaaaaaaaaaaaaaaaaaaaaaaaaaaaaaaaaaaaa

SEQ ID NO: 16697 - DNA, 394 bp, Homo sapiens
ctttcccgattctgactcccagcctccctccctcgcgcgcgctccttccaggtccgtgtccttaccgcccagcaccaggcccatcccgcagtgggcgacagtcgcggcctctctttaggtccagttggcaacgctggaggacagaagaagccaccggcgtgagaaccggctccccggagagcttcctagaccctccttcgcgtcagggtccgccagacccaggacccgctgccaccagcttccccggagcctgccttcctcctcctcctccttttcccgatgatcctagtcgggttcctgttacgtttgcaaggtgcattttgaaaagggaaggaaaatgtgcctttcgtatatcaaaatacagccttagagagccaaaaaaaaaaaaaaaaag

SEQ ID NO: 16698 - DNA, 472 bp, Homo sapiens
ggaaaacaagcgtgtttgagaaaagagagtgacttctttcacttaaagcagccattctcaaaggttgtggcctcaggatcattatacacttggcagttattgagggctcttgagagatttttattatgtaggttttatcaatgctcaccattattaaaaattacataaattttaaggccaggtgcagtggcttacggctgtaatcccagcactttgggaggcccagacaggcagatctcctgaggtcaggagttcgagaccactccggccaacgtggtgagacctccgtctctactaaaaatacaaaaattagccgggcgtggtggtggctgcctgtaatcccaggtactcaggcgactgaggtaggagaatcacttgagcccaggaggcggaggttgcggtaagccaagatcgcgccacggcactccagcctakgcaacagagcaagactccatcttaaaaaaaaaaaaaa

SEQ ID NO: 16699 - DNA, 498 bp, Homo sapiens
  misc_feature 395,424,431: n=a, g, c or t
ttaagtagtttaagtatgttaaatgtggatcttttacaccacatcacagtgaacacactggggagacgtgcttttttggaactcaaaggtgctagctccctgattcaaagaaatatttctcatgyttgttcattctagkttatattttcatttaaaatcctttaggttaagtttaagctttttaaaagttagttttgagaattgagacacaatactaatactgtaggaattggtgaggccttgacttaaaactttctttgtactgtgatttccttttkggtgtattttgctaagtgaaacttgttaaattttgtgtgttaactaaatttttttcttaaaataaagactttttcacaatgactggcacagattactcagcaaaagatagcaraacngggtggttgaagataattcattttaatcngtaatgnattttagtgtgaatttaaaaatttcatacatcaaatctatgatctcccttatattcttatgatgagg

SEQ ID NO: 16700 - DNA, 513 bp, Homo sapiens
ccttgtcctggacgccccttggcggtccgcactggcgggtgccctctcccgaggggaactgaggcggggcgcctgccaccattcgtgattttccgtgactcaccctctcaacagtgtcccgtcagcccccgctttctggaattaagatgattttccatgggcattatagtcagaggaggttttctgtgagacatctgggaaaggtgactcaatgatcactcatattgttctatgatgttatacatttaaccggaatactggtgaacagcttttatatcttggaattttttcccatttttgaatcagaaatttaggaccaagaatcttctgtcacagaacctattactttgaggagtgaacttatattaacggtgctaaaccgtacatgaacgacttggtagatgaaaactttggaaaataggaacatttcatgtcatcacatgtatcctccagcattggggaaaattcaacagttgccttaaggcgggagtttaattgaggcatttactaaaa

SEQ ID NO: 16701 - DNA, 155 bp, Homo sapiens
gcgttcccgactcggagcccccagctccgcgcgagcagctaaccgggctggctctcggtgtgtgcccttcggatggtcggctgaagagggccgccagctggtaagacactccgaggcaacgaccggtctccctctccctagcccggtgtgcagtc

SEQ ID NO: 16702 - DNA, 498 bp, Homo sapiens
ataaggaaaatgtctcctgatatagagctagggttacttgaaacagacatagcagagactgccaggcaccttttgggtttagaattagtaaggaaaactttggaagccacaagtttatcagcatcagcttaaagtcgtctatcttccaagcaagtaacagagtatttttgagtttctgaagataattgtctgtttacatgaaacaaacaaaaatacatcacacctattgagtcactcgctgagatgatccattgctataaactgaattgtgtccccccacaaattcatatgttgaagttgtaaccctcaatgtgactgcacttggagataagacctttagaaggtattggaggaaattctatatgaagacacagcaggaaagaagctgcctacaagctagaaagagatccctcatccagaattgaatcagccagcatcttgatcttggatttgtaatctccagaactgtgaaaaaataaatgtatatggtttaagcaa

SEQ ID NO: 16703 - DNA, 241 bp, Homo sapiens
catagcaacctactagataagggaagcttgtccagcctgcagcccaggacggctttgaatgtggcccaacacaaattcgtaaacttaaattttatttttgagatttttttttttaagctcatcactrtcattagtatattttatgtgtggcccaagacaattcttccaacgtggcccagggaagccaaaagattggacacccctaagataagagatatctttctatagaaagttattctat

SEQ ID NO: 16704 - DNA, 481 bp, Homo sapiens
  misc_feature 473: n=a, g, c or t
agtgagatcccgatcaagctttatcatgcagcccagaagggtgggggaaagaaaaagaattaggagaaaatgttgcaaaagtaatgagataatatgagaatgtgctttgggaactgcgaatctggagtcactggtccatgaggaatctaggataagaagaaggaagctgtgaagaatggttggctaacagtgctggcaaggaattcagatcaacatacctctcaaaagaatggaagtctcttaaactcaggatttggattgccatgggaacttttcagaatggactttcacaaaagctttgctctgagagcatggaagttggctacaacgttgcctgggaacaatacaaaggaggatggttttgaatgtcagtaacttttctgaatatccagcctacaaaataaaactttttctttaattgtaaagtaacaaaagacctctgtaaatatttgaaaaagaatagagacaattanaccatacc

SEQ ID NO: 16705 - DNA, 366 bp, Homo sapiens
ctctccgccagaccgccgccgcgccgccatcatggacaccagccgtgtgcagcctatcaagctggccagggtcaccaaggtcctgggcaggaccggttctcagggacagtgcacgcaggtsgcgtggaattcatggacgacacgagccgatccatcatccgcaatgtaaaaggccccgtgcgcgagggcgacgtgctcacccttttggagtcagagcgagaagcccggagttgcgctgagcttggctgctcgctgggtcttggatgtcgggttcgaccacttggccgatgggaatggtctgtcacaatctgctccttttttttgtccgccacacgtaactgagatgctcctttaataccgtttgtg

SEQ ID NO: 16706 - DNA, 408 bp, Homo sapiens
ctctccgccagaccgccgccgcgccgccatcatggacaccagccgtgtgcagcctatcaagctggccagggtcaccaaggtcctgggcaggaccggttctcagggacagtgcacgcaggtsgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacagtctgctccttttttttgtccgccacacgtaactgagatgctcctttaaataaagcgtttgtgtttcaagttaaaaaaaaaaargaaaaaaaaaaaaaaaa

SEQ ID NO: 16707 - DNA, 418 bp, Homo sapiens
agaacgtcctataaaggctctccccgaagcacgtgactcctctccgccagaccgccgccgcgccgccatcatggacaccagccgtgtgcagcctatcaagctggccagggtcaccaaggtcctgggcaggaccggkttctcagggacagtgcacgcaggtsrcgtggaattcatggacgacacgagccgatccatcatccgcaatgtaaaaggccccgtgcgcgagggcgacgtgctcacccttttggagtcagagcgagaagcccggagttgcgctgagcttggctgctcgctgggtcttggatgtcgggttcgaccacttggccgatgggaatggtctgtcacaatctgctccttttttttgtccgccacacgtaactgagatgctcctttaaataaagcgtttgtgtttcaaaaa

SEQ ID NO: 16708 - DNA, 378 bp, Homo sapiens
ctctccgccagaccgccgccgcgccgccatcatggacaccagccgtgtgcagcctatcaagctggccagggtcaccaaggtcctgggcaggacgttctcagggacagtgcacgcaggtscgtggaattcatggacgacacgagccgatccatcatccgcaatgtaaaaggccccgtgcgcgagggcgacgtgctcacccttttggagtcagagcgagaagcccggagttgcgctgagcttggctgctcgctgggtcttggatgtcgggttcgaccacttggccgatgggaatggtctgtcacagtctgctccttttttttgtccgccacacgtaactgagatgctcctttaaataaagcgtttgtgtttcaaaaaaaa

SEQ ID NO: 16709 - DNA, 484 bp, Homo sapiens
gtgtgggtgacgagtggtggccgaagcagggggacagcaagggacgctcaggcggggaccatggcggacggcggctcggagcgggctgacgggcgcatcgtcaagatggaggtggactacagcgccacggtggatcagcgcctacccgagtgtgcgaastagccaaggaaggaagacttcaagaagtcattgaaacccttctctctctggaaaagcagactcgtactgcttccgatattatcgacatcccgtatcttagttgcagtagtgaagatgtgctatgaggctaaagaatgggatttacttaatgaaaatattatgcttttgtccaaaaggcggagtcagttaaaacaagctgttgccaaaatggttcaacagtgctgtacttatgttgaggaaatcacagaccttcctatcaaacttcgattaattgatactctacgaatggttaccgaagcaagatttatgttgaaattgagcgtgc

SEQ ID NO: 16710 - DNA, 413 bp, Homo sapiens
ctctccgccagaccgccgccgcgccgccatcatggacaccagccgtgtgcagcctatcaagctggccagggtcaccaaggtcctgggcaggaccggttctcagggacagtgcacgcaggtsgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgctcctttaaataccgtttgtgtttcaagttaaaaaaaaaaaaaaaaaaaaaaaaaaaaaaaammcm

SEQ ID NO: 16711 - DNA, 430 bp, Homo sapiens
ctctccgccagaccgccgccgcgccgccatcatggacaccagccgtgtgcagcctatcaagctggccagggtcaccaaggtcctgggcaggaccggttctcagggacagtgcacgcaggtsgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgctcctttaaataccgtttgtgtttcaagttaaaaaaaaaaaaaaaaaaaaaaaaaaaaaaaamccmaaaaaaaaaaaaaaaav

SEQ ID NO: 16712 - DNA, 425 bp, Homo sapiens
ctctccgccagaccgccgccgcgccgccatcatggacaccagccgtgtgcagcctatcaagctggccagggtcaccaaggtcctgggcaggaccggttctcagggacagtgcacgcaggtggcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgctcctttaaataaagcgtttgtgtttcaagttaaaaaaaaaaaaaaaaaaaaaaaaaaaaaaaaaaaavaaaaaaaar

SEQ ID NO: 16713 - DNA, 368 bp, Homo sapiens
ctctccgccagaccgccgccgcgccgccatcatggacaccagccgtgtgcagcctatcaagctggccagggtcaccaaggtcctgggcaggaccggttctcagggacagtgcacgcaggtsgcgtggaattcatggacgacacgagccgatccatcaksccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgctcctttaaataccgtttgt

SEQ ID NO: 16714 - DNA, 407 bp, Homo sapiens
ctctccgccagaccgccgccgcgccgccatcatggacaccagccgtgtgcagcctatcaagctggccagggtcaccaaggtcctgggcaggaccggttctcagggacagtgcacgcaggtsgcgtggaattcatggacgacacgagccgatccatcatccgcaatgtaaaaggccccgtgcgcgagggcgacgtgctcacccttttggagtcagagcgagaagcccggagttgcgctgagcttggctgctcgctgggtcttggatgtcggkttcgaccacttggccgatgggaatggtctgtcacagtctgctccttttttttgtccgccacacgtaactgagatgctcctttaaataaagcgtttgtgtttcaagttaaaaaaaaaaaaaaaaaaaaaaaaaaaar

SEQ ID NO: 16715 - DNA, 443 bp, Homo sapiens
ctatgtatgatgctaatcaatgaacactttatttattttacagagaaaacttatctgtgaactttactatatatctgtttattttactttattttttttttaaataaaaagggttttaaatgctatgcagtcattagtagaaaattttttaggactctgcctgctctgtaactatcttaatatgatctggcagaaactcgcatgtatccaagtaaagtagtttagctaaagaaaggttcttcattgcttttctgttcacagttgtggctctgttttttaagaatgtaacttgtttttagattatacttgcatctgtgactttactaccagccacgtttgacacaaaacaggttctggttcaggtaaagttgcgtcagtcacctgcagcagaaatccctcttcattcctcttctctgtgttcattcctcttctgtgctgttctg

SEQ ID NO: 16716 - DNA, 496 bp, Homo sapiens
ggccgaagcagggggacagcaagggacgctcaggcggggaccatggcggacggcggctcggagcgggctgacgggcgcatcgtcaagatggaggtggactacagcgccacggtggatcagcgccttcccgagtgtgcgaastagcccaaggcatgcctttataggtattgatttaaatcttacaccaaccctgtggattggtacaattattgtgcccacttcgctgaagagaaaattgagagtcagagagcttgtgttttactcaaggaaggaagacttcaagaagtcattgaaacccttcactctctggaaaagcagactcgtactgcttccgatatggtatcgacatcccgtatcttagttgcagtagtgaagatgtgctatgaggctaaagaatgggatttacttaatgaaaatattatgcttttgtccaaaaggcggagtcagttaaaacaagctgttgccaaaatgggttcaacagtgctgtacttatgtt

SEQ ID NO: 16717 - DNA, 176 bp, Homo sapiens
  misc_feature 165: n=a, g, c or t
aaatgagtgttgtttgtaaaacagtaacatcaaattggctagagagataaatgtatcatgttttaaattaggttttgtgagtagacagattacaattctattttaaatataaagtttataaaataaatactttttgtatccgaaaaaaaaaaaaaaaaaggcccnccytggccaac

SEQ ID NO: 16718 - DNA, 527 bp, Homo sapiens
agaaggatgcaccctgaggcagggaggaatgataaaataaaacagtagtagcaattcccaaggtgtggcaagctaaatattggcatttttgtgaagagtaaagtgcctttgtatgatgaatgggtccaggggggtctgctcccttcctgtctgtggaaacagcaggctgagtcaccatgacagcctgctaattaaaatgacctcccggaaatgaggattagaacacagggagaggaagggaggctccagggaggaaaatcccttagcacagagctccactaaagcattttttgtttgtttgtttgtttgtttgtttgtttgggttggagattattgaagtttgctacaaaaatcaaaaagaaaacttgttctcctttgcatgctagttttcagaaatgatgacaaagagccatatgttgattggctacaaatgtcatgttgtatatacagcttctcccctgggttcgttttgcccagaggaacacaaataaagtgttttgtgctaaaaaaaaaaaaaaaargctttt

SEQ ID NO: 16719 - DNA, 303 bp, Homo sapiens
tagttatagcaattctctgatcactttgcttgcatacgtccacctctccgggtcatgtgcttctcaagagtgggagctttgccarggratcgtttgtcagatttctgatgtgtgkaattcatccaggtctggaagggtctttattcagtctgaaggacattttaattttgtatagtattttcatcacaaatcctcgkacacatgagggtawtggrrradavttgramcctttcctttgtgctcactgtcaccatgacatctcamccaagttkcatgtcccamcaggttggttttaagaacatk

SEQ ID NO: 16720 - DNA, 488 bp, Homo sapiens
taacattgttttacacttttgcaaatctctttattcccctggcttaatagaacacagctggattctcatatcagtttcttcatctactctgttgcaatatattgttttggttgatgtatatgaaaaaaattcagtctcacacagatatacagttggaatacaaggaagtattttaatagctttttcaggtaattttgggatatattttgattctacaaaggcagatggcagtttcttaaaagttaattgtggtgtggatctgaaagcattatcagtgaacatttttcaaatgctattacattaaagtgcactggttgattttgtactttgaatgattttktttaataatgcatgattttgtgatatcaggcattgctcatcttgaaaatatttattcgctgagttaagcaaatattccaagtgttgatgcattttattgtatactaccatgaaatcattttgttagtgtcttcaccamtctcatcagg

SEQ ID NO: 16721 - DNA, 152 bp, Homo sapiens
gtccggtcaaggcagccatctcgccgtgagacagcaagtgtcggatccgcagcgcackagccgawtgttgtcctctacagccatgtattcggctcctggcagagacttggggatggaaccgcacagagccgcgggccctttgcagctgcgat

SEQ ID NO: 16722 - DNA, 214 bp, Homo sapiens
aattgtgatgctgttgggaaaccctgatctaaagaaacatcaggccgggcgcggtggctcacgcctgtatgggaggccgaggcgggtggatcacgagggattccaatgttggaagcatttttagcgtacaacaacatccaagtggattactatgaatgcctagacctctatggcaaacagtctcttcgtggcctgtgctgaggactacatcagt

SEQ ID NO: 16723 - DNA, 485 bp, Homo sapiens
agatccaagatacccaggaaacccaagctgtgcaactaaaatccacacatggacacactacagtcaaactgcaaaatactaaaactgagaaagttaaaaacagccagtgaggagtcacaccacggacaaaggaacaataattagctaactggcttcccagcagcaaatgtcaaagccagtagaaracaaaggaagaataccttcattgtactaggagaaaatgctgtcaacctagaactctttcaagaccagggtaattttcatacctaagagacatataagagatttaccaacaacataccttctcaatggaaattccaattcattttagatggaagggaaattatctcaagaaaagactgaaatgtgaaacataaaagctgactgtatgctgggaataaagttagcctcaacaaatttccaggtacagtattgattttaattaggctccmtgatcacaatgcaatcaagttagaaatcaccaa

SEQ ID NO: 16724 - DNA, 458 bp, Homo sapiens
agatccaagatacccaggaaacccaagctgtgcaactaaaatccacacatggacacactacagtcaaactgcaaaatactaaaactgagaaagttaaaaacagccagtgaggagtcacaccacggacaaaggaacaataattagctaactggcttcccagcagcaaatgtcaaagccagtagaasacaaaggaagaataccttcattgtactaggagaaaatgctgtcaacctagaactctttcaagaccagggtgaaacataaaagctgactgtatgctgggaataaagttagcctcaacaaatttccaggtacagtattgattttaattaggctccctgatcacaatgcaatcaagttagaaatcaccaacaagaaagagaaaaacccaatacatttggaaattaaagacaattctgacaacttgtaggttaaagacaactctttaaagtctcaga

SEQ ID NO: 16725 - DNA, 373 bp, Homo sapiens
agatcsaagatacccaggaaacccaagctgtgcaactaaaatccacacatggacacactacagtcaaactgcaaaatactaaaactgagaaagttaaaaacagccagtgaggagtcacaccacggacaaaggaacaataattagctaactggcttcccagcagcaaatgtcaaagccagtagaaaacaaaggaagaataccttcattgtactaggagaaaatgctgtcaacctagaactctttcaagaccagggtaattttcatacctaagagacatataagagatttaccaacaacataccttctcaatggaaattccaattcattttagatggaagggaaattatctcaagaaaagactgaaatgaaaagg

SEQ ID NO: 16726 - DNA, 581 bp, Homo sapiens
agtcttgaatgagggagccccactgtgggagcaccgtgttccctggggacccaagagaatcctcccctgctgggtggcagagacaggcacaaggatagactgtctcactgtgcgctgctcccccgcagattccaggacctgctcctctgttttcttcagggtcttgctttgttcttctctatctcttcttcccaccactggaggtgtcccagcctcctttctcctcttctctattcttttcttttttctcctcttctctgtggcaggtgcctcaggtcagaagccacagtctgcacagagcaggctgtgctctcctgaggaacccccctaacaccgtttggtctcttccgtcactgctctgaggacaaatctctttgcacactttgcatactttactaacagagaatgctgactgctgatacgatattattctggtgtgaaagtgggtgtctttaattaattttaatgacggattctcaaaggtacatcagcaaaacagtctgatgaaaatggggaggctgcctatgatctgccagctgaggactggatagttgcaaacaaagatctgattgacaagacga

SEQ ID NO: 16727 - DNA, 474 bp, Homo sapiens
ctgacacctaggccccgggggtggctctgcraagtcgtaggcgagcgtaatgaaagcaaagatagcaaattgtaaggagggctttgacttttgtcatcttctgaatgacgcacagctgatgtcatcctaattaagcgcattcactcctagtctctggaaatgcaaatcaaatatgcgagatgcggcactgcatttttaatgttgaccataatgtaatgattgaagcaaatttttatttaattttcgagtctgcacctattttggccaagtaaagacagtaaaatagggagagcctcctgaggatctgaatttattgccctggcacataatttttagctctttctccctttgtctcataaccatgtccaccaacgagaatgctaatacaccagctgcccgtcttcacagattcaagaacaagggaaaagacagtacagaaatgaggcgtcgcagaatagaggtcaatgtggagct

SEQ ID NO: 16728 - DNA, 492 bp, Homo sapiens
ataaatgtagttaaagaactactcatctctttcctagattggatatagagggtttttttgaaaacccttggaacacaatttttatttgctttctttgctacagtagtaccaaagcagtagatttaaattagacggtagtctaatagacataaagtagtagatacgaagtagatttaaattagagattttaaaacagtgtatttttatgtaagtagcttagccaaaaataaaaaaaattacatatgtacttggaataaactgatttggaaagtaaaatggtattatctttatttggtaaacttagaatcactttttttccttaatgaaaatatttctaaaagcatcaaagagattctagatatgtgaacttccatgtaaataatggtcattatttacaattaagaaatcctggccgggcgcggtggctcatgcctataatcccagcactttgggaggccgaggtgtgtggatcatgaggtcaagagattgaga

SEQ ID NO: 16729 - DNA, 381 bp, Homo sapiens
ctttctccccgccctgccgccgccccggggcgcasgcgcacgcaatcgcgtttccggagagacctggctgctgtgtcccgcggcttgcgctccgtagtggactccgcgggccttcggcagatgcaggcctggggtagtctcctttctggactgagaagagaagaatggagaagcccctcttcccattagtgcctttgcattggtttggctttggctacacagcactggttgtttctggtgggatcgttggctatgtaaaaaacaggcagcgtgccgtccctggctgcaggggctgctcttcggcagttctagccggccctgggtgcttaccagctgtatcaggatccaaggaacgttttgggggtttcctagccgctacat

SEQ ID NO: 16730 - DNA, 485 bp, Homo sapiens
gcatttccggcgacacctcgcagtcattcctgcggcttgcgcgcccttgtcgacagccggggccttcgtgagaccgctacatctggtaccttggctggcattatgggaatgaggttctaccactctggaaaattcatgcctgcaggtttaattgcaggtgccagtttgctgatggtcgccaaagttggagttagtatgttcaacagaccccattagcagaagtcatgttcccagcttagactgatgaagaattaaaaatctgcatcttccactattttcaatatattaagagaaataagtgcagcatttttgcatctgacattttacctaaaaaaaaagacaccaaacttggcagagaggtggaaaatcagtcatgattacaaacctacagaggtggcgagtatgtaacacaagagcttaataagaccctcatagagcttgattcttgtatattgatgttgtcttttctttctgtatctgtaggt

SEQ ID NO: 16731 - DNA, 426 bp, Homo sapiens
cgacgtcccgcctttctccccgccctgcsgcggccccggggcgcacgcgcacgcaatcgcgtttccggagagacctggctgctgtgtcccgsggcttgsgctccgtagtggactccgcgggccttcggcagatgcaggcctggggtagtctcctttctggactgagaagagaagaatggagaagcccctcttcccattagtgcctttgcattggtttggctttggctacacagcactggttgtttctggtgggatcgttggctatgtaaaaacaggcagcgtgccgtccctggctggcagggctgctcttcggcagtctagccggcctgggtgcttaccagctgtatcaggatccaaggaacgtttggggtttcctagccgctacatctgttacttttgttgggtgttatgggaatgagatcctac

SEQ ID NO: 16732 - DNA, 433 bp, Homo sapiens
acgacgtcccgcctttctccccgccctgccgcggccccggggcgcmscgcacgcaatcgcgtttccggagagacctggctgctgtgtcccgcggcttgcgctcccgtagtggactccgcgggccttcggcagatgcaggcctggggtagtctcctttctggactgagaagagaagaatggagaagcccctcttcccattagtgcctttgcattggtttggctttggctacacagcactggttgtttctggtgggatcgttggctatgtaaaaacaggcagcgtgccgtccctggctgcagggctgytcttcggcagtctagccggcctgggtgcttaccagctggtatcaggatccaagggaacgtttggggttttcctagccgctacatctgttacttttgttggtgttatgggaatgagatcctactacta

SEQ ID NO: 16733 - DNA, 316 bp, Homo sapiens
agattccccgccgcgttccctggactcaggagctcgccgcgatgycccgccccactctccacccgctgaatgcagggcgcatgctgctacttggcggctcaagccccgcccgcaccgtccccattctctgaccgcccctstcccggtacactgcgcaggcacaacagagccgctccchtctcctcgccccgccaccgggacgagagcgcccgccgctgcatttccggcgacacctcgcagtcattcctgcggcttgcgcgcccttgtagacagccggggccttcgtgagaccggtgcaggcctggggtagtctcct

SEQ ID NO: 16734 - DNA, 460 bp, Homo sapiens
attttcccatctttcttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtagagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtgaaaaaaaaaaaaaaaa

SEQ ID NO: 16735 - DNA, 331 bp, Homo sapiens
aatcgcgtttccggagagacctggctgctgtgtcccgsggcttgcgctccgtagtggactccgcgggccttcgsagatgcaggsctggggtagtctcctttctggactgagaagagaagaatggagaagcccctcttcccattagtgcctttgcattggtttggctttggctacacagcactggttgtttctggtgggatcgttggctatgtaaaaacaggcagcgtgccgtccctggctgcagggctgctcttcggsagtctagccggscttggtgcttascagctgtatcaggatccaaggaacgtttggggtttcctagccgctacat

SEQ ID NO: 16736 - DNA, 298 bp, Homo sapiens
cacttagagcaagatggcagcccgcgtccctgtgtgaagccgtctgcagcagctgccagagccctgcttgctgtttcctttmtcaccasccacctcacccggaaatcccctgagtcttgstttgtcgcccaggttggagtgcagtggcacgttctcggctcagtgcacctccgcctcctgagttcaggtgattctcctgsctcagcctccctagtagctgggattacaggacaaggagagggacaaattccttcttggsatccttatggccstgtgacctgctaatgaatgctgactc

SEQ ID NO: 16737 - DNA, 527 bp, Homo sapiens
cttcacctcagcacaaaaacagctggcctcatccatcatgtgtagccgattcagcttctctgggaaactccaaaaccctctcaaagggtcctcaacctctgccctcaaaccactatcgccgtgaggatgacgatgacaatgacaatgctgatgacaatgatggcctgtgtgcaacatctgctggccttcccagaggctctaccaggaatcccccacagcctgggacttctgctcctggaaacagttaaggctttggcaagaggctctcccacaaggcaattsgatctcccctgtctgtctgtragggttcggggcactgctgtggcacgccagacgcagcagctactttctgtgaacagcctcctcataaatgtcagtcctgttggggggtggggagggggccttgatttattatatagcttttggacagttcctacagaaatattgccaaacagtggaataatcaactctttcamtcaagccccctcagacttttttttaatgaaagaataaagtacgcaatgagc

SEQ ID NO: 16738 - DNA, 128 bp, Homo sapiens
atactctggtttctcttcagatcgtataaatctttcgccttttactaaagatttccgtggagaggaacaactctgagtcttaagctaattttttgaggccttgaaaaaaaaaaaaaaatgcgaaaagc

SEQ ID NO: 16739 - DNA, 116 bp, Homo sapiens
tactctggtttctcttcagatcgcataaatctttcgccttttactaaagatttccgtggagaggaacaactctgagtcttaacccaattttttgaggccttgctttggcaaggcta

SEQ ID NO: 16740 - DNA, 146 bp, Homo sapiens
atatactctggtttctcttcagatcgcataaatctttcgccttttactaaagatttccgtggagaggaacaactctgagtcttaacccaattttttgaggccttgctttggcaaggctaaaaaaaaaaaaaaaaaaaaaaaaaaaa

SEQ ID NO: 16741 - DNA, 292 bp, Homo sapiens
gacaagaggatgggactgcagttgtggctgccaggttggagtgcagtggcacgattctcggctcagtgcaacctccgcctcctgagttcaagtgattctcctgcctcagcctccctagtagctgggattacaggacaaggagagggacaaattccttcttggcatccttatggccctgwgacctgctaatgaatgctgactctgagttgctactagaatttggtttctttgtggcttcccaggaattgtgagctatgttggataaggacctgsaaggaaggaatgaggaagc

SEQ ID NO: 16742 - DNA, 565 bp, Homo sapiens
tctccacaggctctccgagagcgccgcgccacgaggtgtaactggagcaagaaagaggaaaaacaggaatacctgtgagaggaacccaagtacatgcagtgcacagaagagcaagtcacttgacttgctggcggccaccccgttaatctgcagcagagcctggacttcagtctgcatctgtgaaacccagcgcatgggtgcgttggtcaccaccgcacagcctccccgtcagacacccacgtttcgccaaaaatttattcaaataattactcctttgcttgttcctttcccaccgcccacttctgacatttttattcaaaagtaggaaatagaagagaaatatgtttgagtgctggtctgctgtgacttcattgaccttttaaatcctcaccatctagtacctaagcacagcgagttggacaaactctcacagtattcacaaagtaaattgccacaacctcatcagctcatccaacacttgtccatgcttttgattttgtccttcttaaaatgtacccttcttaaaataaaccactttatagacttgtaaaaaaaaaaaaaaatg

SEQ ID NO: 16743 - DNA, 342 bp, Homo sapiens
accttttgaacaagatttcctgtactgtggagaacagttctaagcctgttaagctaccattagtaactaaaaacctgtatttaggaggcatgttatgctccaagggtgtgaccattgcgaccactcctatctgacgtgctcacatttcactatttcatacatgtggcaaagaaaaacaggaatatgagaagaaactcaatcggtttcaagacactgagaccccatatgtgggggtgaagtctccaaatcaacaccttttagataattaatataggtttataaccccttatctgaaaccctagagttttgaactttcagggttttggaatttttaaaaaaaaa

SEQ ID NO: 16744 - DNA, 432 bp, Homo sapiens
  misc_feature 428: n=a, g, c or t
acttccggtagagagtcccaaacggccagcggtgggaatttgcggtgggaaggatacgagcaagataaagcagcgagggatttaagtctggcaacagttggactgctggattttcagagaagtgttccccaaagcaaattatagtgctaatttccaatgttccataagcgtggcaagaaraatgggaaatycycggtaaggtatatagtattatttctagaaataaagatkaaccaatccaatattgattttttgtttgtttaatcctggcagtattcttaactaaattgtattcattcttccctttactttccagactttttaattttatttatttttttattttttgggacagaggttgcagtgagctgagatagcaccactgcactccagcctgagcgacagaatgagactccatctcaaacaancaaa

SEQ ID NO: 16745 - DNA, 536 bp, Homo sapiens
aatgacttatggacatcttcacatagatatcacacagttaccttaactcaacaagtccaaaacctaactcctcccttcctctgcaagtctgctccatgttcatcccatagtgatctggattatcatcctgtggaactggccccaaaagctccatagaagtgtcaggaccaagaacaacttcagctccatcaaacaaaccagaaagtcctcctttggcctaaaagacattggagtagagacatgtgagaaaagacagaggcactgactttgacaagttaacacatcatttcaaacaagttcctaaatttacattctcctctggagggtcatgatcaatgtgcaacaaagcctttactatttgttcagctttgcagatgatgaaaaacaggagaattacttcagtaagatgaaaagttatgctcataaattttggtaattatgaataagagataatttcatgcatagatcagtttaattctgccttttactagtactaacttcttgtcattaaaataaacttctaaaaaagtagccaa

SEQ ID NO: 16746 - DNA, 498 bp, Homo sapiens
ctttttcaggttcccgtactgacgtgtcgaggtggtcgcatcccggcgtagaggactaggaatcgggagtcactggccgtatgctggaggctggagacgcgggasyggcttgcctcgctgcggttgttggcagcgatggagatggcgcggctggagaggaggcagcactcggggaagcagcaccaaggcaggcatcgtcattctgcatatgcaggccttgactggcagcagagctcactgtcctgagtgctgcctcctggtcaaggagaagtgcagagagtaaggtgtccttatgttggaaactcaagtggaaggaagatttggtttggttttattctcagagccattaaacactagttcagtatgtgagatatagattctaaaaacctcaggtggctctgcttatgtctgttcctccttcatttctctcaagggaaatggctaaggtggcattgtctcatggctctcgtttttggggtcatggggagggtagcacca

SEQ ID NO: 16747 - DNA, 461 bp, Homo sapiens
atttttggcttttctgtattggtgtgcggggctgctacgtgctcggcttagagaattagaagggtccgtctctttttgcccactggagtctggcacttggggcactgcctccctgttggtggtggtggtgatggagctgtaggagggaggctagcagtgggagcttctcctgctgggctggaagacaagcagaaggaagaggcaccaccgcatgctggaggctggagccacggcggcttgcctcgctgcggttggtggtgacatcggagaccgcagctacgagctaaagcaagctcagtactactggtgatttggaaagtgccttcatattgtttttgccagttctcacctgagaaccctgcagatgcccatgagaggctgtgcctttacaaggastctcartgatacagctgattttcctccatactctaatccccttcatggctgcagcatcaacagat

SEQ ID NO: 16748 - DNA, 474 bp, Homo sapiens
atatttcctttttcaccacaggcctcagtctgctcccaaatatccctctgcagtttctagaaaaactttctttccaaaatgctcaatcaaaagaaagtttttactccatgagatgaatacacaaatcacaaagcagtttctcagaaactttctttctagtttgtctcagaagatatttcctttttcaacacaggctcaatgcactcctaaatatccctttgcagattctagaagaacagactttctaaattgctaaatcaaaaacaggattaacgctgagagatgaatgcacatatcacaaaccagtttttcagaatgcttctgtgtagtttatatctgaagatatataccctttttcacataggcctcgatgctctaaaaaatatccctttgcatattctaccaaaactgtgtttccaaattgttccatcaaaataaagattaaactctgtgagacgaaaaaaaaaaaaaatt

SEQ ID NO: 16749 - DNA, 503 bp, Homo sapiens
ttccgccaatgggtagattcattcagtgagatgtctgaggctctatggtcggtacatgacagtcgtgaacagtatttcacatacctggtcaatggtactgatttgatcccccttctgatttcttcttttcaacaatgttaataaaattctttcccgttgtcctgctaatgacatatatgtaagcctatttggccagtttaaatatttataaacaaaactagtaagagttgttaatgatttttctgaaaattagagcagattagagcagatttgtagttttcaacggctgaagaaataaatccttctaaatgagccagattaatcgtaagttactgatttttttattgaaattgtatttcattgaattgtatttcattcagctgaatgaaaacaggccaggataaagctaacaagtaggctacctatgtgagtagacacaattaagataaattacattaaggtgtgtgattttatattaggtgtttttaacctgggtctgttca

SEQ ID NO: 16750 - DNA, 530 bp, Homo sapiens
aaaaaaacgataaactagggaaagcgccccattgcctggcacgtggtgggtgcgcaataactgttaggtgactttcctcgagtggcttatcaaagctttacccaagctgagaaacactagagcatcagtaggatgagactctctatggactccttgatctctcccctctaagctctcctctcattgaggactcactggcagtctgttataatatctgaacattctacttcaaatcagccctgcacgttggaagggctggcttctgtccccttgaaggggaagaaagatttgaacataccccagcctgaggatgccactatagcctgcgtgttctcatgtgctaatggctaggagctgtgactttccattgagccgggacccagccagatctcaaaacaaggagccaggagagacacctcaactatgttctccttcaccccttcagtctgttgccggtgcttgcctttgstgagctctactgaaaaccagaagacaagawagttcagcttgatgtactggatgggtccaaa

SEQ ID NO: 16751 - DNA, 794 bp, Homo sapiens
tgccgtgtagtcgccgccgtcgctgccgctgccgctgccgccgtcgttgttgttgtgctcggtgcgctgagctccgcctccgcgascggttccgtccccttcccgccgccgccatgaagtgatgttcaaggaggaccactcgctggaacacagatgcgtggagtccgcgaagattcgagcgaaatatcccgacaggtatccgcctaactatgggacagctttacgagaaggaaaaagatgaagatggattcttatatgtggcctacagcggagagaacacttttggcttctgagggccattgctgggctaggtgcaccgtaactgcttgtgtatcttgtaaatagccagccattttcagttattataccagaacctcttcacatagacctattagtgcatttgtaactggatttatttcttaatatattggaaggttttgtttccttagactagtaaattatcatacagagttttattttgagtttttctttttgtgcattgtcctcatgcctgtattctccaggaaacttgtccttctgaaaatcatattgaatgatatttctatatcgaagtgaggtaggtgcggtattaaagtgaaagggaaggtgatgcatttattctgggttatgcttgaagtgttagatggctaagtattaaaattatccaaattaaatccttagcagtcagaacacttgcttcactagaatatgccaactgccaatcatgttggactgagctaatttgttcctctttctgaaactattaaggtaaataattaacaataaaaattctc

SEQ ID NO: 16752 - DNA, 394 bp, Homo sapiens
tgccgtgtagtcgccgccgtcgctgccgctgccgctgccgccgtcgttgttgttgtgctcggtgcgctgagctccgcgctccgcgagcsgkttccgtccccttcccgccgccgccatgaagtggatgttcaaggaggaccactcgctggaacacagatgcgtggagtccgcgaagattcgagcgaaatatcccgacaggttccggtgattgtggaaaaggtctcaggctctcagattgttgacattgacaaacggaagtacttggttccatctgatatctgtggctcagttcatgtggatcatcaggaaaaggatccagcttccttctgaaaaggcgatcttcctgtttgtggataagacagtcccacagtccagcctaactatggggacagct

SEQ ID NO: 16753 - DNA, 490 bp, Homo sapiens
caattaaaagagtaagccatatgtataagaaaactatgataagagtttgaggattgaatgagtgactgtgttgtcagcatcttatcactgtgggcttactatgatgcctttagaagtcttttagaatgataatctttattttggaagtcagttatccttacatataaagttccaatttagagcagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggraatggt

SEQ ID NO: 16754 - DNA, 488 bp, Homo sapiens
ataattctaacttcctgtcagttgaagacgataattctaacttcacacttaattaaaagacagttgcgattctgcagcatcaaatggctatggcagcagcagcagcacaaacagctcagctacatcatcatcggcatacaggcagccagtcaaaaagtaaaatgaagagaggcaygccaaccactccaaaattttgagtcttgcattactttttgttccttttttaaaaacacaagagcactgaatcaaaagaattgagtttctactttttgttttttttaatgtgtcagtattttacattrctagatgtacaaactttatacagaagcacaaccttatcatttttaaataaaaacagggamatggtttaacaaactagggttggtttgcctaagtcattgctttttaaaaatggtttcactatacataatatatatggaagtgacctaagaaataatagaaacatctttcagaaaaaaaaaaaaaaa

SEQ ID NO: 16755 - DNA, 431 bp, Homo sapiens
tttggtttaaaaaatacttcaagtctcaggcccttaaatctactccagcagcaacagcagctctcccagtttacaccacaacaacctcagcagcccacaacttgtagtcctcaacagccaggggagcagggttctgagcaaggttcaaccagtcaagaacaggccttatctgcatcagcaagctgctgttattaaccttactggagtaggaagttttatgcagtcacaggcagctgtgttgtctcagcttggctctgcgagaacagacctgagcaaagccttcctcagcagagattccagctctcctstgcctttcaacagcagcagcaacagatacaacagttgcgattcttgcagcatcaaatggctatggcagcagcagcagcacaaacagctcagctacatcatcatcggcatacaggcagccagtc

SEQ ID NO: 16756 - DNA, 245 bp, Homo sapiens
acttttatgtgtctcagaatatttttgaggcgaaggcgtctgtctcttggctattttaacctaaaataacagtctagttatattccctcttcttgcaaagcacaagctgggaccgcgagcacattgcagccccaacggtggcccatcttcagcggagagcgagaaccattttggaaactgtaatgtaacttattttttcctttaacctcgtcatcattttctgtaggcaaaaaaaaaaaaaaaaa

SEQ ID NO: 16757 - DNA, 248 bp, Homo sapiens
cacaggatacagtggaaagcacagaccttgggaaagcctgtctagccagggaaggcctcttggaaaaggtgactttctatttaagacttaaagaatgatcctcggccaggcacagtggctcacgcctgtaatctcagcacgttggcaggctgagacgggcggatcacctcaagtcaggagttcgagaccaccttgactaacaaggcaaaaccctgtctctactaaaagtacaaaaaaaaaaaaaaaaa

SEQ ID NO: 16758 - DNA, 222 bp, Homo sapiens
aggacagcctcctggccgccgaagaggccgccgccaaggctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaaaaaaaaaaaaaaagct

SEQ ID NO: 16759 - DNA, 180 bp, Homo sapiens
artcccgctccgtcctcctcgcctgccaccggtgcacccagtccgctcacccagcccagtccgtccggtcctcaccgcctgccggccagccccacccccagccaggctatggttgccaccccaacccaataaaactgatgttactagcctctcaaaaaaaaaaaaaaaaaaaaaaaaaaw

SEQ ID NO: 16760 - DNA, 191 bp, Homo sapiens
agtcccgctccgtcctcctcgcctgccaccggtgcacccagtccgctcacccagcccagtccgtccggtcctcaccgcctgccggscagscccaascccagcmaggctatgggttgcsaccccaacccaataaaactgatgttactagcctctcaaaaaaaaaaaaaaaaaaaaaaaaaaaaaaaaaaaar

SEQ ID NO: 16761 - DNA, 525 bp, Homo sapiens
taattttgagtttcggttttacttgactttcagtacctcccattgctgagccttttgaggattctcttacgtattcataagtgtgattctcatttttccagtgactcattttccttgtatttgctttgaaatttcttgtagttttctcatttcacattctctttgacctaatttttatgcagaagccaataatcaaaagaaatctttgtattcttacagggatacctttccgtaaagatgaataaaatgtgtgttttgatgtgccatttgacattttctgtcagatctgttgaaatctttctcaaatgtctccttctaccttaggcatttaatgatgcttccaaccagatatatcatcttctgaaaatctttcttcttactttggaaattttttcttctcttttgagactcttttacatcttatgttatttgtatttgaatgcttttcttacactctgccctcctctgtacaccagactgtaacttctttgaggaccttaactgatacagaattgctggataaaa

SEQ ID NO: 16762 - DNA, 514 bp, Homo sapiens
gtaccatgtttcttgagagagtagacaaaatgttatttcaaacagatgttattcccaaattaataccaacttaatgcagatccctaaaaaaacaaaaacaaaaaaaacccctgaggattacttttgcaactaaatgcacatggaaaactcaaccagtgagaatgtcaaagaaaaaaatcagtaataggatgggagacatctagttttactatatattaaaacaatattcaaaactagaaaagcagagttttcactgggtgcagtagctcacgtctgcaatcccagcactttgggagtctgaggcaggcagatagcttgcgcctaggagttcgagatcagcctacacaacatggcaagacctggtctctacgaaaagtacagaaattggccagcatagtggtacgcacctgtaatcccagttacttgagaggccaaggtgggagaatcatctgagcttgggaggtgggggtcggtaagctgatttcacgccactgcactccagcctgggcgacgg

SEQ ID NO: 16763 - DNA, 474 bp, Homo sapiens
gtaccatgtttcttgagagagtagacaaaatgttatttcaaacagatgttattcccaaattaataccaacttaatgcagatccctaaaaaaacaaaaacaaaaaaaacccctgaggattacttttgcaactaaatgcacatggaaaactcaaccagtgagaatgtcaaagaaaaaaatcagtaataggatgggagacatctagttttactatatattaaaacaatattcaaaactagaaaagcagagttttcactgggtgcagtagctcacgtctgcaatcccagcactttgggagtctgaggcaggcagatagcttgcgcctaggagttcgagatcagcctacacaacatggcaagacctggtctctacgaaaagtacagaaattggccagcatagtggtacgcacctgtaatcccagttacttgagaggccaaggtgggagatcatctgagcttgggaggtggggggtcggt

SEQ ID NO: 16764 - DNA, 498 bp, Homo sapiens
ccattggatgccgccagctggttgagatggaatataccatgcagcagtgcaatgcatctgtttatatggaggccaaaaacaggggatggtgtgaagacatgctcaactataggatataagtactgatttgtaactttaaaggaattgcatttgtccttaagaataacagagtagttttcaatctggtcactcttttgggccaaacccaagagaattttaagaaatgtttcataggtataaaaaggtgatcgcctattactgacagtctcattgtagctctaaaaagcctaatgtatccactgtggaataaactccatagactcaactcttctggagttcacaatgcctccctacctctattcttgatagtgagccagtatctctaaggaaaggagagccgtatttttagtcatcctagggcaggagcactgtggcatctgaggaagacccagggtacagtattagcatttctttcaaccctaagtatgggcatgtgac

SEQ ID NO: 16765 - DNA, 330 bp, Homo sapiens
atttttccctgagccggcggggcagagcgcagggagctggaggtcggcgcttcctctcgtgcttggtccactgacgcgcggccccgccacgaggagcatcagatctccacctccaccaaacatccacacctgggcaaccacacctgtcactcctgtcctctacctgggatcaccagcctgtcaccgcaccctgccctgcacctgcacctcagcaaggtgaacctcttgctgacggaaagcattccaagtgcatgccttgcctgaactaaccacgttatctatttgcaataaacccatttcttaaaaggaaaaaaaaaaaaaaaygcgaaa

SEQ ID NO: 16766 - DNA, 233 bp, Homo sapiens
aacacgcacgccgggcgycaggtttataaagggagagagcaagcagcgagtcttgaagctctgtttggtgctttggatccatttccatcggtccttacagccgctcgtcagactccagcagccaagatggtgaagcagatcgagagcaaggatgttgcttcagagtgtgaagtcaaatgcatgccttgcstgaactaaccasgttatctatttgcaataaacccatttcttaa

SEQ ID NO: 16767 - DNA, 470 bp, Homo sapiens
agaatattcggttcccagggttacagtatctagatagtaaataattcagggaagttagtggtaagagatttcttgatcatttctactgagaattttatttaacaagcattccttatgaaaaataatatctatgaaaaatttccttcatgaggaacgaaaactttcatttaatgaatgacaagggtatagttttaaaataaagggcaaaaatcaaaggttggtaaacgtgtgatctcagctctggaaaccccattatgcttatgtcaacggtgatgtctgagtgttgaggtttgggaaagactgcttttcaggaagccttggacgctgcaggtgataaacttgtagtagttgacttctcagccacgtggtgtgggccttgcaaaatgatcaagcctttctttcattccctctctgaaaagtattccaaacgtgatattccttgaagtagatgtggatgactgtcaggatgt

SEQ ID NO: 16768 - DNA, 304 bp, Homo sapiens
atttttccctgagccggcggggcagagcgcagggagctggaggtcggcgcttcctctcgtgcttggtccactgacgcgcggccccgccacgaggagcatcagatctccacctccaccaaacatccacacctgggcaaccacacctgtcactcctgtcctctacctgggatcaccagcctgtcaccgcaccctgccctgcacctgcacctcagcaaggtgaacctcttgctgacggaaagcattccaagtgcatgccttgcctgaactaaccacgttatctatttgcaataaacccatttcttaa

SEQ ID NO: 16769 - DNA, 464 bp, Homo sapiens
attggtcctagaaagacacggttgtcctgggagtttgtagtgttaagttgcaacaacaacaacaaaaagcaacaaaaccagcttaggataacactttttgttgcttgttcttaaagatgtctcactatgattaaracccttttcattaatgtagtgaaagccacacaggagttccttcttccaggaggagaataccaagcacatcactttctctctgcatcagtgatgtcaaatacgcatcagaaaatgttcaggttttaggagctgtcctaggtgctgtttcatcattggaagcagtgagaaagataagcactgctgcttgtctggatataggctgaggatgattgagagaagctgtgggaactgacacaagggtctgcataggtcatcctgtgaccctggcgactatgttaccaactgacagacagatctttcactgtatcctagcagggcaggtagtccac

SEQ ID NO: 16770 - DNA, 358 bp, Homo sapiens
atttaagggaaaagtgtgaatgcttatagatgatgaaaacctggtgggctgcagagcccagtttagaagaagtgagttgggggttggggacagatttggtggtggtatttcccaactgtttcctcccctaaattcagaggaatgcagctatgccagaagccagagaagagccactcgtagcttctgctttcgggacaactggtcagttgaaagtcccaggagttcctttgtggctttctgtatacttttgcctggttaaagtctgtggctaaaaaaatagtcgaacctttcttgagaactctgtaacaaagtatgtttttgattaaaagagaaagccaaccaaaaaaaaaaaaaaaaa

SEQ ID NO: 16771 - DNA, 412 bp, Homo sapiens
tgttgttgttgtttgagacggaggctcgccctgtcgcccaggctggagcgcaattgcgcaatctcggctcattgcgacctccacttctcaggttcaagcaattctcttgcctcggcctctcaagtagttgggattgcaggcacccaccaccacgcccgactaattttatgtatttttagtagacacagggtttcaccatgttggccaggctgctctcgaactcttgacctgaggtgatccaccttggcctcccaaagtgttgggactgcargcgtgacactgcacctgacttaatcttagcattcttaatgaagacttacagtacataagccatgatttttttggtcaggcaatcaatagttacttattagtgtctactcaatgcaaagcacctttcttggcattctggaga

SEQ ID NO: 16772 - DNA, 542 bp, Homo sapiens
acttcctacttctttttgtctctgtattctgaatagttcttaccaatcttcaaattcactaattctcttttcaacttcttcttgtgtgttgttaattctatccattgagttttatatttcaattgttatattttttatttctagaagtttgcttagttctcttttaaatatgctaggtttttaaaaaaatagtttcctattccctgaaaatacttggtttttcattttcaaagcatagtcattttatttcctgtaactggaatattacaatatctaaattaattgtatatttgtttctgctctttgttgttttttgctgggtcttgtgcatagtgacttatttccttgtggttcttggttacgtttgtctgtgagttgctttttgtttttccttggaaaattatttttgagttgtcttagaggcctaaagtcaagatgcctttgcctctgactagtgcatagaaacaccatcagtttggaaacaacttaaaattatggkttaaagttttttggactaccttggtgttgtaaatactgtgtga

SEQ ID NO: 16773 - DNA, 418 bp, Homo sapiens
cttttttctttgtagccacctcaggggaagcaacagatcgtcactcggtgttctcaccgaaagcacgtaatcgccggtgtaactcatgttggctggggggcctcccggcgcgcgcggagaggctggggtgcgcccccatgcagcatgcttgtgctcaattgcagggtcctcgttctcgagtgtgcagagggcggtgagagctcaactctcgtccccacctcccamccgcagctccccgggtggktragggatgcwtggactggggatagccaggtgggagtccgtcgctgtgtggcctgtggtctcggagtctgttctcctggagtctcgcatttgcacccccttcttcgcagtccccctcccatagacttgctctgggaagcgcctctgcctccgaccctagccggaaccccttcgg

SEQ ID NO: 16774 - DNA, 256 bp, Homo sapiens
acgagaccagttattcagggtccatttctcttggatgtaaaggagtcctgggtaaaatgtggctgtaacctaaaccaactagtccttgtgatttgtttctgccctctgtgtttcctgttygtcaaatgctaagtgtgtgttttgcagtcatgaactaaagcacaaaaagatgcatgagacattgtagtcatatgtctggtgtgacactttggagcaaaaaccttgcagtggtaaataaaaaatttccaacaaaaaa

SEQ ID NO: 16775 - DNA, 359 bp, Homo sapiens
cttttcagcgcctgcaggttccgggaggtcaggttgtattcctggcgggtcgtctggctgggtgggccccggaggtcgtggctcgggagcagggaggcgtaggggggccggcctgctgtgatgacattccaattaaagcacgtgttagactgctgacgcgggtgatgcgaactggagtctgagcctgcccgagcggastgggagggggctggcgggcgggcgcgcgcacacccgctgatctatcactctcgttcttgtagctcccagccgaggacgtcggatgtcatcgtccttgctgctttgccaccccattcccgtcaataaagtggtttgaacccwmaaaaaaaaaaaaaaaaagg

SEQ ID NO: 16776 - DNA, 132 bp, Homo sapiens
cttttttcagcgcctgcaggttccgggaggtcagctcccagccgaggacgtcggatgtcatcgtccttgctgctttgccaccccattcccgtcaataaagtggtttgaacccaaaaaaaaaaaaaaaaaagc

SEQ ID NO: 16777 - DNA, 253 bp, Homo sapiens
  misc_feature 245: n=a, g, c or t
ctttcagcgcctgcaggttccgggaggtcaggttgtattcctggcgggtcgtctggctgggtgggccccggaggtcgtggctcgggagcagggaggcgtaggggggccggcctgctgtgatgacattccaattaaagcacgtgttagactgctgacgcgggtgatgcgaactggagtctgagcctgcccgagcggastgggagggggctggcgggcgggcgcgcgcacacccgctgatctatcantwctcgtt

SEQ ID NO: 16778 - DNA, 135 bp, Homo sapiens
ctttcagcgcctgcaggttccgggaggtcagctcccagccgaggacgtcggatgtcatcgtccttgctgctttgccaccccattcccgtcaataaagtggtttgaacccaaaaaaaaaaaaaaaaaaaaaaaaaa

SEQ ID NO: 16779 - DNA, 185 bp, Homo sapiens
  misc_feature 111: n=a, g, c or t
ctttcagcgcctgcaggttccgggaggtcagctcccagccgaggacgtcggatgtcatcgtccttgctgctttgccactccattcccgtcaataaagtggtttgaacccanaaaaaaaaaaaaaaaaaaaaaaaaaaaaaaaaaaaaaaaaaaaaaaaaaaaaaaaaaaaaaaaaaaaaaaaaaa

SEQ ID NO: 16780 - DNA, 134 bp, Homo sapiens
ctttcagcgcctgcaggttccgggaggtcagctcccagccgaggacgtcggatgtcatcgtccttgctgctttgccaccccattcccgtcaataaagtggtttgaacccaaaaaaaaaaaaaaaaaaaaaaaaa

SEQ ID NO: 16781 - DNA, 157 bp, Homo sapiens
ctttcagcgcctgcaggttccgggaggtcagctcccagccgaggacgtcggatgtcatcgtccttgctgctttgccaccccattcccgtcaataaagtggtttgaacccaaaaaaaaaaaaaaaaaaaaaaaaaaaaaaaaaaaaaaaaaaaaaaaa

SEQ ID NO: 16782 - DNA, 129 bp, Homo sapiens
  misc_feature 105: n=a, g, c or t
ctttttttttcagcgcctgcaggttccgggagctcccagccgaggacgtcggatgtcatcgtccttgctgctttgccaccccattcccgtcaataaagtggtttngaacccgaaaaaaaaaaaaaaaaa

SEQ ID NO: 16783 - DNA, 140 bp, Homo sapiens
ctttcagcgcctgcaggttccgggaggtcagctcccagccgaggacgtcggatgtcatcgtccttgctgctttgccaccccatttccgtcaataaagtggtttgaacccaaaaaaaaaaaaaaaaaaaaaaaaaaaaaaa

SEQ ID NO: 16784 - DNA, 190 bp, Homo sapiens
ttttcagcgcctgcaggttccgggaggtcagctcccagccgaggacgtcggatgtcatcgtccttgctgctttgccaccccattcccgtcaataaagtggtttgaacccaaaaaaaaaaaaaaaaaaaaaaaaaaaaaaaaaaaaaaaaaaaaaaaaaaaaaaaaaaaaaaaaaaaaaaaaaaaaaaaad

SEQ ID NO: 16785 - DNA, 139 bp, Homo sapiens
ctttcagcgcctgcaggttccgggaggtcagctcccagccgaggacgtcggatgtcatcgtccttgctgctttgccaccccattcccgtcaataaagtggtttgaacccaaaaaaaaaaaaaaaaaaaaaaaaaaaaaa

SEQ ID NO: 16786 - DNA, 140 bp, Homo sapiens; identical to SEQ ID NO: 16783

SEQ ID NO: 16787 - DNA, 213 bp, Homo sapiens
atttttgctgcccggacgcggasagraggctgagagagtcggagacactatccgcttccatccgtcgcgcagaccctgccggagccgctgccgctatggatgatcgagaggatctggtgtaccaggcgactggtccgagcaggctgagcgatacgacsaaatggtggagtcaatgaagaaagtagcagggatggatgtggatagtgtctccta

SEQ ID NO: 16788 - DNA, 279 bp, Homo sapiens
  misc_feature 25,133: n=a, g, c or t
atttttgctgcccggacgcggrvgnaggctgagagagtcggagacactatccgcttccatccgtcgcgcagaccctgccggagccgctgccgctatggatgatcgagaggatctggtgtaccaggcgamstgnccgagcaggctgagcgatacgacgaaatggtggagtcaatgaagaaagtagcagggatggatgtggagctgacagttgaagaaagaaacctcctatctgttgcatataagaatgtgattggagctagaagagcctcctggagaata

SEQ ID NO: 16789 - DNA, 455 bp, Homo sapiens
atttttcccatctttcttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtaggagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtgaaaaaaaar

SEQ ID NO: 16790 - DNA, 790 bp, Homo sapiens
acaaaccgaaccgtgaatctttgcggtttctctttccagccagcgccgagcgattggggcatctctcgggacaactggcacaagcgccgcaaaaccgggggcmagraggaaagcccytaccacaagaagccggaagtatgrartttggggcgcccccagctgccaacaccmaagatttggcccccgccgcatcccacacagtaccgtgtgcgggggaggtaaacaagaaaataccgtgccctgarggttgacsttggggaawtttctcctgggggctcagagtgttgtactcgtaagaacaaggatcatcgatgttgtctacaatgcatctaattacgagcykgktycgtaccaagaccctggtagaagaattgcatcgtgctcatcgacagcmayaccgtaccggacagtggtacgagtcccaactatgcgctgccccctgggccgcaagaacgggaagccaaagctgactcctkgaggaagaagagatttttaaaacawsaaaacgatctaaaaaaaattcagaagaaaatatgatgaaaggaaaaagaaatgccaaaatcagcaagtctcctgggaggagcagttccagcagggcaagcttcttgcgtgcatcgcttcaaggccgggacagtgtgggccgagcagatggctatgtgctagagggcaaagagttggagttctatcttaggaaaatcaaggcccgcaaaggcaaataaatccttgttttgtcttcacccatgtaataaaggtgtttattgttttgttcccaaaaaaaaaaaaaaaaagg

SEQ ID NO: 16791 - DNA, 280 bp, Homo sapiens
ggagcgagaggctgagagagtcggagmactatccgcttccatccgtcgcgcagaccctgccggagccgctgccgctatggatgatcgagaggatctggtgtaccaggcgaaggcgawgsaggctgagcgatacgacgaaatggtggagtcaatgaagaaagtagcagggatggatgtggagstgacagttgaagaaagaaacctcctatctgttgcatataagaatgtgattggagctagaagagcctcctggagaataatcagcagcattgaacaaaaa

SEQ ID NO: 16792 - DNA, 382 bp, Homo sapiens
  misc_feature 335: n=a, g, c or t
actcaggggctggacgcctcactcccgtttccgagccataaaaggtctaggaccgcttcccccgagccagcagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtagtcatcttggagggtcgtctcaagtattgaacaaaagacggaaggtgctgagaaaaaacagcagatggctcgaggatacagagrnaaaattgagacggagctaagagatatctgcaatgatgtactgtctcy

SEQ ID NO: 16793 - DNA, 281 bp, Homo sapiens
  misc_feature 200: n=a, g, c or t
ggagcgagaggctgagagagtcggagacactatccgcttccatccgtcgcgcagaccctgccggagccgctgscgctatggatgatcgagaggatctggtgtaccaggcgaaggccgagcaggctgagcgatacgacgaaatggtggagtcaatgaagaaagtagcagggatggatgtggagctgacagttgaagaaagnaacctccdmatctgttgcatataagaatgtgattggagctagaagagcctcctggagaataatcagcagcattgaacaaaa

SEQ ID NO: 16794 - DNA, 482 bp, Homo sapiens
cattcaacaaacattggctgttattatattagctattaaaaatttaagtcatttaggtcaatgaaacaggagggtttccagaattatacccaattaattatacatgggaaggtgatgaaggtagcatgtcaaattggtataaaaagatggaatattaaataagtagggatactgtatcagataggaacatatttggttgcaagaaacaaaaattcctgtgattactagcttcactgtgagtttattttttcacgtaataaatccaaggttacataatccataactgatatggcagtttaacagtgttattaagaactcaaggtccatttattgctctattctgccatctttggtgagtggctttcatcctcattgtctcagaaaagttatttcacctctaagtattacatctacatttcaagcaggaagaagatgaagcttaagagaccaaatggagcatgtcagtcaaaggtgtccttatt

SEQ ID NO: 16795 - DNA, 429 bp, Homo sapiens
ttttctttctgacctaatctcctaatgaatacggasacctgtgcaattccaaccaacactctgctcttttcttccttcatagctgtcacacagaggaaacccaagacagcaacatattctggaagccaggtgaggagagtttctaagagggagagagtgaaaaattctgtcaaatgtcaaattcttttcaaggaagatgragcctgagaattgagcactggatttagcaatgtggaagttactggtgagcttgataggagcaaattgggggaaaaaaatgaaataaatttcaattagagtaggttcaacagagagcaggaacagstaaattagaggcaatgataaacagctttttcaaagagctgtgttttgttttgttacttttttttcttaaggtaaggraaagaatgggcattagctacaaagaca

SEQ ID NO: 16796 - DNA, 423 bp, Homo sapiens
ccaccggtgactgcagcttgacatcatagtatatccgtgagtcaagcggctgtgggtttttggctcttgcatctgctatagttctgtctcgggtgccatttgctaactctgttctctgtgtagctgcttttggcasctcctcatctctcttctaatccaccactcacagtcctagagaacagaccacaagttaagaccgtcacctacagaatcccaagggccaaaactgggcagaggacaactccatccttcttacaaaagggcttctccacaagaagcatttccgttagactctagcagtgagataccctgcttcaagaatttctcatggagccagaarcctttgaaatttgcccttatgatcctcaccacckaatcccactcagcagattccagtaccacctggcatcgtgcaggagaaag

SEQ ID NO: 16797 - DNA, 426 bp, Homo sapiens
attgtbmccaccggtgactgcagcttgacatcatagtatatccgtgagtcaagcggctgtgggtttttggctcttgcatctgctatagttctgtctcgggtgccatttgstaactctgttctctgtgtagctgcttttggcasctcctcatctctcttctaatccaccactcacagtcctakagaacagaccacaagttaagaccgtcacctacagaatcccaagggccaaaactgggcagaggacaactccatccttcttacaaaagggcttctccacaagaagcatttccgttagactctagcagtgagataccctgcttcaagaatttctcatggagccagaaacctttgaaatttgcccttatgatcctcaycaycgaatcccactcagcagattccagtaccacctggcatcgtgcaggag

SEQ ID NO: 16798 - DNA, 108 bp, Homo sapiens
acttagggcgggasgacgaggsgccggwtggctttgttctgtctgaggccaggaagtttgaccgckctgccatgccgaaccgtaagccagccggaatgsttastattt

SEQ ID NO: 16799 - DNA, 176 bp, Homo sapiens
acttagggcgggasgcgtgggcgcgttggttttgttctgtctgaggccaggaagtttgaccgcgctgccatgccgaaccgtaagccagccggaatgcttactatttcttcgtgcaggagaagatccccgaactacggcgacgaggcctgcctgtggctcgcgttgctgatgccatc

SEQ ID NO: 16800 - DNA, 134 bp, Homo sapiens
  misc_feature 14: n=a, g, c or t
acttagggcggganvscgtgggcgcggttttgttctgtctgaggccaggaagtttkaccgcgctgccatgccgaaccgtaagccagccggaatgcttactatttcttcgtgcaggagaagatccccgaactacg

SEQ ID NO: 16801 - DNA, 175 bp, Homo sapiens
acttagggcgggagcgcgtgggcgcstgttttgttctgtctgaggccaggaagtttgaccgcgctgccatgccgaaccgtaagccagccggaatgcttactatttcttcgtgcaggagaagatccccgaactacggcgacgaggcctgcctgtggctcgcgttgctgatgccatc

SEQ ID NO: 16802 - DNA, 175 bp, Homo sapiens
  misc_feature 14: n=a, g, c or t
acttagggcggganccgtggggcgcgtgttttgttctgtctgaggccaggaagtttgaccgcgctgccatgccgaaccgtaagccagccggaatgcttactatttcttcgtgcaggagaagatccccgaactacggcgacgaggcctgcctgtggctcgcgttgctgatgccatc

SEQ ID NO: 16803 - DNA, 174 bp, Homo sapiens
  misc_feature 14..16,26: n=a, g, c or t
acttagggcgggannncgtgggcgsngttttgttctgtctgaggccaggaagtttgaccgcgctgccatgccgaaccgtaagccagccggaatgcttactatttcttcgtgcaggagaagatccccgaactacggcgacgaggcctgcctgtggctcgcgttgctgatgccatc

SEQ ID NO: 16804 - DNA, 175 bp, Homo sapiens
acttagggcgggasgcgtggggcgcstgttttgttctgtctgaggccaggaagtttgaccgcgctgccatgccgaaccgtaaggccagccggaatgcttactatttcttcktgcaggagaagatccccgaactacggcgacgaggcctgcctgtgstcgcgttgctgatgccatc

SEQ ID NO: 16805 - DNA, 214 bp, Homo sapiens
  misc_feature 16: n=a, g, c or t
acttagggcgggasgncgaggsgccgtggctttgttctgtctgaggccaggaagtttgaccgcgctgccatgccgaaccgtaaggccagccggaatgcttactatttcttcgtgcaggagaagatccccgaactacggcgacgaggcctgcctgtggctcgcgttgctgatgccatcccttactgctcctcagactgggcgcttctgagggagg

SEQ ID NO: 16806 - DNA, 241 bp, Homo sapiens
  misc_feature 16..17: n=a, g, c or t
acttagggcgggabgnncgaggsgccgtgctttgttctgtctgaggccaggaagtttgaccgctctgccatgccgaaccgtaagccagccggaatgcttactatttcttcgtgcaggagaagatccccgaactacggcgacgaggcctgcctgtggctcgcgttgctgatgccatcccttactgctcagactgggsgsttctgagggaggaagaaaaggagaaatacgcagaaatggctcg

SEQ ID NO: 16807 - DNA, 175 bp, Homo sapiens
acttagggcgggagcgcgtgggcgcgtgttttgttctgtctgaggccaggaagtttgaccgcgctgccatgccgaaccgtaagccagccggaatgcttactatttcttcgtgcaggagaagatccccgaactacggcgacgaggcctgcctgtggctcgcgttgctgatgccatc

SEQ ID NO: 16808 - DNA, 447 bp, Homo sapiens
accgggagcgtagccttttggcctacgcagcagccgcccgctccgctgcgcccggggaagggacaggggccgcgctgggcacccatatggcggaggaacccggcacgtagaggagttggacctaagaccgcgatcactctcacctcgcagagcccagctacgggcccgcagtctccgccgccgccaccacaccggcatgactaacggctcttcgcgcttcttcctccctcgccggtcgcgcgggaaaggaagagcgacatcggaagacagctcttaggcactccggtggccccgcctcttccgaatcctgactgcaaagcactgggcttgatgctggagcagaaaggcttatgatcttgttgccagaaagaatacacatgaaagcatatgattaaacaatctactcacttaaagataggtcatctctcctcaaaaaaaaaaaaaaaa

SEQ ID NO: 16809 - DNA, 457 bp, Homo sapiens
aaaaagatggcggcttcctagtgagtcggcggctgatttagaaggaggttcaggctacggtgagccgaagccacacaggagccatggaagtggcagagccagcagccccactgaagaggaggaggaggaagaggagcactcggcagagcctcgcccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggctccaaaaccaacgccctcaatgtctccaga

SEQ ID NO: 16810 - DNA, 400 bp, Homo sapiens
acgcacgtccgggcgtccagttcggggcagcttctccggctggtgggtgggtggggcagcctttcaggcagggtggcaaccaactatatctgaggaccagagccattttggggcaccagagcttgtgacctctccatctccacccagctgggtccaggggccactctcagcactcacctcagcagctgacatcataaagcagacttgggaacctggaagcactctggagaacctttccctgagacatggagctttggggccgaatgctgtgggccctcctgtctggcccagggaggaggggaagtacccgggctgggccttcagctcatggcaaccccaaccamctctggctgggttatccagtgccatagaactggkcagccactggactggggtcttt

SEQ ID NO: 16811 - DNA, 528 bp, Homo sapiens
catgtcaaaatgttctgcctctataatgataatagatggttttgtctttcaggatatttatccacctactgtcttctttgccttaaagggacacttggccatcatttttaggctcgaacttaacactgttaagaaataactgaaatatgatggtatttacattaatttttgaaattcaatggtgggatagaattaggtcaggaaatggaagttgttccaatggtgtgagaactaggagacaagatgattcactttattatttaaaccaagcttcatttttagtttttgttgtttaaatggactggaaagttaagtttttgcagggattgttttgaaataaagagatatgctaactcacagatgaactttgttaagacccctttatttttatataaagtctaatatttgaaaagcgattgttataaagtaaaattctctcttcctattctaatatatatcatatatttcaggcttctattttgaaaacaggtataagagatgatatgatacaaccctatagataatgtt

SEQ ID NO: 16812 - DNA, 190 bp, Homo sapiens
  misc_feature 54: n=a, g, c or t
attttttttttttcattttttsagttgtactaartggctgaaggttccctgggnacttgtgcagccctgggggatctgatgacaaagcagaggacccagaaattcggctgagaacagcggctcccggcctcactcctcggggtcccttgtattattttsagtccactgacsttcsattttaaaaaagcct

SEQ ID NO: 16813 - DNA, 266 bp, Homo sapiens
attttttttttttcattttttcakttgtactaawtggctgaaggttccctgggtacttktgcagccctgggggwtctgwtgacaaagcagaggmcccagaawttcgkytgagaacagcggctcccggcctcactcctcggggtcccttgtattattttcagtccactgaccttccattttaaaaaascctgactgccttttatgaaaaaaaaaaaaaaaaaaaaaaaaaaaaaaaaaaaaaaaaaaaaaaaaaaaaaaaaaaaaaw

SEQ ID NO: 16814 - DNA, 214 bp, Homo sapiens
attttttttttttcattttttcagttgtactaaatggctgaaggttccctgggwacttgtkcagccctgggggatctgatgacaaagcagaggacccagaaattcggctgaraamagcggctcccggcctmaytcctcggggtcccttgtattattttcagtccactgacctdvvattttaaaaaagcctgactgcctttatgaaaaaaaaaaw

SEQ ID NO: 16815 - DNA, 574 bp, Homo sapiens
caatgagcagtggtgtccatcacatatattatagaagcaagcgaggacattccaccctagaaatggttcagaaactcataggcacccttagctgatggaaacaatcaatatatttaatacgcttagaatcagttttactccaatcagctggcaattttgagctgccggttatacaccaaaatgttctgttcagtacctagctctgctcttttatattgctttaaatttttaaagaaattgtattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatagggatgtttttgtaagttaattttctaagactttttcacatccaaagtgatgctttgctttgggttttaactgtttggccacggcgggggtgggggcggggggttggtacagaaacttgaagctgtttgtgatatgtacaactcagatgtttctcattaaaaaacaaaattagccagaaaaaaaaa

SEQ ID NO: 16816 - DNA, 506 bp, Homo sapiens
attaccgccggagccgccgagagccttagccgacggaaactggacactggaccggcagcgccatgagactcctcccccgcttgctgctgcttctcttactcgtgttccctgccactgtcttgttccgaggcggccccagaggctcgttagcagtggcacaagatcttacaggatgaagaaacagtagaagattccataattgaggatgaagatgatgaagccgaggtagaagaagatgaacccacagatttggtagaagataaagaggaagaagatgtgtctggtgaacctgaagcttcaccgagtgcagatacaactatactgtttgtaaaaggagaaggtaatacagaagtattagttttaattcagatgtaggcattttaaaacaatgagcttgktcatatatatctgaatacccatatctgtaaagtaatattgktggcatttaaagggaatacgtaggtgatatagacacaataaaaaataaaccmaaaaaaaaaaaaaaa

SEQ ID NO: 16817 - DNA, 455 bp, Homo sapiens
ttacattgctgggtgcggtgacagatgataaagcagatgaaagtgtccttttatcaaataattaattcactcatcagcatttatcaggtatctgcagtgtgctgaggagtgtgctgcccagagaccaatgggacaggaagagctcctagcctgtttgtgctgagataatgtaagcagtgtgcagtggctcatgcctgtaattccagctactcaggaggctggggtgggaggagcacttcagcccaggagattgaagctgcagtaagcagcgattgtgcctgggtggcacagtgggaccctgtctttatatataaataaataaaaagattggatagatagatagatagatgctagatagataaaaattaatgtttaggaagtactgttctaatcaaaaattaaaattaaaaaaaattaaaaaattaaaaataaatagatcagacaaaaaagattta

SEQ ID NO: 16818 - DNA, 290 bp, Homo sapiens
cagtttgctttagttagaacctctgaaacaatgttgaataatgatcccgggctgtttctgatatgcgtggaaatccgcatgtgagagttgagcggtgagagtttcggcaagtggcttttaaaatgttggggtttcctttagtttgtcttgcggctgctgggactcaccggtagttgccagtcctgcctgagttgggcgccagggggcagcagtcacacagaatgaaacgtgggctgtgcccctggaaactggctgaattttgtcaaatgcctttacaccttctataaaaa

SEQ ID NO: 16819 - DNA, 270 bp, Homo sapiens
  misc_feature 264: n=a, g, c or t
cgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttmynhagggc

SEQ ID NO: 16820 - DNA, 524 bp, Homo sapiens
aaagtttgaaatgatgatgaaataagagaaagacattaaaaagatgggaagaatttgccaaaagtcaaagtaggagacatccatctaactaccatacattgccctcaagtctcttccttctcagccttgacctggccccccatcctttttgaattttgaggcttacattatatttacatttaatcctcacaattaccctgtgtgctgagtgttgtgattctcattttatggttgaggaaatcaaggctcacaggagttaaataacttgcccagggccatgtagctatttagtagcttctcagccttgacctgmctcctacactggaatggtccaacttagctcctttcccactcctccttcattttagaaactctactacatatcttttgcccatagcaaaaatcacagttccctgtcaaatttcaactttgtctcctcatctcaggtctccacccagtcttgactccattcctgcctcctcttttcatctctctgcttttgccagagttactggactttatgc

SEQ ID NO: 16821 - DNA, 559 bp, Homo sapiens
caataaatagtaacagcattcaagtatgaagttaagtgtagtgagtaactttagcaaacagctgtgaattttgagaaattaattttttgatactgaattaacctctttggagtttggaaagcagatgaatgatattagtttctgccttcgctagcatgcctttgttttgtccaccagagaacgatcagttcatggttcactcctgtattagaccattcttgcactgctaaaaagaaacacctgagactgggtaattgataagacaagaagtttggccaggcacggtggctcatgcctgtagtcccagcactttgtgaggctgaggtgggatgaccacttgatgtcaggagtttgagaccagcctggccagcgtggtgagaccctgtctctactaaaaatgcaaaaaaattaaccgggcatggtggcacgctcctgtggtccaagctactcgggaggccgaggcaggagaatcgcttgaacccaggaggcagaggttgcagtgagccaagatagcaccactgcactccagcctgggtgacagagcgagactccatcacaa

SEQ ID NO: 16822 - DNA, 504 bp, Homo sapiens
agtaaagattaaatgtgcttctcaaaggcagccacttcatgctgctatgtcgaaagggccattattattattatattttaatggtaaaagagaaaaggagagaggttgagcgagcgagagagaagctaggtgtgatgatgacagactagcttttctgagaggaaaaggaaaagggaagggagagaaaaaggagagcctctgagctcaacggaggattgtgcctgagaagaacccacagaggtgagaaaaaagttgtcttgaaggtgggggtgggggggctgctaaacagacactgtacagagggagaagagacataatttagctgtgttgctagtatgattccatttttaaaggaggggagggggagagtctagagctctaactgtttttagttgcatatggaaatatctaaaaaaatatttagcatttttactaagtgcgttgaggcctctccagtgtcctcctggctgtggctgctttgtcattctctttgactagccagcc

SEQ ID NO: 16823 - DNA, 531 bp, Homo sapiens
acccgcccggaaagttggagcacaacgtcgaaagcagccgttgggagcccaggaggcggggcgcctgtgggagccgtggagggaactttcccagtccccgaggcggatccggtgttgcatccttggagcgagctgagagctcgaggtgagctgggctcgcggtcgcccctctcgcgcgccctctttaagaaccacggcgtccaacctccctggaaatggggggaacatggccgaggcgcgtggcgaggccgcctcgtggaggccccggagcggcatcctcagcgccccagcgatccggtgcccattaggtgcgccttgaagccgaggcaagctccttcggggtgctgggctgcgggcaaagaattcggccctgcgaagagttgggttcggcctgtctcaggcctgcccacatcccatcacagggccgtggacttgaagccggaacgtgaaatccctatagactgaatgcatttccttcctacctgttctctctccccttttatttttatttttatattattttatttttaa

SEQ ID NO: 16824 - DNA, 371 bp, Homo sapiens
gcgccggtcaacgagagcaaacccagtgactcacctccgccgtgctaactcctcgctagctctccctctcacacacgctcacacccggctcgagatggcggcggcggcggcggcggcgggggactcggactcctgggacgccgacgctttctccgtggaagacccagtgcggaaggtggggggcggcggcactgccggcggggaccstgkgaaggcgaggacgaggacgaggacgtcaagttagaagaacccgaagaacctaaagtgctaacaccagaagaacaattagcagataaactgcggctaaagaaakkacaggaagagtcagacctcgaakkagcaaaggaaacttttggtgttaataatgcagt

SEQ ID NO: 16825 - DNA, 405 bp, Homo sapiens
aggatgmcgtcagatacaaatatggcgttttggacgggctcgatagtttgcttggcctctactcaaggaawgctgatggtatagcaagaaggtattctgagcattatatcaatggggaagttmtagatcttttgcaaagcaggagctgccctgttgtgagctctccggtggagagccccacatggcaagaaaatgagaarccccctkmacagacaagagctgaggcccaggatacaatatcctgaaaaaaactgaatcctgctgacagttgcccaagtgaagctggaagtggatctttctgcagtggatccttgagatgactgtagccctggctgacaacttgattgctgcctgtgaaggaccctgaaccagaggactcagcgaaattgtgcccagattcctgac

SEQ ID NO: 16826 - DNA, 448 bp, Homo sapiens
agatacaaatatggcgttttggacgggctcgatagtttgcttggcctctactcaaggaawgctgatggtatagcaagaaggtattctgagcattatatcaatggggaagttatagatcttttgcaaagcaggagctgccctgttgtgagctctccggtggagasccccacatggcaagaaaatgagaagccccctkmacagacaagagctgaggcccaggatacaatatcctgaaaaaaactgaatcctgctgacagttgcccaagtgaagctggaagtggatctttctgcagtggatccttgagatgactgtagccctggctgacaacttgattgctgcctgtgaaggaccctgaaccagaggactcagcgaaattgtgcccagattcctgacctacagaggcagtgagataataaatgctgttgaggtcacaaaaaaaaaaaaaaa

SEQ ID NO: 16827 - DNA, 417 bp, Homo sapiens
aamaatraggatgmcgtcagatacaaatatggcgttttggacgggctcgatagtttgcttggcctctactcaaggaatgctgatggtatagcaagaaggtattctgagcattatatcaatggggaagttctagatcttttgcaaagcaggagcaagctgccctgttgtgaggctctccggtggagagccccacatggcaagaaaatgagaaaccccctgaacagacaagagctgaggcccaggatacaatatcctgaaaaaaactgaatcctgctgacagttgcccaagtgaagctggaagtggatctttctgcagtggatccttgagatgactgtagccctggctgacaacttgattgctgcctgtgaaggaccctgaaccagaggactcagcgaaattgtgcccagattcctgac

SEQ ID NO: 16828 - DNA, 558 bp, Homo sapiens
gtcatcctactttctttttcctggtattttcctctttgggactttggtttcattaatctcaatttgttctgaaggcactaaggcagattttcaaagagctgtaattgtcacagggagagcacaatgacttattgaagtttcacatgttgctctttttggaactaccagagattggaaccaattctccatccacatctctatccgagagttaagttttctcttctctggtgcttgtcaaaagtatttctcccagctaatctcattcccagttgccaaagaaaagatctcaagcataactcctcatctccaggtcacccgacaagatcttgcagttctacttctaagtatgtaatccagagaaaattctgacttgtgtataaaagaagactcattcaataatgtttatttcaaatgaacaaaaaagcagctgaaaaaaatcatgatatattcattgtatagcagtaagaatgaatgaagtaaacctgtatgtagtaacataggaagaaaaaagacgaatcaacatctcccttggaaaatactctagaccaaatttctgct

SEQ ID NO: 16829 - DNA, 476 bp, Homo sapiens
attaaagggaaagcgtgttgtgtgacatggagtcactgagtcattaacctagtcttatgggaatttggcttacaccttatttgtggtcttccaaccttttccttgtgtatcctttccttgtgtatcctctaaaataattttgtaccccctctcgcatagttgtctgaaatttttcatcttcaatttaaggaattgcaaagatctaatttctgttatattgtgtaaagtaagacagttagggctgggcacagtcactcacgcctgtagtcccagcactttgggaggccgaagtggacagatcacgaggtcaggagttccgagatcagcctgaccaatgtggtgaaacgcatctctgctgagaatacaaaaattagctgggcatggtaatgtgcacctgtagtcccagcaactcaggaggctggggcgggagaatcgcttgaacccaggaggcagaggttgcagtgagctgagatcgc

SEQ ID NO: 16830 - DNA, 450 bp, Homo sapiens
gagatagaattgcttttggtaagcttagcagagtcagagagaaaaggagagttcccagaaaacagaaagtggccaaatgattttctggtttccagaaaaggaaaaaaaacttaatttcagaatttacagataaaggaagagtctagtgtgcattattaaaattatagattgtgggccgagcacagtggctcatgcctgtaatcccagcactttgagaggccgaggcgggtggatcacctgaggtcgggagttcgagactagcctgaccaacatggagaaccccgtctctactaaaaatacaaaattagctgggcgtggtggcacatgcctgtaatcccagctactagggaggctgaggcgggagaatcgcttgaacctgggaggcagaggttgcattgaactgagattgtgccattgcactccagcctgggcaacaagagcaaaactccg

SEQ ID NO: 16831 - DNA, 310 bp, Homo sapiens
aaaaaaatcccaaacacctgctctctgaccctgactattgctttgctagcattacacatctwatggtttggctgtwaattcttcatcaccagcaccagagtccaggctggcaaagggctaggaaaccgatcatctgcctcctctamacccagaaccctgtgtggtgacccaaaacaaatggaaagaaccaacctcagatgaaatttgaacccaggtctgtagcctctgcctcctccacagtaggagtttgtgagaatgtccaccaataactgtttattaactaaattcctccacctttccaactcaaaaa

SEQ ID NO: 16832 - DNA, 349 bp, Homo sapiens
aaaaaaatcccaaacacctgctctmtgagccctgactattgctttgctagcattacacatcttatggtttggctgttaattcttcatcaccagcaccagagtccaggctggcaaagggctaggaaaccgatcatctgcctcctctacacccagaaccctgtgtggtgacccaaaacaaatggaaagaaccaacctcagatgaaatttgaacccaggtctgtagcctctgcctcctccacagtaggagtttgtgagaatgtccaccaataactgtttattaactaaattcctccacctttccaactcaaaaaaaaaaaaaaaaaaaaaaaaaaaaaaaaaaaaaaaaaaa

SEQ ID NO: 16833 - DNA, 140 bp, Homo sapiens
agagtttcaaaaggagatcatgaggcgtccaccttgcagtcatgatgtggaacctgctgacttctatttatttcctcgtattaaaaattctgcaaacggcaaaaaaaaaaaaaaaaaaaaaaaaaaaaaaaaaaaaaaaa

SEQ ID NO: 16834 - DNA, 141 bp, Homo sapiens
agagtttcaaaaggagatcatgaggcgtccaccttgcagtcatgatgtggaacctgctgacttctatttatttcctcgtattaaaaattctgcaaacggcaaaaaaaaaaaaaaaaaaaaaaaaaaaaaaaaaaaaaaaar

SEQ ID NO: 16835 - DNA, 291 bp, Homo sapiens
  misc_feature 34,116: n=a, g, c or t
aaaaaagcaggagccctccgtggcagtgcttggntgtccgggcgccgagactccggcctgacctctccatggggtcgaaaggacggtctctggatcccaggagtcgcggaggacgnaccagcatgaggaaaccattggcggaaaatggcaaaascaktgcgamatcccagcctcaactgccgggacgtgtttmaamaggcatttcaawttgtggcttggaytcacgcaaaggccccctcctggttccaaggtgttctatggatttycgttggcatcgatggaaaggtcact

SEQ ID NO: 16836 - DNA, 267 bp, Homo sapiens
gactaatgacatgcttgtcaggtgagtgtgcttttccctctcatgagttcgctgaattaaagggaaagcgtgttgtgtgacatggagtcactgagtcattaacctagtcttatgggaatttggcttacaccttatttgtggtcttccaaccttttccttgtgtatcctctaaaataattttgtaccccctctcgcatagttgtctgaaatttttcatcttcaatttaaggaattgcaaagatctaatttctgttatattgtgtaaar

SEQ ID NO: 16837 - DNA, 459 bp, Homo sapiens
agaaaccactccctggggcttggcaaagcaggagccctccgtggcagggcttcggtgtcggggctccgaggctccggcctgacttctccacggggtccacaggagcgtctccggatgccaggacctgaaatgggccgaccaggatgaggaacccacaggcagaagccggggaagcagcgcggcatcccatcctcaggcctgcccggacggtgttcggatttgatgttttgccattttaaagaatactagacaagaggatctcaatctggatcactatattgggctcctaatatcctgatataattttaaatcatcccaaacaacgcattattaccatatacatcagcatttcccaaactgtgctataagctatgtatactattgatatttttgagctaaaatatacttataaatacataaaaatatatttatctaggtggtgttatgcaataatgcmca

SEQ ID NO: 16838 - DNA, 268 bp, Homo sapiens
caaatctattatgatgtttattaaacacttctgtagcaaagatggtggtagttcttttgttactgaagttgcccttcaccatggctatttgaaaaggagatgtacttggacgtttctgtaaatcttgagataaactgtttggagatttaaccacctctctgatgggggaccaactctatggaaattgtaaatacgttttatttataaacctggcactgtattcaataaacatttctgcagcctttcatctccaaaaaaaaaaaaaaaa

SEQ ID NO: 16839 - DNA, 526 bp, Homo sapiens
agatttgcttggggctggatcccccgcctaccgtttccccgcagccgccggcgcttctggcgcttgtgacccgagcaggaagcccagagagaaaccagaaagacaggaaggggattcctggacttcctttccacatccggcaggaacgcgaccctcctccagctaggagcgcttgtccgggcgcaccaagatgcctgcagcttcaagaagatgtatgggaacagacacagaaactttccctaccagataagcaggacaaagaaacacagactaagagttggcctgtgtggtcacggagtgggttaagagatgataaaaaaatctgctctgtacagatggcacacctggtcccaactaaaccctggggccctagaaagataagacatcccctcctcacaagcccctcctcaagagccccctcctcaagagcccatttataaaaactctgacattcttaactacaacttggcaatcttctcaggatccctctctaacagagacctgttctttcctttttgcctattaa

SEQ ID NO: 16840 - DNA, 515 bp, Homo sapiens
tttatattatttgattacaatgtattatttatggattttttattctttcctttataatgaatagttcgggtgcgttttgtttactcctaaaaggtttctttgcgtattttctaaatgtaatatctcggggaaaatataagaaaagcacgtattagctgaagaatgtaacttgtagtccagctctgcagcttccttaaacttaagaaaaagattgggccagtgacaagaatttaaagacaatgtccaagttgacaattatttttctatagtccatacaaattaaataatctggcaactctggcaaatcgccttgtaaaatgcgtctcattttttaacttgctttmgttttgaaccgcccttgtaatcgcctgaaatcgctagttctttatgcggtggctgccgctgtgttccgttattttcagtaggtgtcatatttatttgtattgcctttgttctgttcgccgctggttttaaaccagcttgctgtgtgcatctcagacgtcggttggtacgtc

SEQ ID NO: 16841 - DNA, 343 bp, Homo sapiens
tgaagaaaaggagcaggatactaggataattctgggtggtcttggggatggcagtatggaatctatacatatagagtagtcagagaaggcctcattgaggagttgttatttaatcagggacctgaagaattaagaggaggctagctagaaagaggataggtgagaaagagcatgatgcttttgacaagacataccaagactcctgtgattgaggcacagggaggaagggtgtaagacaggggtatccaatcttttggcttccctgggccacattggaagaagaaaaattttcttgggccacacattaaatacactaatgatagctgatgagctaaaagaaaaa

SEQ ID NO: 16842 - DNA, 460 bp, Homo sapiens
aaaaacaaaaaaaaacctttgttctgtaagacagtatagaaagttgggagaaaggtctactccaggatcaagacctcctgaaagggtctcgaggaccccaatggttcctggaccacactttgaaaactatggatctgaaaataatttaggattgcattttcctgtaatgccgcgtcttagcaatgtgaccttgggaactggaccaacaggacccaagggagagtatcaaaggcaaaacaaaggaaaatgaggacaacccaatactcagaaaaaaaaacgagtaattcatggattcacaacgggcaacaaactagatgactattaggaagagaagagcaaaccttatgatctcaaaatgatttcttgttcatttgcatcctcgcatcaatctagactttaagaaatatgkgatttttaaataaatgggtatatctgaaaaaaaaaaaaaaatgsgraaasc

SEQ ID NO: 16843 - DNA, 458 bp, Homo sapiens
  misc_feature 405,414: n=a, g, c or t
atttcccaactttcttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggagttcacaacctctgtggtccgtagagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctcttggagtggatcaaactagaactcatatnccatactanatatgtttgtcaataaacttatgacgcaaaaaaaaaaaaaaaaa

SEQ ID NO: 16844 - DNA, 459 bp, Homo sapiens
attttgggaccgacgaatgcgagcaagaggccaagcccctctccacctacactccgtagaaggcaggccccgaagccaggagacggcggagatcaccgacttccagagggtgcgtttctgcaaggtggtggcggcccctccgctgccgggggccgctcgctgaccgcgcccgccggaccgcggcctccgcgctctgcactaacctcccaccgcctcgctcctctgtcctctgcttctgccacactccagccaggagagggttaaatctaargagggaggagccagggtctgcgarccgggcggggccagggcagtagtcgggtgcaggccccaccaacgggggacgtcacggcactgggacggctgggacgcttccgcrttagtctcccatggaggccctgggcggctcgagccaggtcttcaggccgaatctcccgcctccaggattgcatccgaggc

SEQ ID NO: 16845 - DNA, 501 bp, Homo sapiens
aaaaggagccaacctggcctggtgaccttctctgtgcaagcagggagcaggcacacaccaccaatgagtgaagaaggctgctgtggcatgctcgggacctagagggaacctgcctcattgacaggggacagcagctgcacagctccagacaatcgttgtcaaggacgggaatgagattctaacatggctgatctgatttttcaagaaaggtgaaagacccaaattcatggaagagaagtgagtcacacagggagccagtggcagagccaaccccacagagcaatcaacatgctctactctgcagacctgcaacagggagggaagccagactctgatgcaagaaggaaagaccatgtgctggctcagtgtgtgcagcctggactgagctactgaactctaaatccaaggatgactaatgtaagcctaaagggtaatctgcaaatactgctccattaatattcaatgataaatgatattgctttagaatcaaattcacataaa

SEQ ID NO: 16846 - DNA, 471 bp, Homo sapiens
atatccagaaaaaaatgaaaacaagctattttggtcaagggcttatgaaatcatcatcattcttctttccttgaaatatcttttgcttctataataatgctgttggktcaatwaggtaaaataaaggagggtctttagtggtgtttatcttagcagtgtgtggggaaaatatcctccaaagttgaaataaccastgsrattcytycagaaaagtgatagccaagtgaggaaggcaatttgctagcttgacagacacctccctgagaacagtcaactccctggtctgatcacaagctacccaacaaacagggtactatctctgatgctctgcacctgccaggagggctgcccagtgaaggtggcccacctccactctctaggaaaatacatctccaactgcaaaatggcaaaccactgagtcattactggcctttaacaaaagtccggttagagggagctgcttctctagag

SEQ ID NO: 16847 - DNA, 197 bp, Homo sapiens
attccgcgtgcgtaatggcggcttaggagcacgccagacgaagccggasagcggaggcggggtgctgaagggagacgggatggcgggtgtacatctctgccgagttccgtactcttgggcatttttgtggcccaatccagcctaaagcagggttgagatgacggttttcgcgttgmmyttctcggagctgcccgccg

SEQ ID NO: 16848 - DNA, 432 bp, Homo sapiens
agaacctcccgccatattcctctcacctccatcgacctctgccctaccagcgtgasktggagatgtcctctacttacccactagctctcaagaccatacctggttcacagacaactgccaagagacctgcggtgaaccaaccagctgccagccggtccactgtgagaccggcaatcttgaaacctcttgcggttcttccactgcttactacgtgcccaggccttgccaaggaagcagttttcttcctgcttctttcttctccagttcctgccttccagtatcctgtagaccacagaggtatgtgtccagcggctgtcgtccactgaggccgctgctcaatagttascagcccataggagactgtgtgcccaatgcctatcgccccaattctgcttgktcaagagttgccagccccaaaacctcctcacttct

SEQ ID NO: 16849 - DNA, 495 bp, Homo sapiens
agagaatttcagatcagtgattacaagtggggcagtaacttgctaagagtttgcttcctggagagtagatctgtatgtgtgacatcacaggtaagccccaagaatttatttaatcagatttgttcagacgagttactgctgcctacgttagagttagatttcaaggcgagtcagcaaacccatcctttctgctcagtctcccgtactgttctcccaagttctttgttctgggagtcagaacccaagtgcaagaggagggcagaagagtctgatgctgttactttgcgatcctgctcttggtttccactgtccaggccatacaactctgtctactcccattagtatttaccaacaggtgttaaaggaaagctgaacaagcagcctactcaccgatctgctaggtggtcttccatgttcatggtggcttctgcagtttcattgagagtaacattgctgttaatacagatagatccagtagtagagacatcatcggtc

SEQ ID NO: 16850 - DNA, 429 bp, Homo sapiens
accattttcccatgaatgacatcataatagaacctccctgtcttattgccttttcttattggtaacaaaagatgacaaactaggtaatttatattaaaaagtttatttagctcatagttctagaggctggaagtccacagtgccggcatctgtgagggccttcttgctgcctcacctcatggcagagggcatcacatgctcagagtgggagcaagggagccagggagagctcacaggcacaagaataacgctgctgtgataataaacccactcctgggacagcaacattcatcccgtcatgagaacagagccctcattcatycattcatctcatcataggggcagaargattacatttctaacacatgaacttttgggggacacattcaatacctagcactcccaaaatattcactaagagtgagagta

SEQ ID NO: 16851 - DNA, 843 bp, Homo sapiens
  misc_feature 492: n=a, g, c or t
tcgacgacggctggagggacgtttcagaggcgagtcctgggtggctcctcgccttgggggcctcctggccctgaggctggcggtggccgcatgccggcgcgtgtctgtttctgtgcggcggctcagggtggcgcggctgctgctcactgtgctgctgggacccaagagtggggcgtcgcccctgctggccgccgcgtcccccgagattgacccacaataaagcacaggccttaccgcggcgtcaccctctcccactcctttgttctgggtcctttcgggagggctgatgggcagcacaggaggcccgtcctcggggggctgcgcacatcacgctccttgccgggcgtccggcacagctgcggtcaccaaagcaggtgctggccctcggacctgagagcccagccagggcccatgtggtctgcaaatgggagcggctgtttttgaacacggggtcattctgcagtcaggacgaaccggtccccgtcgcagvangttgcacgtgccctgcgccacatcctcacgctcggtggagggacgcgtgcggcgggacggtgcctacgggtacttgcagctgtgtcccatgtggcatcccagagctgcgccctgctggtctctgtgagcgccacgctgctgtgctggaaatgccgctttaaaaagggataccgtgggactctgcccgtctctttcataacgcaatatttatttgtattgggtgacgattgattctttcgacctaacattttgggttttaaccaaataaccggtccaggattgagcagctccgttctgtcagatgctactccaaatgttaccagaacgatgacaaaagtgggagacgctcta

SEQ ID NO: 16852 - DNA, 449 bp, Homo sapiens
  misc_feature 423: n=a, g, c or t
agtcagccattatgataactatgcttcttacacctgagaagagggacatatttcaaactttctggctatcattttgaagaactacaggattcctaaggcagtcagtccaaagaataaatgatcagaaaagacagagaacgaagaaatcctctacgagccccatgggttcacagaagtctatcaatcactctgtcagtcttccggatcataattcaagttgccttccccaattttgttggatatatcagatctactccagctccatgggatgatcagtgtgcttttttcctatttttaaagacagcaaagtggaaaactggtggatattataaggacaccctaaaaagtacmbtgttactatgacaatgaaaaggagagcaaatgtccaaactcttcttggtaaattccatttttctgtttganatattttagttccctgcattaagtgt

SEQ ID NO: 16853 - DNA, 175 bp, Homo sapiens
tttttcttcctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagccacccaaaatc

SEQ ID NO: 16854 - DNA, 409 bp, Homo sapiens
ctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttctgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaactttttttgagta

SEQ ID NO: 16855 - DNA, 517 bp, Homo sapiens
  misc_feature 475: n=a, g, c or t
gtcccggcggctttacaaagcccgcgccasctcggccgcccggcgggacccagagccgccgcggagcttccagcgtccccaggttttataataatcaagaagcacatgaaagaggcctcttcatcaagcattcttgactaagttatgaaaatggaattgaagtttattttcccccttcatatggtaagtccagctgtgagcagagtgttctgttcttcacttccagcaagccaggtcagtgtctttgtgcaaacccatgactatagattggtaacatcctgtgtctaattttgagcatgcatttcagaacaggtttcttaatcatttgtcttttaaaaattttgtctttgacttttttatggactcagttatgaatgtcataagttcaatgattattaaaattattgcttactctgggagtacaatggtacaaatatgggcctcaaaccagtttgtccatcatacgactttttanttttcactttaggcatcagagtggtgcccgtggtgagatact

SEQ ID NO: 16856 - DNA, 275 bp, Homo sapiens
gcattctgaattatttttctaagctctcatatctgcagtaaagatttggtttatttttataaacgaataagagatatatggttagaatgatatgttccaagtcttaatatccgtaacttagtgcaatttagtttgcaacataacatcttggtcctactgtggaaaaggagctctagatttgagcactgaatattttgtaagattttgtgaatttgcaggaccttgactttattcaaatgtgttccaaaattcataagttttttttcttttttttt

SEQ ID NO: 16857 - DNA, 478 bp, Homo sapiens
ttcatgggattcatatgaggaacaaaattaaatttgaatacagtcagataactgccacgcrggcatttggggaacatccccgaatgccctgatgtgatttccctcagaaaatccttgttattagaggagaaggtctgggcaggggcagcagcatctcagacatcaagtcaactttatcatctactacatcagcactgaagtccaggggcattgaggcactaactaggttccattttctttggtttggttacttattttttctttttgggttctcggtgtgcagaggctgtagagagagcctcagggcgtgaccgctgcaggaattcggccctccagctcccctccagttaccaggagccgatttggaggccaggccttcccagctgagtgtctgtcagcttcattctctctcagctgtgcagtggaagagcaacaacagacaggtgaccttcttgggttgtgcttcacaatggactgg

SEQ ID NO: 16858 - DNA, 418 bp, Homo sapiens
aggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttcctagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtg

SEQ ID NO: 16859 - DNA, 436 bp, Homo sapiens
cagattaccttagttattgcgctacccacagtaggacaatattgtaaagcataagagaacctctgaatctgattataaatgaaatagagattacttagaggttatttcttgtctatattgttaatatagaataagagttgactaggtagtcttacatttaaaaatccctgttgtggccaggcatgcgtggtaggccaaggtgggaggatcgcttgagcccaggagttaaagaccagcctgggcaacatggcaaaaccccatctctacaaaaaattagccagatgtagtggcatgcgcctgtggtcccaaccactcaggaggctgaggtgggagaatcgctgagcccgagaggcagaggttgcagtgagccaagattgtgccactgcactccagcctggctgacagagcaagaccctgttcaaaaaaaaaaaaaaaa

SEQ ID NO: 16860 - DNA, 419 bp, Homo sapiens
  misc_feature 367,386: n=a, g, c or t
gaaatacaggtttgctgggtgtggtggctcacgcctgtaatcccagcactttgggaggcctaggtgggcgggtcaccagcccggccgacatagtgaaaccccgtctctactaaaaatacaaaaatcagccagatgtggtggctcatgcctgtagtcccagctacttgggaggctgaggcgggaggatcgcgtgagcctgggaggcagaggttgcagtgagctgagaccacaccactgtactccagcctgggcaacagagtcagactcagtttcaaaaaataaataaacaaacaaaaataaaaaatacaggtttgcagggaggccctgtgggtggggaagcatgggcaaagcattctctcctaatgtngcatgtwaggtagaatgcngcatcttggtcattcttccctttcatcgtttga

SEQ ID NO: 16861 - DNA, 445 bp, Homo sapiens
  misc_feature 417: n=a, g, c or t
acccggaagcgcgcccgggctcctgcaggcggggcgctgtgcggccgcgatccgcatttgcaggaccagggatgctgtgctgctctcccatgagccagtcaccgagtcggtctgctgaagccctttctgaacctctggccgtctggatgctccactgtgcttgccaagatgaagtgcgtcttggtggccactgagggcgcagaggtcctcttctactggacagatcaggagtttgaagagagtctccggctgaagttcgggcagtcagagaatgaggaagaagaggttggcctcttgatgctctgagctcggtgaccccacccccacaccccaccagtcctctctggactaaatgagggcaagaagaagtcgaattttatcacgtaacagaagaacttggagccatcagtttctgtnacctaaaaagtttaacaaggctggggcg

SEQ ID NO: 16862 - DNA, 284 bp, Homo sapiens
agttgttacttaggtgcgctasctgcggasccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacgaccaamtcatamasctcctatggaaaaaactycstaccahtcaccctagcattabdatatgscatgtctccatacccattacaatctccagcattccccctcaaa

SEQ ID NO: 16863 - DNA, 430 bp, Homo sapiens
  misc_feature 413: n=a, g, c or t
taaggctcattctgggttttctgggcaatgaactaactagaactgagagttcctccttcctgtagtggtaggagagtgatggcattttccccccaatactggagatggtccttcccacagactttctgtttccaagctgcttgagcagttgggtttcctagataactcttctaaagcattggcacccacatccagacttcttggggtgccaggcagcccgtgcctgcccccattgagaagtttgcatcactatgctcatcccacaggaggccagattaccatggggacttgcccttccagagcaatagcctggccctagcttgcctccctgtgtgatgatgggagagaaggggactgcctttggtatagtgggttttctttttctccaataaagtctttttctcaagcaaaanawaaaaaawwtgcgaaa

SEQ ID NO: 16864 - DNA, 436 bp, Homo sapiens
agtgacaatcaggaagtcggcgtgtcgagtggctcttcctggctgctgaggcgggttaaggtctgagggtcttgtggggccacggcgctgatcaccaggtgtttggcttggtcggttcttatttctcgcctggcaatggcgacgtacacctgcataacttgccgggtggcgttccgcgacgcgacatgcagcgggcccactataagacggactggcaccgctacaacctgcggcggaaggtggccagcatggcccagtgaccgccgagggcttccaggagcgagtgcgggcgcacgggccgtcgcggaggaggagascaagggctcggccacctactgcaccgtttgcagtaagaagtttgcctctttcaacgcctacgagaaccacctcaagtcccggcgtcacagttgagctggagaagaaggccgtgcaggca

SEQ ID NO: 16865 - DNA, 400 bp, Homo sapiens
tcaattagtttttgacaagttaataaaacagaaaaatgaaaagacatacaaagtccaagtcaaaactttttatcgttagagttaacagccataaaattacctgcaaaattgacatagagttttctactctctctctgtgaacgatttgcaaacagttctcagaagagcccaggtctatagaccatggttagagtactcaaggtaaactactcaaattagaccatactcagctgtagagtttcaaccaaatgagatttgtttggagaacatcatagtctctctcagttgggcgtgctggctcatgactgtaatcccagcactttgagaggccgagtcggtagatcgccagacctcagggcaacatggcgagaccccatctcttaaaaaaaaaaaaaaaaag

SEQ ID NO: 16866 - DNA, 302 bp, Homo sapiens
tacaaatcaagaccagccagatgaagagacacttagggcaaagtttgagaggatcctggatatggggcttccctgtccttgctctgtgggatcaatatgtgttttcttcctggcacattggtgcaatcatcaaccagggatctccaccaatctttggtatccagagtttttattggggtttcattatgtaggcatgattgattgactcattggtgatgtgattgttcaatctccagccccctctcttcactcatgaaaccccaataaatatcctcattgacaaccaaaaaaaaaaaaaaaaa

SEQ ID NO: 16867 - DNA, 156 bp, Homo sapiens
gcatacggctgccggcatggcacattacaacttcaagaaaattacggtggtgccgtccgccaaggacttcatagacctcacgttgtcgaagactcaacgaaagactccaaccgttattcataaacattaccaaatacatcgcattagacattttta

SEQ ID NO: 16868 - DNA, 122 bp, Homo sapiens
gactgtccccctcaccaggtccgtggccttggcatcactcaacctggcccagcctcagagtcagtgcttgtctctgaacaattagggccgcgtggggggctaatatttaggacacgaataaa

SEQ ID NO: 16869 - DNA, 156 bp, Homo sapiens
gactgtccccctcaccaggtccgtggccttggcatcactcaacctggcccagcctcagagtcagtgcttgtytctgaacaattagggccgcgtggggggctaatatttaggacacgaataaaataatgtatamcgcttaaaaaaaaaaaaaaaaaa

SEQ ID NO: 16870 - DNA, 168 bp, Homo sapiens
gactgtccccctcaccaggtccgtggccttggcatcactcaacctggcccagcctcagagtcagtgcttgtctctgaacaattagggccgcgtggggggctaatatttaggacacgaataaaataatgtataacgcttaaaaaaaaaaaaaaaaaaaaaaaaaaaaar

SEQ ID NO: 16871 - DNA, 182 bp, Homo sapiens
gactgtccccctcaccaggtccgtggccttggccatcactcaacctggcccagcctcagagtcagtgcttgtctctgaacaattagggccgcgtggggggctaatatttaggacacgaataaaataatgtataacgcttaaaaaaaaaaaaaaaaaaaaaaaaaaaaaaaaaaaaaaaaaaa

SEQ ID NO: 16872 - DNA, 179 bp, Homo sapiens
gactgtccccctcaccaggtccgtggccttggcatcactcaacctggcccagcctcagagtcagtgcttgtctctgaacaattagggccgcgtggggggctaatatttaggacacgaataaaataatgtataacgcttaaaaaaaaaaaaaaaaaaaaaaaaaaaaaaaaaaaaaaaaa

SEQ ID NO: 16873 - DNA, 233 bp, Homo sapiens
agtaaccaatacaggactcctgtagtgggcagcctgggtaagacttcactggtgctgtacaacactcttcaactcttcttaaacaatctccctttcttccctcaaatgtcagccttgcattatggtatgaaggttttccctaactactaaagttttgctggcatttttggcaataaatcttttacatttctaattaaaaaaaaaaaaaaaaaaaaaaaaaaaaaaaaaaaaad

SEQ ID NO: 16874 - DNA, 461 bp, Homo sapiens
tagatataggcaggtcaggtcccaaaccccaatgtaatataggctccctctttcacactctgtcaatggcacaaagccctattgttaatacagttctctactcacactcaagataagagtaaacaacactgtccttcgactacacaactttcttcctctacacacatctgctctgacagctttcctccaggcgtctcatcacagcaatactgaaagggactgtggcaagccagttttgggacccgtcctccaggattctgggaagatgaggtggcctacaggaccaagagaccaaagctatatcgagaaccagagttccctctgttgccagtgtcagtaaggaattcctccatgggagttccacacttgaatagagctagctgatcacagaagagaaggtcagagagatgcattcaggccggcctggaaaaaagcaaacattcatattgggaactaccact

SEQ ID NO: 16875 - DNA, 237 bp, Homo sapiens
acgcacctcggtaacatcacagcaggtccaggccaatgataaccttataagaggccatgtcgaagcgcgacatcgtcctcaccaatgtcaccgttgtccagttgctgcgacascgtgcccggtgaccagagcaccgcccccacctgagcctaaggctgaagtagagccccagccacaaccagagcccacaccagtcagggaggaaataaagccaccaccgccaccactgcctcctca

SEQ ID NO: 16876 - DNA, 474 bp, Homo sapiens
agaaagccagacttgagggagctgggcctggtgccaccagcttaaccacagcacacactgcaactcattcatacgagaaacacacgaaatgtaggctgtgttgagaaataaatagcagaattgtaattaggggccagaggaaaagggtgtgaagaccatgtcaagatttatgcctgtgagatgggttgcagaattgacctgagcagaccaggcttccgagggtcaaaaaagcgtctgaaggagagacactgagtgcattctgggttcacattcccctcctctactgcattcctgaattttctgcctcacagcggcatctgaagcagtggctgtatgtgtccttaaccacccttcaagtccacaacatgtcatattacctcattttggctccctgggactattttggaggacctgaattagtcatgtggggtacttgattaaaaatcacttgaacagccaaaaaaaaaaaaaaat

SEQ ID NO: 16877 - DNA, 454 bp, Homo sapiens
aatgcgcaagaaggtgcctgcgggactggagcagagcgtgctgcgagggtcttcccagcgcaggcgggttttccagtgttacttgcggctgggcgtgggggactagctgcctttctggcagcaggcaggaagccgcaaaaagtttctgagcccccgaacctgtagcggacgtggaaaaagaacgcccctcctcaagtgtctggctgaaagatgccacccagggaagggaactcgggctagctaaggaggccattcttgatgttgcttctagatctcatgtcatcaccgagccctcagctgctggtggcagctgctcagcagacccttggcatgggaaagagacggagtccaccccaagccatctgccttcacttagctggagaggtgctggctgtggccggggactgaagccagctgtgctctatgattgcaactgtgcaggggcatcagagct

SEQ ID NO: 16878 - DNA, 583 bp, Homo sapiens
atacagattctctctctgcatcatgaggggctgctgtctggggatgggggaagagtggtgtaggcaattcaagtctgcctttcctatcctcttcagtgcctctttccttaatatgatgtggagaaataggaacacttttacactgttggtgggactgtaaactagttcaaccattgtgggaagacagtgtggctattcctcaaggatctagaactagaaataccatttgacccagccgtcccattactgggtatatacccaaaggattataaatcatgctactatgaagacacatgcacacgtatgtttattgcggcactattcacaatagcaaagacttggaaccaacccaaatgtccaacaatgatagactggattaagaaaatgtggcacatatatgccatggaatactatgcagccataaaaaaggatgatttcatgtcctttgtagggacatggatgaagctggaaaccatcattctcagcaaactatcgcaaggacaaaaaaccaaacaccgcatgttctcactcatagcaatctctatctgtgaacctgtagtcaattcagagtcccaaactggtt

SEQ ID NO: 16879 - DNA, 209 bp, Homo sapiens
agtaaccaatacaggactcctgtagtgggcagcctgggtaagacttcactggtgctgtacaacactcttcaactcttcttaaacaatctccctttcttccctcaaatgtcagccttgcattatggtatgaaggttttccctaactactaaagttttgctggcatttttggcaataaatcttttacatttctaattaaaaaaaaaaaaaw

SEQ ID NO: 16880 - DNA, 548 bp, Homo sapiens
actctcgcgaggccccagagagcaggcgctgggcagtgtggaggtcgttggagtcacttccgcgtcaccagctcctgtgcctgccaagtcggtgcccctcccgctccagccatgctctccgccctcgcccggcctgccagcgctgctctccgccgcagcttcagcacctcggcccagaacaatgctaaagtagctgtgctaggggcctctggaggcatcgggcagccactttcacttctcctgaagaacagcccyttgtgagccgcctgaccctctatgatatcgcgcacacacccggagtggccgcagatctgagccacatcgagaccaaagccgctgtgaaaggctacctcggacctgaacagctgcctgactgcctgaaagttgtgatgtggtagttattccggctggagtccccagaaagccaggcatgacccgggacgacctgttcaacaccaatgccacgattgtggccaccctgaccgctgcctgtgcccagcactgcccggaagccatgatctgcgtcattgccaatccggttaattcca

SEQ ID NO: 16881 - DNA, 602 bp, Homo sapiens
atcggccaacggacgcgaggcgcgcgccatggaacagcggttagctgagtttcgggcggcgcggaaacgggcgggtctggcggcccaaccccctgctgccagtcagggcgcacaaaccccaggagagaaggcggaacagcagcgactctaaaggcagccccaggctggctaaagcggttcctggtatggaaacctaggcccgcgagtgcccgggcccagcccggcctagttcaggaagcggctcagccccagggcagcacatcagagacaccatggaacacagccattcctctgccgtcgtgctgggaccagtctttcctgaccaatatcaccttcttgaaggttcttctctggttggtcctgctgggactgtttgtggaactggaatttggcctggcatattttgtcctgtccttgttctattggatgtacgtcgggacacgaggccctgaagagaagaaagagggagagaagagcgcctactctgtgttcaatccaggctgtgaagcatccagggcaccctgactgcagagcakttggagcgcgagttacagttgagacccctggcaggagataggaccagctgtgctgtcatgcagcta

SEQ ID NO: 16882 - DNA, 424 bp, Homo sapiens
cttgaggagagcctctgtctgcagaggggagacgaataggacacaggcaggtctgggagtgtcttgcagagccgaggaggtgggtagcagctggcctgtggagaaagccagtcctagtgacagccttccctccctgaccaagccccctctccattcctaggcatagaaggtccttcctgaccctggcaaccccccctgggacggacctagcttgctctacttctgcaagaggaaagccgttatctggggccaatgcgtcccactggcttgatttcaagagtggcagaagcctgatggaagggtccttgagtgaatcctcccagccccccgaatgaggccaggtagatgcagtgagctgggctatccatgtcgcagcctgkcargaggggagcaggatccttttcctttctggggcctstgggac

SEQ ID NO: 16883 - DNA, 313 bp, Homo sapiens
aacctgtgaatttgctccatcaagactggcaggcagggttacccctgaggagggggtgggggagaaggggtaggggtgggaccctatcatctcccagagggagatcaaggcagccatcatctgtcgaactagatggtcccaggaaggtggcgtcasatctgcagccgcgtcgacgttgtcggagcctccgcggaggacccaggagagccggactaggaccagggccctgggctccccacactccccatggagaagctggcggcctcgacagagccccaataaacgatcccacagcctcaaaaaaaaaaaaaaa

SEQ ID NO: 16884 - DNA, 482 bp, Homo sapiens
aaccctctctcttctccttctttgctgtcctgccggggatctccagtgtgtgcgggggcttaaggacctcctgaggaccgctgctctctgcctctccaggaatggcctggggggagccaggcacccggcacctccacctgcctaacctgtggcccatctgccaccatctgtgcctacagggtctgccccccagcctgcccggcctgtgtgctctctaggacccccatagggccaggggctggcctctttgccccattcccgctccatgccggccagagtgtagaaagccataacgcagccatcagcacaataatgtgactctacgctgatatgctccctctctcctccactgacttccccttcccggatttgtgaggtgtcaagactaggaatctggccttagagcctgcccctccaccccctcagatcaggcatagcatagtcaagcccagcaggtttcctcargagctgtctggggtgtt

SEQ ID NO: 16885 - DNA, 514 bp, Homo sapiens
atttacaacaaaacttggtgagaagatatccctgcaaactcccagatccacaaagacctgcatggtactaacatctgtgcaggagaaagcacaggggctttctctgtgggacttctgatggatctgagaacaagagaatccccaaatagtcaacagtcgttcactggaaagcatggcaggccaagctgaggacagcatttgtaactgggaagaggtttgccaactccaatagcagagatggagttcactatgtttcccaggccggtcttgaactctcgggctcaatcaaaggagtagaaacaatgcaaatggcaacatgagggctgaactctggcacagarcttttagaagaaagaagaaactaaattcctatgataaaggcgacacacagctctaggtaatgaaagaagtaagcttgacctcctgatgccagtatacttcctamtgtactaagatgaagacctatgaatccagcctgcagatcaagagggctgaataggccaggtgtggttgg

SEQ ID NO: 16886 - DNA, 470 bp, Homo sapiens
tttcccgagccggctccgtgtttagggagggcagtgatcacgcaagccggagcgcgggctgacgttggacgagctgccaggtagctgaaasaggcagccaggcagccgagacacttcccagcgrttccagcctgggctccgcagaagcctcgctgaatcccagccagctggttctaaccttccagaatcgcaatcccttctccccacagccagccctcgccaagcaagcagcaggatgtttgcagtgtcgcgcccagggctctgagactgagcctgccatccactcgcacgcctttctttcagggcttttcggctgttggctacactgatgtgacccccctccctttttggaatgatggggatctttttggtgtatgttggatttgttttcttttccgttttatatgtacaacaagggctttcttctcaagcaaaatttaccgagtttcsgsggaacgtgacggcgaccg

SEQ ID NO: 16887 - DNA, 602 bp, Homo sapiens
cagatttcattagttatacagatactcatttgtgtgtgtgtgtttgtgtatagctgtatgcaatgttatcatgagtagctttgtatacaccaccaccacaatctagatgcctaactgtaccgtcacctcaagactccttatgctacccctttatagatacccactcccttcagtcccccacatccctaaccttccccagaagccacgaatctgttcatctctataattttattcatgaaattaataataataattcaataaattgaattatgccatatgtatcttttggggattggcttctttcactcagtataatttccttgatgttcatctaagttgttgcatttatcaatagtttttttctttttattgctgagtagggttccatggtactgatgtttaaccattcagtcactgaaagaaatgtgcagtttccggatttagttattacaaataaagtactataaatatttgtacaagtgttcctgcatgaaaatcagttttaatttctctgggatatatgcccaggagcacaattgctgaattgtatggtgatatggtttgactcagatctcatcttgaatttccacatgttgtgggag

SEQ ID NO: 16888 - DNA, 169 bp, Homo sapiens
agcacttgttcgcwggccgcccctggaggctagaagctccggcgccgagagtgggcatggcgacttggtctcagccrgactcgggtttctctggaaacccccctggtaagtgtggaggaggcgggacactctgacccaagacgaaaggcctgtagctccagccaaagaa

SEQ ID NO: 16889 - DNA, 342 bp, Homo sapiens
attcttagataatgaagctgtggcagtaggaatgtatgtgaggcaacctgccagggtaatgagatgaagaaacaaataaaatgtaaaggctacagaatgaagaagcaatactgtctgtgcctgtaaacccccgtcacctgatggaatggatgtctgccctatatctcagggctttgttataaactcaaatgaaaggatatttatgaaagaacagtatgaactaaactacaaacrcaagaacgctgaatctcccggactggccctctggactcgaatatcagcacttgggggtgaatgaagaaggtgcatcatttccagggaagcagatttgctgttgactaa

SEQ ID NO: 16890 - DNA, 431 bp, Homo sapiens
ggtcagtggttccgggtaggagctaggtgaccctcggctgctgcagggatctgcagsgactgcagccatgggggcgcacctggtccggcgctacctgggcgatgcctcggtggagcccgaccccctgcagatgccaaccttcccgccagactacggcttccccgaacgcaaggagcgcgagatggtggccacacagcaggagatgatggacgcgcastgaggctccagctgcgggwctactgcgcccaccacctcatccggctgctcaagtgcaagcgtgacagcttccccaacttcctggcctgcaagcaggagcggcacgactgggactactgcgagcaccgcgactatgtgatgcgcatgaaggagtttgagcgggaggaaggctgctccagcggaagaagckgcgggakaagaaggcggcagagttg

SEQ ID NO: 16891 - DNA, 157 bp, Homo sapiens
agagcatggcggcgggcgagcttgagggtggcaaacccctgagcgggctgctgaatgcgctggcccaggacactttccacgggtaccccggcatcacagaggagctgctacggagccagctatatccagaggtgcgaaaaaaaaaaaaaaatgcgaa

SEQ ID NO: 16892 - DNA, 405 bp, Homo sapiens
catatctatctaatcagatcttcttttgggaggatttgatgtaagttactgacaagcctcagcaaacccaaagatgttaacagtattttaagaagttgctgcagattcctttggccactgtatttgttaatttcttgcaatttgaaggtacgagtagaggtttaaagaaaatcagtttttgttcttaaaaatgcatttaagttgkaaacgtctttttaagcctttgaagtgcctctgattctatgtaacttgttgcagactggtgttaatgagtatatgtaasagtttaaaaaaaaagttggtattttataagcacagacaattctaatggtaacttttgtagtcttatgaatagacataaattgtaatttgggaacataaaaactactgaataaatcatgtggc

SEQ ID NO: 16893 - DNA, 432 bp, Homo sapiens
aagccgcggttcctaccaaccgttcttattgctggcggcctgaggagcccatcatggcgacgcccctaagcggcgggcggtggaggccactggggagaaagtgctgcgctacgagaccttcatcagtgacgtgctgcagcgggacttgcgaaaggtgctggaccatcgagacaaggtatatgagcagctggccaaataccttcaactgagaaatgtcattgagcgactccaggaagctaagcactcggagttatatatgcaggtggatttgggctgtaacttcttcgttgacacagtgatgtgagtgtctacccgsccctctgagcccacagggttcagcttaccccttmcctcatgcaacttatatttttttgagtatcttctatgtaccaggcactatgcgaggttttatatccagtaggatatcagcta

SEQ ID NO: 16894 - DNA, 513 bp, Homo sapiens
aaaaagaggaaaggagcggggagcggggaaatgctatgtgggcctgtttggatcttaactgaaataaaccgactgtagaaaggcattatttttgggaaacccgaggatggactcgctattagatgatattaaggaattgtagttaatctcgtcgcgtgtatctgttaagggctataggctgaagtatttaatgctgaaaccatatgatggtttctttaaaatacccccaaccggccgggcgctgtgactcaaacctgtaatcccagcacttgggaagccgaagcgggaggatcgcttgagcccaggagttcgagaccascctgagcaamatagtgagacctcgtctgtacaaaaawtkttttttaattatttatttaattaaattagcttggcgtggccgctcacaccttagtcccagctacttgggaagctaacgctggaagatcgctcgaacccaggaggtcgaagctgcagtggggccatgaccctgccactgactccagcctgggtgac

SEQ ID NO: 16895 - DNA, 496 bp, Homo sapiens
aaccttggaagactttatcagtcaatgagaaaatttaaggtagaaacatgtttttactatatttttctctcttaagtaatgaaatagaacctgaaataataaattttaagtaagctcaaattatacacttattgcacaaaggaattgagaagatagtgagtataaaacaacataggccaagcacagtggctcattcctataatcctggcactctgggaggctgaaatgggagggtcctttgagaccaggagtttcagaccagcctggacaacatagggagaccctgtctctacaaaaattaggcaggtgtggtggcacatgcctgtcttcctacctacttggaagactaaggcaggaggatgggttgagcccaagaagttggggctgcagtgactatgatcacatcactgccctctagcctgggtgacagagtgagacctatctctaaaacaaacaaacaatagtcaraatataaataaaatttaaaaatcaggag

SEQ ID NO: 16896 - DNA, 561 bp, Homo sapiens
tgtttggggtggggagggggcttttgttcccttttgacataatatagtcaatgcactaacaattatgtatattcaaacttgattattttaaattcgatcttcagctgtactgtaaatagggtactgcattgtagtctccatatctgtattacttttctgtaatatttaagagttgcttaaaagcatacaaaatgtactgttactaaaacagctaattatttctctctccccctttgacaggaaggggcttcagttgttcctccatggctagaaccataataaacaatgtacccgtaatttgtaacataaagtattgcaatatgttagtaacaatcttgcagccttcctttccaaagttcattttattttgatcagttcagtatattgcactaattattttaggtattttcattatatgaaagctaccatgtgtcagagatgatttaatctatttaagtgttggactgctaggagaacttgtacatttatgataatgcagaattaggaaaacggttcaccagtgtttagttttatattgaggtgctcaggttggaataaagt

SEQ ID NO: 16897 - DNA, 347 bp, Homo sapiens
  misc_feature 2: n=a, g, c or t
tnctgggagagttcagcacctcccggcaggaagaggctccggcctcattgggtgcgtkagaagggaagggtggatcctaaaaggtaatactgagccttcattcaaactaaaaggctggaagggaggcagctgcctttgtttgccatggatgggtaggggctgcactgagcagcaccggtgttcttcatccggctgcacccccaacagagctctttcttccccagatcccttttacagttggattctccctcttggatctggctctgcttagtccgrcctagagggatcagcttcgcccacgcccactctcacccggaacctttcatctcttattgaagccttttagg

SEQ ID NO: 16898 - DNA, 540 bp, Homo sapiens
gatcacgtgacttgcttgaccttatcaatcacttggacaactcaccctccttaccctgccccctagtcttgtattcaacaagtatcagcacgcccagccatttggggccaatactgtttctgcgtcttggtggtagtggtccccccggcccagctgttttctccttagctctttgtcttgtgtctttatttcttacaatctctggtctccgtacacggggagaaacccgcaaagccctgtaggstggaccctacaatggatctgttgtaatttttgcctgaaagcctacctctttttcagctctttcctattttatcagagaaaagagtctaaaattctcattgggccaagcatgttgtttcttcgtttaaaagtttatgtagacccttaggtattatttcatcagtgctgaagatggacacttagaaacagtgttgataacttccagccctactgaaatacctgcaaatgcctataacattatgattgtttgctttctcctgaaagaggctttaaacttgttcgataaatttaaacatt

SEQ ID NO: 16899 - DNA, 473 bp, Homo sapiens
attcagctgggagcatccgcagactcacgtctccaaaaaccaagctctccgagtgagcaattcctgtccctcttaagggcttacaactctaagggggtccgcgtgagagggtcttgatggattgaggaagcataggccctcctctgtgtggagtctctcgctggacctaggaactcagggatcctaggcaggtcagctggaagggaagacacgcctctccacaccaagcctgaggttcaccgcgaaagagaggccgccaccctgccccaaacccgccccaacctgctcctccagcagagccctgtgttcttcctggctgaggagtggttccagcaaagcggggctcttccacgtccttcagctccccccagtggcgccggatctaggaaaggttgtgccttttgctgaaactctggggttgacaggagctcatctaacaggctggaggtgagtgcagaggagagcccggctcc

SEQ ID NO: 16900 - DNA, 681 bp, Homo sapiens
  misc_feature 520,564,665: n=a, g, c or t
atgctcaggaatgctttcttgtcattgttgacagccctcctctgtgtggagtctctcgctggacctggaactcagggatcctaggcaggtcagctggaagggaagacacgcctctccacaccaagcctgaggttcaccgcgaaagagaggccgccaccctgccccawacccgccccaacctgctcctccagcagagccctgtgttcttcctggctgaggagtggttccagcaaagcgggctcttccacgtccttcagctcccccagtggcgccggatctaggaaaggttgtgccttttgctgaaactctggggttgacaggagctcatctaacaggctggaggtgagtgcagaggagagccccggctcctggagcggttgggaggtgcccggttggctggcatctgtgcttgacgcggaggcctccggggtcacgagctccggaggtgaaggtgccccgtcttcgggttcccatgccgccctggcgacctgcggctccaggcccaccacggactccggtnggacgtgggtggcgcaasacacctttcccctgtgactcagcttnaggggccccaaggtgtcccactgagcacgcgcccagcaggccatcgcgctgcgggttctggtcttcctgtcatttgttggggttcggaggccaccagggantctgaggatgggagat

SEQ ID NO: 16901 - DNA, 368 bp, Homo sapiens
atatccgggttcccgccgcctccaccgccaccgcctcagccgcctcgcacatttagtcttgccgggagtggtgtgattcccgaccaagattggcggccgttgggggcgagtcggctccttcggttcttctccgccgggaattatcctcgacttacactgggcggccccttgggcaacgagatagcgtcgggcaacggtggcgccgywggcaggcgaacgacgaggacgggcagaacctttggtcctgcatcctcagcgaggtctccacccgctcgcgcttccaagctccctgcggggaagaacgtgctactgctgggtgaagatggagctggaaaaacaagcttaataagaaaaattcagggaataga

SEQ ID NO: 16902 - DNA, 576 bp, Homo sapiens
atattttgataaattattacacacgcagaaaaactgatcacactgactggatctgtccacgacatggaaaataaactggattttcagaatattgttgttttctgtagtgttcaaggtattgtttctaaacataaacatactctaaacatgctttattcacttgttaaagtcatacttttaaaagtaataccttactaaagatggtgattacttttccgaggtcagaaaaggaaagctaagcgttttcattatcaaatacacaagcttattaaatgaatgactgttaactactttattttcatttgcacattaattttggaattgtttctgttttgctgctgacggaaatactattttggctctgtgtatatttgtattttgatttttctggtttgtttacccccatttgcttttagctcccccttatgtttaaatatattctaacttatgtaaagagcataatcttagagcaaaatacttgaggttttatgtcagatctaatcttaagtgtttgttgttttttaaaaggtgttttctcagatggctgcagtgtttttgctatttctgcataaatac

SEQ ID NO: 16903 - DNA, 366 bp, Homo sapiens
agttgaggccaccctggtggcaccaaagccctctcaggcaggcagacccagggcctccccgccacaccttgttcatggattttgtcgcaggagccatcggaggcgtctgcggtgttgctgtgggctaccccctggacacggtgaagggcctgctggccttgccctaggcctggagccgctcgtgcctgaagcccaattctcctgcaggtcaggatccagacggagccaaagtacacaggcatctggcactgcgtccgggatacgtatcaccgagagcgcgtgtggggcttctaccggggcctctcgctgsccgtgtgcacggtgtccctggtatcttccgtgtcttttggcacctaccgscactgg

SEQ ID NO: 16904 - DNA, 456 bp, Homo sapiens
  misc_feature 205: n=a, g, c or t
attgtgcggccgccgcscgctgcggagggttgggggaggagttgggagtttagcgcagtcgccggagtgcgaggacaacgaccatccggccctagcctggccgggcgggtgcgggagcttccctttctcagcgcggcgcgaaggtggctcgccgtcagcgcctgcttccctcgacctcgtcctcctccccgctccggaggmvtgncgagatgtggcgcctctgactccacttctccccgcccctgtcaccgagagggggaacgagctctcgcccactcgccggaggagacggccctggactcccaaccccgccggcgaaaccatgagctccgtccagcagcagccgccgccgccgcggagggtcaccaacgtggggtctctgttgctcaccccgcagagaacgagtccctcttcactttcctcggcaagaatgtgtgactatgtcttcagcagtgg

SEQ ID NO: 16905 - DNA, 527 bp, Homo sapiens
gctttgacaaaaccagggaaagagacagagagagataatggcggctaaactaatctgttcgtctttaacagtgcattcaatggcaaataagaagccatcaccttctgctgcaacaagaacaataacctcaaagaagagcacagcactccacaggtgaaactgctgacaagagtcgagcagctcaagcttctgaccaaagccgagaaagcaggacttttgtctttagcagagaaatcaggtttctctctatcgaccatcgagcgtcttggattgctgaccaaagcagaggagttcggcgttttgtctgccgccacaaacccggaaacgcctggaacgttattcactttgagcctcggtttactccttcttggaccggtttttgcatatgtggttcctgaagattacacttgggaagtagtgattcaggttcttgtggctctactctctgttcttggtggctctgctgcttttgctgcttctggttttgtctccaatttgcagaaatctgattagcccgatcgtttttt

SEQ ID NO: 16906 - DNA, 431 bp, Homo sapiens
gtcgaggcggggcgcgggaacgacggcggccatggcggcctcggggccgggtgtcgcagctggtgcttgtgtcccgaggtgccatccgccaccttcttcactgctctgctctcgctgctggtttccgggcctcgcctgttcctgctgcagcagcccctggcgccctcgggcctcacgctgaagtccgaggcccttcgcaactggcaagtttacaggctggtaacctacatctttgtctacgagaatcccatctccctgctctgcggcgctatcatcatctgggcgctttgctggcaatttcgagagaaccgtgggcaccgtccgccactgcttcttcaccgtgatcttcgccatcttctccgctatcatcttcctgtcattcgagactgtgtcatcactgtcaaagctggggggaagtggaggatgccaga

SEQ ID NO: 16907 - DNA, 451 bp, Homo sapiens
aacgcaaacccggaagcggatcgggtggagtgtaggtcatatcgccgcgttgactagataacgaaggrcaatgcatatatacaaaattgctgtattgcctggtgatatgcaactgtacctgtgacatcataattgcaccctccgacatgatatctcttccaaatgcttgatgaaaaaggtgggaggatcacttgagccagggagttgaaggctgcagtgagccctgtttttgccaccacactccagcttgggwgagtgagctacaccctatctcaaacagacaaggaagtaaatgagaggtttaattcctcctttgaaaataaagaaagagattttctttcctttcatttcttttcttaggagatttatttagaaaatttgcaaatgcattttctgttttctgagggtagtattctttctttctcttttcttttctttctcgcacatggaa

SEQ ID NO: 16908 - DNA, 449 bp, Homo sapiens
gagccggcactgatgttttctggggtcaccagaaagccctggtttcaccacaaattgtgactgtcaggacacagtgctgctatggtcaggattcctttccatatgctgcttcagcctcagacctcggtgggccttaagagtaggggctgctcagccaggcgcagtggctcacgcctgtaatcccagcactttgggaggcagaggcgggtgggtcacctgaggtcgggagatcgagaccagcctgaccaatatggagaaaccctgtctctactaaatatacaaaattagccgggtgtggtggcatgtgcctgtaatcccagctacttaggaggctgaggcaggagaatcgcttgaacccaggaggcggaggttgcggtgagccaagatcgcaccattgcactccagcctgggcaacaagagcgaaactccgtctcaaaaaaaaaaaaaaa

SEQ ID NO: 16909 - DNA, 349 bp, Homo sapiens
gttgtctctttttcttcctgcccctttgtttgacttcaccattctctgtttccttttcgctccgctgtagttacgtgactcacctttcattcagtacctcccttcaaggaaagccctgtctcctgtccttggactgggatcacacagagttcttgggatgaccctggctctcccgcgccagccgctctgctgccaagcgcaagcattcgctcccagatgcttcgcccagttctttgcaaatgtcatccaatcagtgtccaggtgttcacggctcatcactggcttactgctctggtctacatagcttgggacattgctgtttatgcaggtataaaaaaaaaaaaaaaaa

SEQ ID NO: 16910 - DNA, 216 bp, Homo sapiens
cagcggaasracgaagggacgggacccgggagcctggacgagtccgagcgcgtcacctcctcacgctgcggctgtcgcccgtgtcccgccggcccgttccgtgtcgccccgcagtgctgcggccgccgcggcaccatggctgtgtttgtcgtgctcctggcgttggtggcgggtgttttggggaacgagtttagtatattaaaatcaccagggtct

SEQ ID NO: 16911 - DNA, 435 bp, Homo sapiens
aaaggtggwcagacaccccagcacaaagccgagtgaagaactctgaggaaggatgcgtgcttgsrgaatgatgcctcgaccctggtgcctgaagccgwgcctggrratctgaagggagccgagctccttctgcagaagggcgctgagaagggagctggaaggaaaagaaggaaacattccttcctcaactggaggaagacacgcggccacacacagaaccagcggccccaggaccgtcaccctgcgtgcccgggcctgtccctcctgaccccaggattatagtggcgaggcagggtgttagccaagcggattgagccaggacacagcaccgcggascctgcaggcgagtcctccggagctgagagcaaacggctgcactaggamccagcagtcagaccggsccccascctggagtgaacacatcgccactgccag

SEQ ID NO: 16912 - DNA, 472 bp, Homo sapiens
catcagtgttctcctgccttcaaactcagtcttaaactgtaacttctcccttcagttctgttggttctcaggcctttggacgcagtctgaaatgatgccatcagctctcctgggtctccagcttgcctactacagatcttgaggcatgtcaacctctacaaccacatgagccaattccttatgataaatcataaacacacacacaccgcaaacacacacacacatttccatcctattggttctgtttctctgcagggtccagattaagacagcaatatagactgtgctcaaasactggyammwtttaccsatctcaagatggaaggagcccctcaargtagctctkaaaatgtttgcaatgtgccggggtagtcagctgacctttttctgcccctgtttaattgtcagaaaaacataagttggatttagtgstccttggaagaataattcatctttaagtctgtaactctga

SEQ ID NO: 16913 - DNA, 439 bp, Homo sapiens
catcagtgttctcctgccttcaaactcagtcttaaactgtaacttctcccttcagttctgttggttctcaggcctttggacgcactgaaatgatgccatcagctctcctgggtctccagcttgcctactacagatcttgaggcatgtcaacctctacaaccacatgagccaattccttatgataaatcataaacacacacacaccgcaaacacacacacacatttccatcctattggttctgtttctctgcagggtccagattaagacagcaatatagactgtgctcaaacactgstacatttaccatctcaagatggaaggagccctcaaagtagctcttwaaatgtttgcaatgtgccggggtagtcagctgacctttttctgcccctgtttaattgtcagaaaaacataagttggatttagtgctccttgaagaat

SEQ ID NO: 16914 - DNA, 449 bp, Homo sapiens
catcaacttctggacatttaaatacatgcatattagatagttttcactgtatcctatctctttactctcagtcttgcactttttaccttggtctttcaaagccgatgcctttttctgacaaattttatagttcattaatgtcactatggagctgtatctaatttgttgttaaatccatcagttgaattttcagttgtagaatttgtattaggttctttatcaaacctataatgtcattttatagttcctggttccctgatgaaatttccaagcttggctgcttctttgaccttagtgaacaattgttgtgtaatctgagttggccaattatagtatcttaaggttttttgtggtctgttgctcatgttggttctcacatatgaagtcttttcttgtgtgcctggttttctttgtgtgctaaacatgtatttgtaaaaaaaaaaaaaaaa

SEQ ID NO: 16915 - DNA, 510 bp, Homo sapiens
ctatcgcgagaacagcatgggggaaaccacctccgtgatccaatgaccggcacgtggtcccacccttgatacatggggattattagaatcaaagtaagatttgagtggagacatacagccaaaccctatcaaatatcttaaaccaatatagttcatattttattacttttaactgtactttttctttcctccttttggaacgaggggatccatgctttcattttgcacagggcccaacatattatgtatccatttcgtatctctgccttgtatgtttaattttcttaactaaaataaataggtaatagggatgtttttatttctgttcttcttaatatctagaaaacataagttgtatttacttcatctgatctcttctctcttttcctcatgctctggctccccttggttacataactgtctttacacctgctcatattttccagagagttaagaaaccattttttttagaataaaactctgagcttaagatcttagacattttttttt

SEQ ID NO: 16916 - DNA, 193 bp, Homo sapiens
aaacccgggtggggtggcggggcggcggggtgacggggcacgaggccgggattccaccgcagactccgaagaggcaggggcatccagtggttcaaggttacaataagctgtgatcgtgccactgcattctacctgggatgacagagtgggaccctgtgccacagagtagaccctgtctcaaaaaaaaaaaaaa

SEQ ID NO: 16917 - DNA, 503 bp, Homo sapiens
gccgaagaagagcgggcgacaaaggtgcgggatggcatggattctgcaactctccccagcctccactgcgtttcgaagcgacgcccttgactgaggagtgtttttaataatcatctggccgacttggaagctggaggccgaasatagctgtcaattttcttgcgttccttctgcttcctcggggcagagatggtgaaatctacttgttaggacagttgcaaacccgattgcagtctgggctctggatgctggaattatcctgtgatgattcatcatctttaacagaaagccgaggttacagagcccagagtgatttttgacgttccacaatattccacgaacattttctgattgctcactatatgcatagattgactgagtctctgggggaaagatgtagaagacaggagttctaaaccctaggaagtgcatcaccggtagtggcgccggctgtagtcccagctacttggggaggaaaccagatccttaagtcatttctctct

SEQ ID NO: 16918 - DNA, 445 bp, Homo sapiens
agagagtgggagaaaccggggagcagcgggagcagcaggtccggggggagctgttccgctgcgctgccctcgttattcacacggacgctgcggasttcccagggctgcttccctgtccccctgggtggaggctgccgtctaaacctgactccagagtttaagatgcaatggccagaagacatgaacgtgtcactagaaggatgtggacatgggctccgggactgttgatgatgactgtggtgttttggggtcatcaggggaatggacaaggccaaggatcgcgtcttcgccaggaggactttcccccgcggattgtggagcatccttccgatgtcatcgtctctaagggcgagcccacgactctgaactgcaagcggagggccggccaacgcccaccattgagtggtacaaagatggggatcgagtggagactgacaaggacgat

SEQ ID NO: 16919 - DNA, 505 bp, Homo sapiens
actccgtctcgccctgccccggcgggggtcaggatcctccacagttcctgatgaatatctgttatcgctgaagtttctctttggctcatcagccacccaggccttggacctagttgatcgacagtccatcaccttaatctcatcacccagtggaaggcgtgtttaccaggtccttggaagttccagtaaaacatacacatgtttggcttcttgtcattactgttcatgtcctgcatttgcattctcagtgctacggaagagtgacagcatcctgtgcaagcatctcttggcagtttacctgagtcaggttatgaggacctgtcagcagctaagtgtctctgacaagcagttgactgacatattattgatggagaagaaacaagaagcataaaaggactgcaggaggtgctgtgggttggagccgtgggctgtggagggtttgtgtatgatgagaagccctgtacagtcttgtcaagaaataccctgagccagtctctgagacgct

SEQ ID NO: 16920 - DNA, 478 bp, Homo sapiens
attgtaaagtaaaagctataaagcagtatttttcttgacaaatggcatatgttttccacttctttgcatgcgtttaagtcagtttatacacaaaatggattttattttttagtttaactgtgtttctccgacagctcacctctctctgaccacccagccatttccttcctgtgctccacgttcttctgtgtgattaaaataagaatattatttttggaaatatgcaactccttttcagagatcaggagggatttatgtagcagctatttttactgcaaaagtaattcactggaaaaaaaatgtaatttgtaagaaagctttatttttatctcagctctatgtaaagttaaagttactgtacggagctgaaggacggggggcggtaggggtcttgatgaaacctcttgaacgaagcacagtttgtcccatctttgttcactcgtgtgtctcaaccatctttaatagcatgctgctcctt

SEQ ID NO: 16921 - DNA, 491 bp, Homo sapiens
aggatcctccacagttcctgatgaatatctgttatcgctgaagtttctctttggctcatcagccacccaggccttggacctagttgatcgacagtccatcaccttaatctcatcacccagtggaaggcgtgtttaccaggtccttggaagttccagtaaaacatacacatgtttggcttcttgtcattactgttcatgtcctgcatttgcattctcagtgctacggaagagtgacagcatcctgtgcaagcatctcttggcagtttacctgagtcagggttatgaggacctgtcagcagctaagtgtctctgacaagcagttgactgacatataattgatggagaagaaacaagaagcataaaagggcaattgaaggaacagactaaaaatcgtgtcctggaagaaactacaggtactaccaggggattttcagtctgagaagaaaagacaaaaatwgatgacagaaggagtattagaagggagagcgatg

SEQ ID NO: 16922 - DNA, 526 bp, Homo sapiens
gcgggcggtgatcgaagggctgaagatgcggaggaggccgagtcgctaggcgctttcgggggcgctgtgccggtgaggcttaggcaaggggacggggaaccgtggttagatgcagcagccctcccaggtcccacttctttggcgttcctgctgcctgtsactcaagacaattgacttccasctsaassctcakctccgaacgccttgcattagaagctagagctttggaggttctgaggacggtccctggggagcaagtggaacttcttcctctttgaaaccggtttcccaagggaactgcctgtgtgactgaraggctagtaatctgtttgtagatgatttatattttggctgcagaatgaatccccctccctactcggagtactctccttagagatgatcccccgcmccctccccatgggttcgctctcagagctgggatctgtataaagagcgctgtgggagtcttttgccctccgctctagctctatcttcctccggaccccgaagcttaagaattatccgc

SEQ ID NO: 16923 - DNA, 531 bp, Homo sapiens
agatgcagcagcggcggcagcagccctcccaggtcccacttctttggcgttcctgctgcctgtgactcaagacaattgacttccacctgaaccctcagctccgaacgccttgcattagaagctagagctttggaggttctgaggacggtccctggggagcaagtggctgttgtccagctctaatgatgtcctagagcagaagtgtttcttctgatgtctcattttaacaagaggatgatgtctgtgtatgtctctgtgttttagagaggctggcaaatgctgctaagaggatctgaggttcacataaagaggatgaaaattctgaattactttcattgcaaataaaccttaacaattgtgagagttagagagcatacttttcacataagactttggtatgctgcctaaagctacttacataatttgctattcagagaaatgcatttgtttattgaggacccacccggacttaaattggaaaaatgtaacattcagatttttattttatatgtgaaaataaatgtgtgattg

SEQ ID NO: 16924 - DNA, 154 bp, Homo sapiens
agagggagggttaaggcgcctgggcsacagcgagccggctgagggggctgtggcggccgcggcgggcgacatggacaacgcggggaaggagcgtgaggcagtacagctgatggcggaggccgagaagcgagtcaaggcctcccactccttcctc

SEQ ID NO: 16925 - DNA, 219 bp, Homo sapiens
aagactatactttcagggatcatttctatagtgtkttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgakagggagagaacgcggtctgagtggaag

SEQ ID NO: 16926 - DNA, 235 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtcttagtgaaaaamaaaaaaaaaaaaag

SEQ ID NO: 16927 - DNA, 224 bp, Homo sapiens
aagactatactttcagggatcatttctatagtgttttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgatagggagagaacgcggtctgagtggaagaaaaa

SEQ ID NO: 16928 - DNA, 233 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaaaaaaaaaaa

SEQ ID NO: 16929 - DNA, 232 bp, Homo sapiens
aagactatactttcagggatcatttctatagtgtgttactagagaggtttctctgaacgtgtagagcaccgaaaaccacgaggaagagaggtagcgttctcctgagcgtgaagccggctttctggcgttgcttggctgcaactgccgtcagccattgatgatcgttcttctctccgtattggggagtgagagggagagaacgcggtctgagtaagaaaaaaaaaaaaaaaaa

SEQ ID NO: 16930 - DNA, 233 bp, Homo sapiens
aagactatactttcagggatcatttctatagtgtgttactagagaggtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaaaaaaaaaaa

SEQ ID NO: 16931 - DNA, 220 bp, Homo sapiens
aagactatactttcagggatcatttctatagtgtgttactagagaagtttctctgaacgtgtagaacaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaa

SEQ ID NO: 16932 - DNA, 272 bp, Homo sapiens
agactatactttcagggatcatttctatagtgtgttactagagaagtttctctgaacgtgtagaacaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtggaaaaaaaaaaaaaaaaaaaaaaaaaaaaaaaaaaaaaaaaaaaaaaaaaaaaaaaaa

SEQ ID NO: 16933 - DNA, 266 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtragagggagagaacgcggtctgagtaaaaaaaaaaaaaaaaaaaaaaaagaaaaaaaaaaaaaaaaggtcaaaagct

SEQ ID NO: 16934 - DNA, 231 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtttgagtaaaaaaaaaaaaaaaaa

SEQ ID NO: 16935 - DNA, 236 bp, Homo sapiens
  misc_feature 155: n=a, g, c or t
aagactatactttmagggatcaatttctatagtgttttttagagaagtttctctgaacgtgtagagcaccgaaaaccacgaggaagagaggtagcgttttctcctgagcgtgaagccggctttctggcgttgcttggctgcaactgccgtcagcnattgatgatcgttcttctctccgtattggggagtgatagggagagaacgcggtctgagtggaagaaaaaaaaaaaaaaaaa

SEQ ID NO: 16936 - DNA, 269 bp, Homo sapiens
agactatactttcagggatcatttctatagtgtgttactagagaagtttctctgaacgtgtagaacaccgaaaaccacgaggaagagaggtagcgttttctcctgagcgtgaagccggctttctggcgttgcttggctaactgccgtcagccattgatgatcgttcttctctccgtattggggagtgagagggagagaacgcggtctgagtggaaaaaaaaaaaaaaaaaaaaaaaaaaaaaaaaaaaaaaaaaaaaaaaaaaaaaaaa

SEQ ID NO: 16937 - DNA, 220 bp, Homo sapiens; identical to SEQ ID NO: 16931

SEQ ID NO: 16938 - DNA, 220 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtaaaaaa

SEQ ID NO: 16939 - DNA, 230 bp, Homo sapiens
aagactatactttcagggatcatttctatagtgtgttactagagaagtttctctgaacgtgtagagcaccgaaaaccacgaggaagagaggtagcgttttctcctgagcgtgaagcmggctttctggcgttgcttggctgcaactgccgtcagccattgatgatcgttcttctctccgtattggggagtgagagggagagaacgcggtctgagtgaaaaaaaaaaaaaaa

SEQ ID NO: 16940 - DNA, 234 bp, Homo sapiens
aagamtawamyttycarggrwycawttyytaatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtaaaaaaaaaaaaaaaa

SEQ ID NO: 16941 - DNA, 236 bp, Homo sapiens
aagactatactttcagggatcatttctatagtgttttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgatagggagagaacgcggtctgagtggaagaaaaaaaaaaaaaaaaa

SEQ ID NO: 16942 - DNA, 243 bp, Homo sapiens
aagactatactttcagggatcatttctatagtgttttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtggaaaataaagaaaaaaaaaaaaaaaaaa

SEQ ID NO: 16943 - DNA, 236 bp, Homo sapiens; identical to SEQ ID NO: 16941

SEQ ID NO: 16944 - DNA, 220 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaa

SEQ ID NO: 16945 - DNA, 232 bp, Homo sapiens
aagactatactttcagggatcatttctatagtgtgttactagagaagtttctctgaacgtgtagagcaccgaaaaccacgaggaagagaggtagcgttttctcctgagcgtgaagsmggctttctggcgttgsttggctgcaactgccgtcagccattgatgatcgttcttctctccgtattggggagtgagagggagagaacgcggtctgagtaaaaaaaaaaaaaaaaaa

SEQ ID NO: 16946 - DNA, 253 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaaaaaaaaaaaasscaaaaaaaaaaaaaaaa

SEQ ID NO: 16947 - DNA, 528 bp, Homo sapiens
atctttgggagctgcatttttgataaataagaaaaacctcctcattttaatgaagtagtttcaatggagcaaaaacatggaattaaagaaccacagttcaactccatcaatgaagtaacatcatttgccaactaacaaactgagtctacatctctttatttgcaatgtaaaaccccatcctgttaggggaaaaaaaaatagtactaatgttggatttagaagtccggagttcaattttaggctttggagagaagtaatccacttttacttgagatttccaatctcatatcaccaccatcatcattatcaccattatcatcaccaccaccaccaccatgagcaaccaacatcatcatcatcaagaacaacttgcttttgctagccaaagcaatgggaacacagcactctattagggggcaaggtattaatttgctttttatttaattataacaaaagcgaaatacatgtttttgtaatttcctatcaataatttagaagaattaaatataaatataaaataaaaaccaa

SEQ ID NO: 16948 - DNA, 425 bp, Homo sapiens
taagcgccagtctccgccttgcgagctcagagtgtgcccgctgcgccgccgctgtccgtacctgccgccgccgccaccgcsaccatgcccaacttcgccggcacctggaagatgcgcmrgcgagaatttcgacgagctgctcaaggcactsgggtgtgaacgccatgctgaggaaagtggccgtagcggctgcgtccaagccgcacgtggagatccgccagacggggatcagttctacatcaagacatccaccacggtgcgcaccactgagatcaacttcaaggtcggagaaggctttcaggaggagaccgtggacggacgcaagtgcaggagtttagccacttgggagaatgagaacaagatccactgcacgcaaactcttcttgaaggggacggccccaaaacctactggacccgtgagctgg

SEQ ID NO: 16949 - DNA, 221 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtggaaaat

SEQ ID NO: 16950 - DNA, 250 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaaaaaaaaaaaagcgcaaaaaaaaaaaa

SEQ ID NO: 16951 - DNA, 234 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaaaaaaaaaaaa

SEQ ID NO: 16952 - DNA, 242 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtggaaaataaagaaaaaaaaaaaaaaaaa

SEQ ID NO: 16953 - DNA, 234 bp, Homo sapiens
aagactatactttcagggatcatttctatagtgtgttactagagaagtttctctgaacgtgtagagcaccgaaaaccacgaggaagagaggtagcgttttctcctgagcgtgaascggctttctggcgttgcttggctgcaactgccgtcagccattgatgatcgttcttctctccgtattggggagtgagagggagagaacgcggtctgagtggaaaataaagaaaaaaaaaa

SEQ ID NO: 16954 - DNA, 253 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaaaaaaaaaaaagscaaaaaaaaaaaaaaaa

SEQ ID NO: 16955 - DNA, 234 bp, Homo sapiens
  misc_feature 234: n=a, g, c or t
aagactatactttcagggatcatttctatagtgtgttactagagaagtttctctgaacgtgtagagcaccgaaaaccacgaggaagagaggtagcgttttctcctgagcgtgaagccggctttctggsgttgcttggctgcaactgccgtcagccattgatgatcgttcttctctccgtattggggagtgagagggagagaacgcggtctgagtgaaaaaaaaaaaaaaaaaan

SEQ ID NO: 16956 - DNA, 231 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtaaaaaaaaaaaaaaaaa

SEQ ID NO: 16957 - DNA, 234 bp, Homo sapiens; identical to SEQ ID NO: 16951

SEQ ID NO: 16958 - DNA, 242 bp, Homo sapiens; identical to SEQ ID NO: 16952

SEQ ID NO: 16959 - DNA, 526 bp, Homo sapiens
gcgctcctagtctccactgctgccgccgtcgccgccacccgagccggagcgggctgggccgccaaggcaagatggttggactacagcgtgtggggaccacattgaggtgtctgatgatgaagacgagacgcaccccaacatcgacacggccagtctcttccgctggcggcatcaggcccgggtggaacgcatggagcagttccagaagggrgaagggaggaactggacagggggctgccgcgagtgcaagcgcaaggtggccgagtgccagaggaaactgaaggagctggaaggtggccgagggcggcaaggcagagctggagcgcctgcaggccgaggcacagcagctgcgcaaggarggagcggactgggggagccagaagctgggaggagatgcgcaagaaggagaagagcatgccctggaacgtggacacgctcagcaaagacggcttcagcaagagcatggtaaataccaagcccgagaagacggaggaggactcagaggaggtgagggagcagaaacaca

SEQ ID NO: 16960 - DNA, 238 bp, Homo sapiens
agactatactttcagggatcatttctatagtgtgttactagagaagtttctctgaacgtgtagaacaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtggaaaaaaaaaaaaaaaaaaaaaaa

SEQ ID NO: 16961 - DNA, 231 bp, Homo sapiens; identical to SEQ ID NO: 16956

SEQ ID NO: 16962 - DNA, 232 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccrrtattggggagtgagagggagagaacgcggtctgagtgaaaaawaaaaaaaaaa

SEQ ID NO: 16963 - DNA, 226 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtggaaaataaaga

SEQ ID NO: 16964 - DNA, 231 bp, Homo sapiens; identical to SEQ ID NO: 16956

SEQ ID NO: 16965 - DNA, 293 bp, Homo sapiens
aagactatactttcagggatcagttctatagtgtgttactagagaagtttctctgaacgtgtagagcaccgaaaaccacgaggaagagaggtagcgttttctcctgagcgtgaagccggctttttggcgttgcttcgctgcaactgccgtcagccattgatgatcgttcttctctccgtattggggagtgagagggagagaacgcggtaaaaaaaaaaagaaaaaagaaaaaaaaaaaaaaaaaaaaaaaaaaaaaaaaaaaaaaaaaaaaaaaaaaaaaaaaaaaaaaaaaa

SEQ ID NO: 16966 - DNA, 235 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaaaaaaaaaaaar

SEQ ID NO: 16967 - DNA, 231 bp, Homo sapiens; identical to SEQ ID NO: 16956

SEQ ID NO: 16968 - DNA, 225 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaaa

SEQ ID NO: 16969 - DNA, 224 bp, Homo sapiens
aagactatactttcagggatcatttctatagtgtgttactagagaagtttctctgaacgtgtagagcaccgaaaaccacgaggaagagaggtagcgttttctcctgagcgtaasbggctttctggcgttgcttggctgcaactgccgtcagccattgatgatcgttcttctctccgtattggggagtgagagggagagaacgcggtctgagaaaaaaaaaaaaa

SEQ ID NO: 16970 - DNA, 231 bp, Homo sapiens
aagactatactttcagggatcatttctatagtgtgttactagagaagtttctctgaacgtgtagagcaccgaaaaccacgaggaagagaggtagcgttttctcctgagcgtgaagscggctttctggcgttgcttggctgcaactgccgtcagccattgatgatcgttcttctctccgtattggggagtgagagggagagaacgcggtctgagtaaaaaaaaaaaaaaaaa

SEQ ID NO: 16971 - DNA, 235 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaaaaaaaaaaaag

SEQ ID NO: 16972 - DNA, 243 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtggaaaataaagaaaaaaaaaaaaaaaaaa

SEQ ID NO: 16973 - DNA, 241 bp, Homo sapiens
aagactatactttcagggatcatttctatagtgtgttactagagaagtttctctgaacgtgtagagcaccgaaaaccacgaggaagagaggtagcgttttctcctgagcgtgaascggctttctggcgttgcttggctgcaactgccgtcagccattgatgatcgttcttctctccgtattggggagtgagagggagagaacgcggtctgagtggaaaataaagaaaaaaaaaaaaaaaaa

SEQ ID NO: 16974 - DNA, 244 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaaaaaaaaaaaagcgcaaaaaa

SEQ ID NO: 16975 - DNA, 243 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtggaaaataaagaaaaaaaaaaaaaaaaag

SEQ ID NO: 16976 - DNA, 231 bp, Homo sapiens
aagactatactttcagggatcatttctagagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtaaaaaaaaaaaaaaaaa

SEQ ID NO: 16977 - DNA, 230 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtggaaaataaagaaaaa

SEQ ID NO: 16978 - DNA, 253 bp, Homo sapiens; identical to SEQ ID NO: 16946

SEQ ID NO: 16979 - DNA, 231 bp, Homo sapiens; identical to SEQ ID NO: 16956

SEQ ID NO: 16980 - DNA, 234 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctstccgtattggggagtgagagggagagaacgcggtctgagtgaaaaaaaaaaaaaaaaaaa

SEQ ID NO: 16981 - DNA, 242 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaaaaaaaaaaaasscaaaaa

SEQ ID NO: 16982 - DNA, 236 bp, Homo sapiens
aagactatactttcagggattatttctatagtgttttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgatagggagagaacgcggtctgagtggaagaaaaaaaaaaaaaaaaa

SEQ ID NO: 16983 - DNA, 277 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctacaactgccgtcagccattgatgatcgttcttctctccagtattggggagtgagatggagagaacgcggtctgaaaataaaaaaaagaaaataaaaaaaaaaaaaaaaaaaaaaaaaaaaaaaaaaaaaaaaaaaaaa

SEQ ID NO: 16984 - DNA, 231 bp, Homo sapiens; identical to SEQ ID NO: 16956

SEQ ID NO: 16985 - DNA, 232 bp, Homo sapiens
  misc_feature 155: n=a, g, c or t
aagactatactttcagggatcatttctatagtgtgttactagagaagtttctctgaacgtgtagaacaccgaaaaccacgaggaagagaggtagcgttttctcctgagcgtgaagccggctttctggcgttgcttggctgcaactgccgtcagcnattgatgatcgttcttctctccgtattggggagtgagagggagagaacgcggtctgagtgaaaaaaaaaaaaaaaaa

SEQ ID NO: 16986 - DNA, 242 bp, Homo sapiens; identical to SEQ ID NO: 16952

SEQ ID NO: 16987 - DNA, 253 bp, Homo sapiens; identical to SEQ ID NO: 16954

SEQ ID NO: 16988 - DNA, 256 bp, Homo sapiens
agactatactttcagggatcatttctatagtgtgttactagagaagtttctctgaacgtgtagaacaccgaaaaccacgaggaagagaggtagcgttttctcctgagcgtgaagccggctttctggcgttgcttggctaactgccgtcagccattgatgatcgttcttctctccgtattggggagtgagagggagagaacgcggtctgagtggaaaaaaaaaaaaaaaaaaaaaaaaaaaaaaaaaaaaaaaaaaa

SEQ ID NO: 16989 - DNA, 283 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaaaaaaaaaaaaaaaaaaaaaaaaaaaaaaaaaaaaaaaaaaaaaaaaaaaaaaaaaaaam

SEQ ID NO: 16990 - DNA, 241 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtggaaaataaagaaaaaaaaaaaaaaaa

SEQ ID NO: 16991 - DNA, 254 bp, Homo sapiens
  misc_feature 254: n=a, g, c or t
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaaamaaaaaaaagscaaaaaaaaaaaaaaaan

SEQ ID NO: 16992 - DNA, 225 bp, Homo sapiens
  misc_feature 221: n=a, g, c or t
aagactatactttcagggatcatttctatagtgtgttactagagaagtttctctgaacgtgtagagcaccgaaaaccacgaggaagagaggtagcgttttctcctgagcgtgaascggctttctggcgttgcttggctgcaactgccgtcagccattgatgatcgttcttctctccgtattggggagtgagagggagagaacgcggtctgagtggaaaatnaaag

SEQ ID NO: 16993 - DNA, 242 bp, Homo sapiens; identical to SEQ ID NO: 16952

SEQ ID NO: 16994 - DNA, 231 bp, Homo sapiens; identical to SEQ ID NO: 16956

SEQ ID NO: 16995 - DNA, 231 bp, Homo sapiens; identical to SEQ ID NO: 16956

SEQ ID NO: 16996 - DNA, 237 bp, Homo sapiens
aagactatactttcagggatcatttctatagtgttttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgatagggagagaacgcggtctgagtggaagaaaaaaaaaaaaaaaaag

SEQ ID NO: 16997 - DNA, 242 bp, Homo sapiens; identical to SEQ ID NO: 16952

SEQ ID NO: 16998 - DNA, 237 bp, Homo sapiens
aagactatactttcagggatcatttctatagtgttttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgatagggakagaacgcggtctgagtggaagaaaaaaaaaaaaaaaaaa

SEQ ID NO: 16999 - DNA, 224 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaawbaa

SEQ ID NO: 17000 - DNA, 372 bp, Homo sapiens
ccttcaaatctagattccaaattacagaaatgcagtcattgtagctaagtctcctgatgctgcaaagaggtaagtaagctagacatgggtcctgatccctcctgagtgctcccgaagtcagaatgagctgctttggaatccagaggctgtcactcgtggcctttgaaagcccactggctctcatgttaacccctccatcgttgtcatgtcccatgccacacacagctttatctccagcctccagacagcacacatgatcgctgagttgctcagctttcctctgggaaaacaaagttccttcaagttctcagagaaaggaaagcaatgaggctatgagcatttttcaagcaatggtttttttttttgtttttt

SEQ ID NO: 17001 - DNA, 233 bp, Homo sapiens
  misc_feature 221: n=a, g, c or t
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaanaaaaaaaaaaaa

SEQ ID NO: 17002 - DNA, 220 bp, Homo sapiens; identical to SEQ ID NO: 16944

SEQ ID NO: 17003 - DNA, 235 bp, Homo sapiens
aagactatactttcagggatcatttctatagtgttttactagagaagtttctctgaacgtgtagagcaccgaaaaccacgaggaagagaggtagcgttttctcctgagcgtgaascggctttctggcgttgcttggctgcaactgccgtcagccattgatgatcgttcttctctccgtattggggagtgatagggagagaacgcggtctgagtggaagaaaaaaaaaaaaaaaaa

SEQ ID NO: 17004 - DNA, 232 bp, Homo sapiens; identical to SEQ ID NO: 16929

SEQ ID NO: 17005 - DNA, 241 bp, Homo sapiens; identical to SEQ ID NO: 16990

SEQ ID NO: 17006 - DNA, 231 bp, Homo sapiens; identical to SEQ ID NO: 16956

SEQ ID NO: 17007 - DNA, 234 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtaaaaaaaaaaaaaaaaargc

SEQ ID NO: 17008 - DNA, 243 bp, Homo sapiens; identical to SEQ ID NO: 16972

SEQ ID NO: 17009 - DNA, 235 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtggaaaataaagaaaaaaaaaa

SEQ ID NO: 17010 - DNA, 241 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagaaaaaaaaaaaaaggaaaaaaaaaaaaa

SEQ ID NO: 17011 - DNA, 474 bp, Homo sapiens
aaagtgctggattccaagggactggaagggaaagtccctaaaaatcacgagttcaggcgtctgagacttggtgggaacggaccttcctcttagtgcccaagcctgttctaatttttaaaaactgatgtctattaagacccaatgttaactttatgaaaatggttcctaaggagattcacatctctgtgtccgaattctgtgtgcagcaaacatcatctcaagtgcgttttcccaactacgcttctttccaggataaaatactctaagtgacaaatgttgagtacattatcagaaaagttcaagggaagagaacaggctcaagtctacttctcacgctggctctggggattaggaaattcagaaagttttgtttcagactggcagtgctgtctgatataaacacagcgtcaagtactgcacgctgtagctacctgaggtttaggccggaagaggcacggctgatttaaaagtgaa

SEQ ID NO: 17012 - DNA, 232 bp, Homo sapiens; identical to SEQ ID NO: 16929

SEQ ID NO: 17013 - DNA, 228 bp, Homo sapiens
aagactatactttcagggatcatttctatagtgtgttgctagagaagtttctctgaacgtgtagagcaccgaawacbacgaggwagagaggtagcgttttctcctgagcgtgaagctggctttctggcgttgcttagctgcaactgccgtcagcbattgatgatcgttcttctctccgtattggggagtgagagggagagaacgcggtctgagtggtgaacaaaagad

SEQ ID NO: 17014 - DNA, 236 bp, Homo sapiens; identical to SEQ ID NO: 16941

SEQ ID NO: 17015 - DNA, 242 bp, Homo sapiens; identical to SEQ ID NO: 16952

SEQ ID NO: 17016 - DNA, 240 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaaaaaaaaaaaarscaaa

SEQ ID NO: 17017 - DNA, 233 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtaaaaaaaaaaaaaaaaaag

SEQ ID NO: 17018 - DNA, 231 bp, Homo sapiens
aagactatactttcagggatcatttctatagtgtgttactagagaagtttctctgaacgtgtagaacaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaaaaaaaaa

SEQ ID NO: 17019 - DNA, 254 bp, Homo sapiens
  misc_feature 235: n=a, g, c or t
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaaaaaaaaaaaancscaaaaaaaaaaaaaaaa

SEQ ID NO: 17020 - DNA, 232 bp, Homo sapiens
aagactatactttcagggatcatttctatagtgtgttactagagaagtttctctgaacgtgtagaacaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaaaaaaaaaa

SEQ ID NO: 17021 - DNA, 232 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtaaaaaaaaaaaaaaaaag

SEQ ID NO: 17022 - DNA, 253 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaaaaaaaaaaaarscaaaaaaaaaaaaaaaa

SEQ ID NO: 17023 - DNA, 237 bp, Homo sapiens
aagactatactttcagggatcatttctatagtgttttactagagaagtttctctgaacgtgtagagcaccgaaaaccacgaggaagagaggtagcgtttttctcctgagcgtgaagccggctttctggcgttgcttggctgcaattgccgtcagccattgatgatcgttcttctctccgtattggggagtgatagggagagaacgcggtctgagtggaagaaaaaaaaaaaaaaaaa

SEQ ID NO: 17024 - DNA, 231 bp, Homo sapiens; identical to SEQ ID NO: 16956

SEQ ID NO: 17025 - DNA, 232 bp, Homo sapiens; identical to SEQ ID NO: 17020

SEQ ID NO: 17026 - DNA, 220 bp, Homo sapiens; identical to SEQ ID NO: 16944

SEQ ID NO: 17027 - DNA, 230 bp, Homo sapiens
aagactatactttcagggatcatttctatagtgtgttactagagaagtttctctgaacgtgtagagcaccgaaaaccacgaggaagagaggtagcgttttctcctgagcgtgaascggctttctggcgttgcttggctgcaactgccgtcagccattgatgatcgttcttctctccgtattggggagtgagagggagagaacgcggtctgagtaaaaaaaaaaaaaaaaa

SEQ ID NO: 17028 - DNA, 231 bp, Homo sapiens; identical to SEQ ID NO: 16956

SEQ ID NO: 17029 - DNA, 231 bp, Homo sapiens
aagactatactttcagggatcatttctatagtgtgttactagagaagtttctctgaacgtgtagagcaccgaaaaccatgaggaagagaggtagcgttttctcctgagcgtgaagccggctttctggcgttgcttggctgcaactgccgtcagccattgatgatcgttcttctctccgtattggggagtgagagggagagaacgcggtctgagtaaaaaaaaaaaaaaaaa

SEQ ID NO: 17030 - DNA, 242 bp, Homo sapiens; identical to SEQ ID NO: 16952

SEQ ID NO: 17031 - DNA, 231 bp, Homo sapiens; identical to SEQ ID NO: 16956

SEQ ID NO: 17032 - DNA, 491 bp, Homo sapiens
attcttcttttggaacccagatgtctagaccagcagaaactgaagtgcatactcagagcctcgtttttcagcatgacctccagtgagcacacataagtaaacagaagcttaaatttgcttaaaaaataagagcaaaaatgttttgaattaaatcttattcagccaacgtggttagagatggaaatgtgacaagctctcaagtgaacatgaagaagcatcttggaaatactattatccctaacccatctcattgagttcacagtgtgtaactgcatctgaacatgtttagttgctttacaggtgacagcaactcaacattgattagagactggaagaaagaagaaaaatcatatcctctcaaatttaacacaatttacaaagaaatagtgttcacttaaaatattagaaaggggaaaagtatgtttgctttgtttttaccaggagcttataaatgtgctttgtatcagaagtgcatgctctatgtctgcaca

SEQ ID NO: 17033 - DNA, 254 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaaaaaaaaaaaarssaaaaaaaaaaaaaaaaa

SEQ ID NO: 17034 - DNA, 236 bp, Homo sapiens; identical to SEQ ID NO: 16941

SEQ ID NO: 17035 - DNA, 231 bp, Homo sapiens
aagactatactttcagggatcatttctatagtgtgttactagagaagtttctctgaacgtgtagagcaccgaaaaccacgaggaagagaggtagcgttttctcctgagcgtgaagccggcttkctggcgttgcttggctgcaactgccgtcagccattgatgatcgttcttctctccgtattggggagtgagagggagagaacgcggtctgagtaaaaaaaaaaaaaaaaa

SEQ ID NO: 17036 - DNA, 230 bp, Homo sapiens; identical to SEQ ID NO: 17027

SEQ ID NO: 17037 - DNA, 225 bp, Homo sapiens; identical to SEQ ID NO: 16968

SEQ ID NO: 17038 - DNA, 223 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtaaaaaaaaa

SEQ ID NO: 17039 - DNA, 247 bp, Homo sapiens
aaagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaagaaaaaaaaaaaaaaaaaaaaaaaaaaaa

SEQ ID NO: 17040 - DNA, 237 bp, Homo sapiens
agactatactttcagggatcatttctatagtgtgttactagagaagtttctctgaacgtgtagaacaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtggaaaaaaaaaaaaaaaaaaaaaa

SEQ ID NO: 17041 - DNA, 231 bp, Homo sapiens; identical to SEQ ID NO: 16956

SEQ ID NO: 17042 - DNA, 242 bp, Homo sapiens; identical to SEQ ID NO: 16952

SEQ ID NO: 17043 - DNA, 487 bp, Homo sapiens
ctgacttctgagtttatagaagtttcagttctgaagtttaagaggagtttcacttcatcccttttcattttgaaggcagctgaaaaagttggatgaagatagtttaaccaaacaaccagaagaagtatttgatgtcttagagaaacttggagaagggtgagtgtaaagaaactataggtaggtcattgggtcccagtctttttcctgccccagaagaagcagaaggatatgaacctttcagcattgttctaggtggggtggaaggtaaatttacagcttgtgatgtccttcttcgctttactccaatccctattatagacagatttagtgattcctggtctttttaacacgaagaatatctattgttttctcttttgtagsatctgtatgattttatctacttaacagatagcactaattagattaarattctataagaaactttttaatttgctgttcataatttctgattggtatgcataactgt

SEQ ID NO: 17044 - DNA, 220 bp, Homo sapiens
aagactatactttcagggatcatttctatagtgttttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgatagggagagaacgcggtctgagtggaaga

SEQ ID NO: 17045 - DNA, 230 bp, Homo sapiens; identical to SEQ ID NO: 16977

SEQ ID NO: 17046 - DNA, 242 bp, Homo sapiens; identical to SEQ ID NO: 16952

SEQ ID NO: 17047 - DNA, 241 bp, Homo sapiens; identical to SEQ ID NO: 16973

SEQ ID NO: 17048 - DNA, 253 bp, Homo sapiens
aagactatactttcagggatcatttctatatatgttactagagaagtttctctgaacgtgtagagcaccgaaaaccacgaggaagagaggtagcgttttctcctgagcttgaagccggctttctggcgttgcttggctgcaactgccgtcagccattgatgatcgttcttctctccgtattggggagtgagagggagagaacgcggtctgagtgaaaaaaaaaaaaaaaaaaasscaaaaaaaaaaaaaaaaa

SEQ ID NO: 17049 - DNA, 270 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaaaaaaaaaaaaaaaaaaaaaaaaaaaaaaaammaaaaaaaaaaaaaa

SEQ ID NO: 17050 - DNA, 220 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaga

SEQ ID NO: 17051 - DNA, 228 bp, Homo sapiens
aagactatactttcagggatcatttctatagtgtgttactagagaagtttctctgaacgtgtagagcaccgaaaaccacgaggaagagaggtagcgttttctcctgagcgtgaascggctttctggcgttgcttggctgcaactgccgtcagccattgatgatcgttcttctctccgtattggggagtgagagggagagaacgcggtctgagtggaaaataaagaaaa

SEQ ID NO: 17052 - DNA, 231 bp, Homo sapiens
aagactatactttcagggatcatttctatagtgtgttactagagaagtttctctgaacgtgtagagcaccgaaaaccacgaggaagagaggtagcgttttctcctgagcgtgaaccggctttctggcgttgcttggctgcaactgccgtcagccattgatgatcgttcttctctccgtattggggagtgagagggagagaacgcggtctgagtaaaaaaaaaaaaaaaaaa

SEQ ID NO: 17053 - DNA, 245 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtggaaaataaagaaaaaaaaaaaaaaaaagsc

SEQ ID NO: 17054 - DNA, 500 bp, Homo sapiens
atctttgggagctgcatttttgataaataaggtgagcaaagaggttacataactcacccaaagccagagttagtaaatggaagaactggaatttgcaccccggcaatcttgctccatgtggtggattgctatagtaaacggttcatcacaatgaaaaccttagagatgtaatgtctcatgtcacacagtgagtctgtaaggcgtttaggaatagaatctggctcaactggctggatcacacgtatgacttcttcactgccaaacccagagtaatggaagccccatggctggatactttgttgtttatattccacgtgtttattatactgtaggagcatgagtggattcaatgcttttaaaaagcacccagtgaaataaaaaatcccactgtagtttggcaaaaatggaagtaatgacaaagaatgtctgaacacattttaattagagctactggtctgttcttgacctctctcttctgttaaatccaggacaatgtcttt

SEQ ID NO: 17055 - DNA, 232 bp, Homo sapiens; identical to SEQ ID NO: 17020

SEQ ID NO: 17056 - DNA, 253 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaaaaaaaaaaaaagcaaaaaaaaaaaaaaaa

SEQ ID NO: 17057 - DNA, 231 bp, Homo sapiens
aaagactatactttcagggatcatttmwatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagcaaaaaaaaaaaaaaaa

SEQ ID NO: 17058 - DNA, 225 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtggaaaataaag

SEQ ID NO: 17059 - DNA, 224 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaa

SEQ ID NO: 17060 - DNA, 232 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtaaaaaaaaaaaaaaaaaa

SEQ ID NO: 17061 - DNA, 220 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtggaaaa

SEQ ID NO: 17062 - DNA, 232 bp, Homo sapiens
aagastatactttcagggatcatttctatagtgtgttactagagaagtttctctgaacgygtagagcaccgaaaaccacgaggaagagaggtagcgttttctcctgagcgtgaaccggstttctggcgttgcttggctgcaactgccgtcagccattgatgatcgktgcttctctccgtattggggagtgagagggagagaacgcggtctgagtggaaaataaagaaaaaak

SEQ ID NO: 17063 - DNA, 253 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaaaaaaaaaaaagccaaaaaaaaaaaaaaaa

SEQ ID NO: 17064 - DNA, 256 bp, Homo sapiens
  misc_feature 77,156: n=a, g, c or t
aagactatastttcagggatcattttctatagtgtgttactagagaagtttctctgaacgtgtagagcaccgaaaancasgaggaagagaggtagcgttttytcctgagcgtgaagccggctttctggcgttgcttggctgcaactgccgtcagcnattgatgatsgttcttctctccgtattggggagtgagagggakgagaacgcggtctgagtgaaaaaaaaaaaaaaaaaaascgcaaaaaaaaaaaaaaaa

SEQ ID NO: 17065 - DNA, 219 bp, Homo sapiens
atacttagcaccatttcactaaggaaccttgaatacaaccaggatcctcctttgcatgcgactgtagctgcatttcatgaatagtttgaacccttgtcaatgcattttttgaaaaagaaagaaaaaaaaaaacttcgtgtatgtgactcaaagcatgtaaccttaagatgttgcattctaaactgacaataaagacctttcccaaaaaaaaaaaaaaaa

SEQ ID NO: 17066 - DNA, 242 bp, Homo sapiens; identical to SEQ ID NO: 16952

SEQ ID NO: 17067 - DNA, 261 bp, Homo sapiens
aaagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtggaagaaaaaaaaaaaaaaaaaaaaaaaaaaaaaaaaaaaaaaaaa

SEQ ID NO: 17068 - DNA, 226 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagaaaaaaaaaaaaa

SEQ ID NO: 17069 - DNA, 236 bp, Homo sapiens; identical to SEQ ID NO: 16941

SEQ ID NO: 17070 - DNA, 236 bp, Homo sapiens; identical to SEQ ID NO: 16941

SEQ ID NO: 17071 - DNA, 241 bp, Homo sapiens
aagactatactttcggggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttmtctccgtattggggagtgagagggagagaacgcggtctgagtggtaaaaaaaaaaaaaaaaaaaaaaaa

SEQ ID NO: 17072 - DNA, 235 bp, Homo sapiens; identical to SEQ ID NO: 17003

SEQ ID NO: 17073 - DNA, 242 bp, Homo sapiens; identical to SEQ ID NO: 16952

SEQ ID NO: 17074 - DNA, 253 bp, Homo sapiens; identical to SEQ ID NO: 16946

SEQ ID NO: 17075 - DNA, 231 bp, Homo sapiens; identical to SEQ ID NO: 16956

SEQ ID NO: 17076 - DNA, 487 bp, Homo sapiens
tattaaaaaaaatgtcgtttaacttcttgtttgtttcagtgtaatgctcttaaagtcatagcatgaaaataattgaactgtcctattcttagtagtttgaaataatagtatttttgtatgttttgggtgtgtctatgtatgtattaacataacagttttcactgcctaggtgttcataataaaaaagaaaatgaaaaaagttctgagtgtacataatattcaataataatctcccaccaggtgtcaatttagattgcatattcctcattactgttcccaactgggattttgttttcttttaaagagacagtgatcgtgtttttctaaagatgttttctttctctctttcaatatcttaactcactttttttttcttccttttttgtcttaattattaattcaggggtgtttgtccactgttgtcaaaggaggggcacaaggggaattggcccccggctcctagaactttttgttttatgtactttaa

SEQ ID NO: 17077 - DNA, 253 bp, Homo sapiens; identical to SEQ ID NO: 16946

SEQ ID NO: 17078 - DNA, 235 bp, Homo sapiens
aagactatactttcagggatcatttctatagtgttttactagagaagtttctctgaacgtgtagagcaccgaaaaccacgaggaagagaggtagcgttttctcctgagcgtgaascggctttctggcgttgcttggctgtaactgccgtcagccattgatgatcgttcttctctccgtattggggagtgatagggagagaacgcggtctgagtggaagaaaaaaaaaaaaaaaaa

SEQ ID NO: 17079 - DNA, 231 bp, Homo sapiens; identical to SEQ ID NO: 16956

SEQ ID NO: 17080 - DNA, 233 bp, Homo sapiens; identical to SEQ ID NO: 16928

SEQ ID NO: 17081 - DNA, 236 bp, Homo sapiens; identical to SEQ ID NO: 16941

SEQ ID NO: 17082 - DNA, 231 bp, Homo sapiens; identical to SEQ ID NO: 16956

SEQ ID NO: 17083 - DNA, 231 bp, Homo sapiens; identical to SEQ ID NO: 16956

SEQ ID NO: 17084 - DNA, 418 bp, Homo sapiens
atttacacgccttgtggggctggcaaatgttccaaatctgccactatgaaataattggcagcaaggatgggaaaaagaaaaacctcattttaatggtccttacctctggtttggctttcacagtgaagccaaaccaggacagcttgttacacagagtctggaaagcagcccttcatgttgggattctggaattgggtcactgccgagtcagatttcaataaggaaaacatacttgaaaatcatgctgaccaactatattgatgacattaggctaatttgacatggtagacaagaaattccaagtactgttctdtgcattattggtaactgtgtctgctgtgctttggaataaggtccaagatttgaaaatgactttggaactctctcaagaaatcccttatccaagaaatacggataa

SEQ ID NO: 17085 - DNA, 249 bp, Homo sapiens
taaaaggaaaaaaaatgttttgaaacagataatagacttacataaagtgttgctgggatgttgtgggctctaaagctgttgtttgcagcaggtaccagactggtgcatctggatgacctccccccatagtacctgcagcattttggggtgtttgggtgaaggtggattgttgacagcacataaccagcatttagattttaaggatctgcctttagatatgggttcatggccaaaaaaaaaaaaaaaaag

SEQ ID NO: 17086 - DNA, 513 bp, Homo sapiens
  misc_feature 297: n=a, g, c or t
gactgctgccttatgctcttgggtgaacgaggcttggtgtagatggcgtttcccgctaacttctcaggcccctgctgtgtgtgaggctgttccagctcccttggggctggactcccgagccttttttcttcggcagcgttctccacagatgcctgggcaccctgttccctcctgatgctctgccttcccacctctttgaagtgccttttctggatgctccttgggcccatgaggactctattcactttttgctggttttggcctacagtttgaatctttgccaggctgtttcctgtngttggcagtttaatgaacggtagtaacattgattccacatctaggtttactgctgagaaatatggcaaatgtaacttagagcactgataacctcactctcgtcattggtgtctagctgctcactcccaaagcctgacaagttgatgccactgctgtctgagggctcctccggctcaacagtcagctcagtgcttgtgtaattcttccgggctttta

SEQ ID NO: 17087 - DNA, 223 bp, Homo sapiens
  misc_feature 42: n=a, g, c or t
acttaagacagaggggcggcggcgggcagcagctgcgccganctgctctggaaggagaggacggggcacaaaccctgaccatgaccccccacaggctgctgccaccgctgctgctgctgctagctctgctgctcgctgccagcccaggaggcgccttgrcgggttgcccaggcwgcgggcaaggggtgcaggcgggttgtccagggggctgcgtggaggagga

SEQ ID NO: 17088 - DNA, 308 bp, Homo sapiens
agagacagatgcgaggcggcggtcagaggccctgcctgarctgccccctggggagccggaattccgctgccctgaacgcgtgatggatctcggcctgtctgaggaccacttctcccgccctgtggtctgttcctggcctctgacgtccagcagctgcggsaggcgatcgaggartgcaagcaggtgattctggagctgcccgagcagtcggagaagcagaaggatgccgtggtgcgactcatcsacctccggctgaagctccaggagctgaaggaccccaatgaggatgagccaaacatccgagtgct

SEQ ID NO: 17089 - DNA, 487 bp, Homo sapiens
aaagaggatattcaccaccatgttcccatccggtctttcccctgccttgctttgtgcagcaggtgggcagacagagcccacagaaacagaagtagaaagagggccgcaccatctctggggccagcactcctaagtcttagctctttgtgggaatagaaaatcctgagctcccaccacctctcgtctgaccctccatcaactccctcgaacctgtgcaaatggactgagcaaaagaaaatggaaagagatgtttgtcaccacacaggagacctcctttctggccccaagcacaactccatctctgcgtatgctcagaaactcagaatttagctgctacttatgtgttagctccattctctctggtgtgtgactgagagaacacgccagkttcttactgacagaggcttaggggtgacctctctggacccagaggaagtacaacctctgtagcgagaattgtccttgggaacagaacaggcattcctcc

SEQ ID NO: 17090 - DNA, 506 bp, Homo sapiens
  misc_feature 205,208: n=a, g, c or t
atcagtcttctaatatcagtctctaagggtatagtcatatatgcaaaaataatagcccttaggaaatatatttaggcctaaatctctaagctaaggatggatttgatagtaaaaatacattaaaattataaatagctccaaggcccacacactgcccatgactttataaaatgttcttgcattcaggttatacagccagagtctnaancagaaagccagagtgttcctctagtgtgtggatttgattttgtgtctttgtgcttcctgttgcctcctggtgaacgcagtytgacctttcctttgtttgcaggtatgcttcagaagtgtccttctgttgatgacttcgtaagtgccctcgtttccgacttggatctggacttcgaaactttcctcatggattctgaataaaagaaacactctacacctcttaaatcaaggtcatgtagataatgactktgttataaatgctacagctgtgagagcttgtttctgatttcattgttcgc

SEQ ID NO: 17091 - DNA, 214 bp, Homo sapiens
aagtcaggaggccccgcttcggctaacgcttgcgatggttgaattcccctcctcacgccagcctaggagaagaagttcgtagtcccagaggtgaggcaggaggcggcagtttctggcgggtgagggcggastgaagtgacagcggaggcgaarcaacggtcggtggggcggagaagggggctggccccaggaggaggaggaaacccttccgaga

SEQ ID NO: 17092 - DNA, 291 bp, Homo sapiens
ggggacagcggcggcggggacggggggcggcggcggcagagtagccctaaccgctccaggtgctgccgacgctccgggtgcgggggccaccgcgggcatccactggtggtcagcaggttccaggctggtgtttacaatctcggaggaagtgcgatggtttctgttcttttgacagttcagtctgatttcaagtcagtcgaaagcgaaccagaagcaccgggcacagcagctcctctggctgtgtagacagacctkggcaatgtggccgtgcagcccagacgatcagagaga

SEQ ID NO: 17093 - DNA, 508 bp, Homo sapiens
attaactctctctcttctcctaaagaatatatacacagtgggtaagaattgcaaaataattgggtgtttcaaagacagggatgatgcacttttataaaaaaattttaatacacaagtcctctctaagcatggatatatatataaaaacagtgccagactaggagtatggagacctgggttctgggttcacctctgatgcaggctgtgtgacattaagcaaatcctaacctcttgggactgtcttttcatctgcaaaatgaagaggtagaatttagtaagtttgcgtcccatcaatgcttaaaattctataattcagaaaggcaggccattctacctagtttcatcccgctttagctcagccttactcagatatgctggccagatgtttctaatcttacacataaaagactctggtattcagaggccaaaagaaactggacaatttaagaaaagtactaagcagatgagttttccttctgtctgattcttaacagctacatgacaatta

SEQ ID NO: 17094 - DNA, 414 bp, Homo sapiens
  misc_feature 267: n=a, g, c or t
agctgcgttggctgtagaagagaacggacggcgatggcgacggtcgcagcaaatccagctgctgctgcggcggctgtggsggcggcacggcggtgactgaggatagagagccacagcacgaggagctgccaggcctggacagccagtggcgccagatagaaaacggcgagagtgggcgagaacgtccactgcgggccggcgaaactggttccttgtggagaagcactggtataagcagtgggaggcatacgtgcagggaggggacmnggactccagcaccttccctggctgcatcaacaatgccacactctttcaagatgagataaactggcgcctcaaggagggactggtggaaggcgaggattatgtgctgctcccagcastgcttggcattacctggtcagctggtatggt

SEQ ID NO: 17095 - DNA, 235 bp, Homo sapiens
attttaggtggtccgcggcggcgccattaaagcgaggaggaggcgagasggccgccgctggtgcttattcttttttagtgcagcggagagagcgggagtgtgcgccgcgcgagagtgggaggcgaagggggcaggccagggagaggcgcaggagcctttgcagccacgcgcgcgccttacccctccctttccagagaaataaactcttcccgtcgctctgccaaaaaaaaaaaaa

SEQ ID NO: 17096 - DNA, 261 bp, Homo sapiens
  misc_feature 85: n=a, g, c or t
attttaggtggtccgcggcgggccattaaagcgaggaggaggcgagasggccgccgctggtgcttattcttttttagtgcagcgngagagagcgggagtgtgcgccgcgcgagagtgggaggcgaagggggcaggccagggagaggcgcaggagcctttgcagccacgcgcgcgccttacccctccctttccagagaaataaactcttcccgtcgctctgccaaaaaaaaaaaaaaaaaaaaaaaaaaaaamaaaaaaaaa

SEQ ID NO: 17097 - DNA, 83 bp, Homo sapiens
attttaggtggtccgcggcggsccattaaagcgaggaggaggcgagasggccgccgctggtgcttattcttttttagtgcagc

SEQ ID NO: 17098 - DNA, 72 bp, Homo sapiens
agcaacggagagacgcacgctctgcacagtctattttcggagcctagccagagacgggaaaactgaccaagc

SEQ ID NO: 17099 - DNA, 449 bp, Homo sapiens
aatttggagcctgcgcagtcagatccgaggacatgttgacgtcgtccgagagtcttaaaatcctgctgtggccggattccagactcgtgggggaaaggctgatggagtttcgctcttgttgcccaagctggagtgcaatggtgccatctcggcttactgcaacctccgccccctggcttcaagcagttctcctgcctcagcctcctgagtagctgggattgcaggtgcctgccaccacgtccagcaaatttttgtatttttggtagagatggggtttcaccatgttggccaggctggagaaacgccatctctactaaaaatacaaaattagctgggcatggtggcacatgcctgtaatcccagctacttgggaaggctgaggcaggagaatcacttgaacctgggaggtcgaggttgtggtgagccgagatcgcaccattgtactccag

SEQ ID NO: 17100 - DNA, 710 bp, Homo sapiens
acttccggagaaaacagttcccctccggccggacagtggtagcggcccgacccgttctagagacggagcgggtgaaacatttttcagaagggggttattccactggaacctcgagggtggatcggagtcacgtggcgcagacgctgaaggtggatccggctacgagagtgcgcaggcgsagtgttcgccctctcgccacgaagtaaacaagtgggagggtctgagagctgcaccacctggggcaagcacgccttgaaacgcccacttccttctccatattgtatactggaattgaagccaaggaggtaccattttgctcgagggcatggcctaagccggtcagctaaggccatgttaatacggggctgtcccatctctctgcggggcgcgacastggaagagccgaacggataagagaagaggaggtgagaggagctgtacaccacaagaggcactgagggactcaggataacgggatgaagccgtcagtgcccccagaaacgaagcggccccggacgaatttctgagtcaccgtcgcgagaaagcgggctgagccgccattttgaagcctggcaaaccgaagcaagaaatgctgccgtgttggatctttgccagccttcgtgccgaatgggagcaggttggagggagggagagccaatatacactatgggctgattaagccggttggctgccatgttgttaacgagcac

SEQ ID NO: 17101 - DNA, 482 bp, Homo sapiens
catttcttgccaagccctgtgacactccccattgatgactcccataggtacagataaagttaagaacaggaaacagaagggtaggatgcatagggagggagagaagccctgaaaactttttttttctttttgaagcatggaaaacaaatcttttatgccactccagccataaataaaattttaacttcaaccctgtgtgctcagtgtttctttagttatgccaaggcttgctagaatgttatttagtgagaatttttagcttgagttgccacccaactgtgaaatcaactaaatgattacttgaatgtatttaaatgttttaaaaagcaaacattataaatttttctttaatgtcatttagtaagtgcagtcagggaatatctgaatctaagagctggccagacacagggtatagcagaattacaagcatagaggatgctatgcagtgggatgtaaagctcattacagcccatttttaagaa

SEQ ID NO: 17102 - DNA, 534 bp, Homo sapiens
ggcttttatatgcagttctggagttgggcaacacctcattctataaagtgagtgttcttatgagctgagcagagaagtttggttttatagacagaaaagggctgaggaaagcagaaacagaaaacaaaaaaagcagattgattgtttcagagcgacttttccttgtaaaggttagcagagggacttccttcacatgctggctaaaatgggcttgcttagggtttggctgccagctctccgtctcctgacttctcagaaggtcatataaaccaattagttttggctcggtcgtgtggaacttttagcatgagggactccattttggtttggtttattgggccgcgtgcaggagctcagtccaaaccagtggccctcatcaatttcacttaatatttatgcaaagcagttcagcaaggtaaaaggaggggagtcaacagggaaggctggatggcctagacccttgaagcctgcaggaggacattaatttggggggaatttgtttcatccttgaggcagtgctaaaatatatcatga

SEQ ID NO: 17103 - DNA, 434 bp, Homo sapiens
  misc_feature 171..172,174,183..186: n=a, g, c or t
gccggccaggaaccacccgttaagggatggtgaggttggaaaaaggctcctgtaaccctcctccaggatgaaccacctgccagaagacatggagaacgctctcamccgggraagccagagctcccatgcttctctgcgcaatatccattccatcaaccccacacaactmanngnbargattsnnnncctatgaaggaagggaaaagaaaggcatatctgatgtcaggaggactttctgtttgtttgtcacctttgacctcttattcgtaacattactgtggataatagagttaaatgtgaatggaggcattgagaacacattagagaaggaggtgatgcagtatgactactattcttcatattttgatatatttcttctggcagtttttcgatttaaagtgttaatacttgcatatgctgtgtgcagactgcgc

SEQ ID NO: 17104 - DNA, 442 bp, Homo sapiens
  misc_feature 30: n=a, g, c or t
atccgcagttcccgggccagcctggggcgncggccaggaaccacccgttaaggtgtcttctctttagggatggtgaggttggaaaaaggctcctgtaaccctcctccaggatgaaccacctgccagaagacatggagaacgctctcaccgggagccagagctccattgcttctctgcgcaatatccattccatcaaccccacacaactcatggccaggattgagtcctatgaaggaagggaaaagaaaggcatatctgatgtcaggaggactttctgtttgtttgtcacctttgacctcttattcgtaacattactgtggataatagagttaaatgtgaatggaggcattgagaacacattagagaaggaggtgatgcagtatgactactattmmttcatattttgatatatttcttctggcagtttttcgatttaaaagtg

SEQ ID NO: 17105 - DNA, 542 bp, Homo sapiens
aaacagaattaaagaagaaagcagtaacagaaagatatctagataatccccatatattagaaattaaatgcatttttaaatagcccatagtcaaaaagtcgtcagggaaattagaaaacatcttgaatagaatggaaacaaacagacaacatgtcaaaagatatgatccagccaaagcgctattgaggaaattaaagcagttagtgatttaaaaatctcagatctcccatataaacttccacattaagaaaatagaaaaagaagagcaaattataatgaaagtaatcagaaggaaggaawtwgacaaaagcmcaactatgaagaagcagaaaattwaaatagaaaacattaaaagaaagctggttctttgagaagatcaataaatttaatgaactttagccagactaatcaggaaaagagaagacacattacaaattgcagaattgaggaagaagggacatcactactgatcctacagatgctaaaaaatagrtwatagaatattaacgattttatgccagtaaacttttaagtttaatgga

SEQ ID NO: 17106 - DNA, 92 bp, Homo sapiens
aaaaacgcgacggcggaggcgctttgctctcaccggggtcgagccgcggcgagggaacggatcggagacgctgcgcctgctcagaaggtagc

SEQ ID NO: 17107 - DNA, 477 bp, Homo sapiens
  misc_feature 362: n=a, g, c or t
aaattgctgtttagaaagatcaggacaaggttatgatttctcacccaagttcctggggaaaaggatcatgagggaattacttattaacaaggaaaaagcaaagaggaactttacaaactattacagttttccatcatcacttgactgctgacaagaagcctctttgaattccagtatacacgatcacattttaaaaccttcaagacgccgtttaatcaggagttgtaggcacatttgttagagagagctgcactttaaaaattatacagacatcacctgaagttattaaagttatcaaaacatattaaaaaccttcaagtaagaggctactccccaggaaacgtgtggagccagtgaacggnagaaaaacaattgaagggaaggcttgaaaagtccattacaaaactacagtcctttgaaaaagatttcaaagatattaaaatgaaaactgattacattaaacaataacttaaactt

SEQ ID NO: 17108 - DNA, 411 bp, Homo sapiens
agcgggtctccaggacctggcattaggacgtgcgtgttagggggcaggtatttggagccaggccccactttcgagttgtctttccgcagaccagagactgcggacggggccaggaaccaggaaccgttaggragataaggaaggtgttatagcccacattcatcctatacggccacaaggccgkgggccaggctgcctcctcacagcatcagctttttcttcggcttcatttccctctggaaagcgctttctcacagacgctgcaaagaccgaagggcagcccctgccctgctaccctccagggagccaccgctctagagcccaggctcctctggacatcatgtgacttgggggacgacttgcctttcttctgaaacacggctacagactataactttaaaacacggggct

SEQ ID NO: 17109 - DNA, 332 bp, Homo sapiens
agatccgaggacatgttgacgtcgtccgagagtcttaaaatcctgctctggccggattccagactcgtgggggaaaggctggatttcaacagatcacatggatcaaggccttagggaggtggttggggattcacgtatgccctggaccatctggagcccaagttgctgcagatcctgtcaccacgagtggacaccctctggccaccatagcaaagaagtctgaggcaggagaatcacttgaacccaggaggcagaggttgcagtgagccgagatcgcaccacagcactccagcctgggctatagagcaagactccttctcaaaaaaaaaaaa

SEQ ID NO: 17110 - DNA, 139 bp, Homo sapiens
gaggacgcccgcgagtcgggacggtggtggcagcctgtagcggtgggtctcgtccttccagggcctgcgggctctggaacgggaagtctccccagcggcagcacttgctgtggactggctgcccatgggcgatttgtgg

SEQ ID NO: 17111 - DNA, 402 bp, Homo sapiens
tttctcccggaacctctgctcagcctggtgaaccacacaggccagcgctctgacatgcagaaggtgaccctgggcctgcttgtgttcctggcaggctttcctgtcctggacgccaatgacctagaagataaaaacagtcctttctactatgactggcacagcctccaggttggcgggctcatctgcgctggggttctgtgcgccatgggcatcatcatcgtcatgagtgagtggaggagctcgggggagcaggcgggccggggctggggctcccctcccctgamcactcagctctccccaacaggtgcaaaatgcaaatgcaagtttggccagaagtccggtcaccatccaggggagactccacctctcatcamcccaggctcagcccaaagctgatgaggr

SEQ ID NO: 17112 - DNA, 449 bp, Homo sapiens
atttttattagagacggggtttcaccatgttgcctaggctggtcttgaactcctgacctcaggcgattcacccgcctcggcctcccaaagtgttaggattacaggcgtgakcaccgcgcccggcttgawttgtacacttcaaaaggtggaattttatggtgttgaattatatctttatttttttaacggggggaaaattgacgccgctggagaggagttagcggaactgaaacaatgaaatggtgcgcgagtgtcgcctgtccccgtcgcatccatcccaacgaaktttgggccctggaacggtgcacccagaaggcctgcggggagagacgctgaggcatgatctggaagaaagacgtctcaggattcgaagggaatgcagctaaggtggcggcggaggttcgcctaggactgggggaggcgtccctaggwmtcagaagttggcccgg

SEQ ID NO: 17113 - DNA, 510 bp, Homo sapiens
acattaaaggcatttttgtccttctgtactgtaggagaaaatcacgacatttcaccaggctactcaggaatactgtggtttcattttatggtgctcaggtgttttaaaattatacatcaaaaccaagtgttcagmawtgccaaaagggatgaaatgaagcttttttctttctatagttgaaaaattccttcaagcaagtgctgacatgtttccatcgaaactgtacattttttcagtggaatggcaaaagcaaagctgcttcctaatccgttttgctctttaaaataattttcaaaaattatcacatatctaggtaatacctaatttttttcttcatagttttaaatagttgtaaaggatgtaatttctgacattctgatgacatttttaaattaaaccattgcatcctttataaaaaatatatccaatagaatctaagtgtaatagaaacataatacccatttctccatctaaaaagtttctgaacaagtcagacattctttctccttt

SEQ ID NO: 17114 - DNA, 427 bp, Homo sapiens
  misc_feature 421: n=a, g, c or t
agagtgcctagaggccaggaaagggagaaggtcctaccagcctggggtagggactcgggggccaggcactgctgacgcaggctagcagggcgccactggctggtccccacccacctcggtgtttgggggatgggcgcaccagccctcctgggtgagccctagcctggggcttcctatttcgggagccgggggcgtgggccacgtctcctcatgtgatgcgagggctatttaaagcggcagcccgggcagggagccgccgtcggagcccttgcacgcctgctctcttgtagcttctctcagcctagcccagcatcactatggtggacgctttcctgggcactggaagctagtggacagcaagaatttcgatgactacatgaagtcactcggtgtgggttttgctaccaggcaggtggccagncatgac

SEQ ID NO: 17115 - DNA, 458 bp, Homo sapiens
agagtgcctagaggccaggaaagggagaaggtcctaccagcctggggtagggactcgggggccaggcactgsgctgacgcaggctagcagggcgccactggctggtccccacccacctcggtgggttgggggatgggcgcaccagcccctcctgggtgagccctagcctggggcttcctatttcgggagccgggggcgtgggccacgtctcctcatgtgatgcgagggctatttaaagcggcagcccgggcagggagccgccgtcggagcccttgcacgcctgctctcttgtagcttctctcagcctagcccagcatcactatggtggacgctttcctgggcacctggaagctagtggacagcaagaatttcgatgactacatgaagtcactcggtgtgggttttgctaccaagcaggtggccagcatgaccaagcctaccacaatcatcgaaaagaa

SEQ ID NO: 17116 - DNA, 308 bp, Homo sapiens
acttgatatctgtttactttagaggaggcagtttttgagaaaggatcataaatatcctggcccagtgccccaggagctatgacaagcaaaggaacatacttgcctggagatagcctttgcgatatttaaatgtccgtggatacagaaatctctgcaggcaagttgctccagagcatattgcaggacaagcctgtaacgaatagttaaattcacggcatctggattcctaatccttttccgaaatggcaggtgtgagtgcctgtataaaatattctatgtttaccttcaacttcttgttctggctatgt

SEQ ID NO: 17117 - DNA, 91 bp, Homo sapiens
aatcaatcaattcagaacgtcgagatggagcccaactcactccagtgggtcggctcaccgtgtggcttgcacggacctttacattttctac

SEQ ID NO: 17118 - DNA, 507 bp, Homo sapiens
cattctaagtatcatttatgtgagtttgactactccagatacctcaggcaggcaactgacccctgcttcctgagccacctgggacttgaagttctaccactgtggctccaaagctgcccaactagaaaccccaaaaggcaagagaactcctcacccgaaaccagaagagggcgtatggctagagtttcaccctaagaagaaaggggaagcaggtggaaaagcaattaaaaaaaaatcagcatctctctctagcctattatctcctgttagacacagcccagaaaatgaatagagacaagtcctggctgggtctgggttcagaaacataatagaaggattcatctaatggaagggaattctttccacagttgctagttcctcacacctctgcctctatgggattctcctggtccccacatgctctgctgtgtcttctagctgtcggccactgtggaggaagtgaacctttctagatcctgctgactcatacaatgagttttgtgtgga

SEQ ID NO: 17119 - DNA, 426 bp, Homo sapiens
  misc_feature 324: n=a, g, c or t
gcatttagttgaagctgcaggggagtgagggagaggaggataggaagcaggaaagcgggagagctcgagggacaagggggctcggtgtgtttacaccaggcacgggctacgagcgtccatcccggcccctggcttgcgctcccgaagaggagagcaaggctgttctgggatccggccgtcgtgcggcaagaggcttgtctgtccgggttgccggaaccaggagaacccagagggaaaccgaggsaaaggagcggcgcgttttactagagagagcgcgagaaagaggcgagacaggagcgcgcgagggagcatcgagcgcggaangacatgagracctactggctgcacagcgtctgggtgctgggctttttcctgtccctcttctcattgcaaggactgcctgtttcgcagcgtggatttttaacc

SEQ ID NO: 17120 - DNA, 421 bp, Homo sapiens
aaactttacaacgtttacacagttttttaaaaagagactgtatacacttgatttgctttcaaaataaatarggtcagctagtctaggaggttaacgtcgggtaggaatgctgatcatgataggtttggttttctacagattctgttccggtgcctttcctatccaggcaccacctgagaaagttgtcatttgaggtcgcacttggaagttacatctgtgaagtttctgtcattcgtccagatctgtgtgtgtagcatgtgctgaggaagcacgtgctgggctgtgcctcagacagtgcatcaccgggcacccagaggcttgcctggctattcctgttctggtgtgtgtggagtgttggggaggaacagatgcagatcaacctgtggctgttttcccgtctaggttctcacaggtatctcct

SEQ ID NO: 17121 - DNA, 471 bp, Homo sapiens
attggccactgtgtsttaaactagtgtgcgtgcagaaaggatgtgaagagttaagaggcttttaggcacaaaaggatagatttagagcaggacaggcggtcttgaggaagggcctagacctatgatgtgggtgttgctgcttcagaaggctctgagtcctgagtgtggagctgctgtcagtggcgtgtgtgagtgagcgggaagttttgtcatccttttgaagtgtcctctgtcacttgtgtcctgaatcatcaggtgtgttgctgggcattgccatccgaaccgggagtcccctgagcctcaaccttgccgagcctgtctggaagcagctggctgggatgagcctcaccatcgcggacctcagtgaggtaactccctggggcggcaggcggggcctctagggtcttgttaacaggcacagtctgttctgcgggtccggtcaggctgtgaactctggcctaatctcagtgc

SEQ ID NO: 17122 - DNA, 452 bp, Homo sapiens
cttgtgatgaacttaagtgcgctataatcttgaacgtgaccatccactttgcctgcggattaattgttgtgctttgtattgagacactgctagtttaattttagcatggtgactactgaggccatgttttcttaagcattcaggtgatgaaaatgaggaaatggtgttgcaatatcaawksccgcgtgacccaaatggccatgttattttaacgacaggaggagtgacacagacaactggatgagggaggctgtaactgaaatatcacgtgggtgaacaaagggagaaatgtcgatggcagctgtgttgaccctttacaacatgcagcggattctgccagatcccaccaacaatcatgctttctacagtaaccaagtgctgcatccaatcatggcaatgaaaaacagttctcctaacttgtaaatactttgatttgaaaaaatggagtttca

SEQ ID NO: 17123 - DNA, 312 bp, Homo sapiens
aatgtatatgcatacatatacatatattattgagacataatttacataatttatgttctataaaattagcatattttaaatatacagttctctggattttgaaaaatgtatacgtgtacataatcatggatccaccaccccagttaagatatagaacattccagggccaggttcagtggatcatgcttgtgatcgcagcatgttgggaggctgaggagggtggaccacttggggccgggagtttgagatcagtctgggcaacagggtgaaacccgcctccactaaaaatacaaaaaaaaggaaaaaaaaaaa

SEQ ID NO: 17124 - DNA, 426 bp, Homo sapiens
aaaaatgctaaaggtagaagcaactggtagtcccgaggaagggtgggcgggtggagagccccggactggagctcctgcgaactccccttcctgccctcaggagatgccactgcaggacccaaggagcagggaggaggcggccaggacccagcagctattgctggccactctgcaggaggcagcgaccacgcaggagaacgtggcctggaggaagaactggatggttggcggcgaaggcggcgcacgggaggtcaccgtgagaccggacttgcctccgtgggcgccggaccttggcttgggcgcaggaatccgaggcagcctttctccttcgtgggcccagcggagagtccggaccgagataccatgccaggactctccggggtcctgtggagctgccgtcgggtgagcacgtttcccccaaaccct

SEQ ID NO: 17125 - DNA, 562 bp, Homo sapiens
aggatagcctgaagaaacgtctacaggcaaaagtcaaagttattgggccctttttgagattgaagaagagtgccatctcaagacaaatctagcttattctaagaaatatagactctaggcatcaagactactactggctactaggaggcccaggagtgtacacttcagtcattatgttgggaaattggggtcccagagcatcaactggtgcatagcagcctggctggaagcattctgagtgctctgtctgccctggtgggtttcattctcctgtctgtcaacccggctgcattaaatcctgcctcattgcagtgtaagttggacgaaaaggatataccaaccagacttcttctttcttacgattatcattcaccttacaccatggactgccatagagccaaagccagtctggctggaactctgtctctgatgctggtttctactgtgttggagttctgcctagctgtgctcactgctgtgctgcagtggaaacagactgtctgacttccctggtactcatgtcctcaagacgactcatgatgctggatatgagaatattact

SEQ ID NO: 17126 - DNA, 442 bp, Homo sapiens
actttcagaagatgaaggtaagtagaaaccgttgatgggactgagaaaccagagttaaaacctctttggagcttctgaggactcagctggaaccaacgggcacagttggcaacaccatcatgacatcacaacctgttcccaatgagaccatcatagtgctcccatcaaatgtcatcaactactcccaagcagagaaacccgaacccaccaaccaggggcaggatagcctgaagaaacatctacacgcagaaatcaaagttattgggactatccagatcttgtgtggcatgatggtattgagcttggggatcattttggcatctgcttccttctctccaaattttacccaagtgacttctacactgttgaactctgcttacccattcataggaccctttttttttatcatctctggctctctatcaatcgccacagagaaaag

SEQ ID NO: 17127 - DNA, 505 bp, Homo sapiens
tataaagccaaaagacaatggaaaatcagaaaaatatgttacaaaaatatttgtgatacataaagaagctaaactactaatacataaagtattcctggaaatcaataagaaaaagattatcaacatagaaataggcaaaggataagaacagaccagtctcccaaacaggaattcaattgactcttaactatgtaaaaaacgcttgatcctacacacaataataataatacaaatgaaaactacattcagacatcctgtttcatttattagattggcaaaatccaaaagataataacacattttattggaaaagccatggggaaaataggcagtctcacagacaattggtgaaaatatacattggaatcctatggaaggcattttggcaatattcatcaaacttacaaatgcatacaacttttgacctagcaattccaaatctagagatctaccttgtggatatgcttgtacacaaacataaagtgtactaggctgttctatgcac

SEQ ID NO: 17128 - DNA, 379 bp, Homo sapiens
aaacatgaggatttaagtttggccgagatactgagcttcagcataatgggatatgtgactaaaaacagttggaaaaccacggacccacagcatgatttcagatgcatcaaaaatatgaaacacaaacaaataatcaagatgcccaacgcactgcagattcgtgtgtatttctgaagaggaaactgaccctaaggagttctggctgggtccacgttaggaagaacacaggcaaggatctgcggagggaggacagacctgcagccatagacactgggggraacacaacaaaatcaactgagtatgaagagggagagtgttttaaatcagagcaatgaaagaaagtgaaggagaaagagggggaaacccgggccaaggcagc

SEQ ID NO: 17129 - DNA, 415 bp, Homo sapiens
tgatcccctcagtaacgttggggcaatgccttgatgtttacttggttctcagatatggattggccatcaggttggcacaatctgtggctataaactggcaataagaaatcctctcccagccgggtacggtggctcacgcctgtaatcccagcactttgggaggccaaggtgggcagatcacctgaggttgggagttcgagaccagcctgaccaacatggtgaaacccgtctctactaaaaatgcaaaattagccgggcgtggtggcacatgcctgtaatcccagctactcgggaggctgaggcaggagaatcacttgaacccatgaggcagaggttgcagtgagccgagattgtgccattgcacttcagcctgggcaacaagagcgaaactctgtctcaaaaaaagaaacaaaaa

SEQ ID NO: 17130 - DNA, 547 bp, Homo sapiens
accggccaggatgcagacataatgatggcaggagctggagcagccacctgaggacccagagctcaaagccacatgttgagaagggcagagataactgtatccactctggactgctgacctttgaactattatgttatttccagggaaatgcaaaccaaaggatgtggtctctgatctaatccttagagaatgtgaccatgaagacacttttcctacctggtaaacaaaagataatgagaaaagtgaggttggaagttggtttactgagccaggagctataacagccagcgccctgacaaagccagcctctggataagaaactaattacttctcctgcttcttcagttwgacctcctaagggaagtcaaaaggggcaggaattggagagacgtctacaaagcttccaacaccatggccctgggggtgacctcctcggtaccctgcctgcccctccccaacatcctactcatggccagtgtcaaatggcaccaggggcagaaccagacatggaacagaccatccatagcccccaacatcttcttgaaga

SEQ ID NO: 17131 - DNA, 470 bp, Homo sapiens
  misc_feature 29: n=a, g, c or t
tttagctccagtcatagcaattctgtagnttcctcacatttactgtgtctttgtccacaaatgaaatatgttgtaaggtcagtgttaatttcgtgagacgatatagatgaacacacttgctcattttttgaaataaatatgcagatttaaaatgagtggcacatatatataaataggttattgaatgggtattctcttttccctttaatttaaaaagtgatatttatttattaaaaggagcattggtagaattattggtttatagtatcttctttaataatccttacaattacatatactaataggatgttaaaattatcatcgtgtttcctatttgtgtttagattcttataaagcatgagatgagtaatcaagggaagggtcgcatctccatgwttkccccatgaatagaatccatttgacaagccatttcatttcctttctggagaaagggagttgttttttttttc

SEQ ID NO: 17132 - DNA, 520 bp, Homo sapiens
atgtgtgcttctactagtgtgtgctcttttcactgtagacactatcacgagacccagattaatttctgtggttgttacagaataagtctaatcaaggagaagtttctgtttgacgtttgagtgccggctttctgaktagagttaggaaaaccacgtaacgtagcatatgatgtataatagagtatacccgttacttaaaaagaagtctgaaatgttcgttttgtggaaaagaaactagttaaatttactattcctaacccgaatgaaattagcctttgccttattctgtgcatgggtaagtaacttatttctgcactgttttgttgaactttgtggaaacattctttcgagtttgtttttgtcattttcgtaacagtcgtcgaactaggcctcaaaaacatacgtaacgaaaaggcctagcgaggcaaattctgattgatttgaatctatatttttctttaaaaagtcaagggttctatattgtgagtaaattaaatttacatttgagttgtttgttgct

SEQ ID NO: 17133 - DNA, 371 bp, Homo sapiens
attatgcctccaagaagaggttcaactaggtgggctgcttagaatctagttttgtattatttggacttttgttcacattatcctttcaaaatacattttaaaaatactatatgcaccgaggtgggtggatcatctgaactcaggagttcgagaccagcctgggcaacatggcgaaaccttgtctctaccaaaaatacaaagaattagctggctgtggtggtgtgcgcctgtagtcccagctactcaggaggctaagataggaggatcacttgagcctgggaggtgcaggttgcagtgagctggaattgtgcaactgcactccagcctgggtgacagagtgagaccctgtckkcaaaaaaaaaaaaaaaaag

SEQ ID NO: 17134 - DNA, 510 bp, Homo sapiens
aaaaccggctggagttccgttttgcgatgtggtttcgttcttctttcgctctttgtaataaatcttgctactgctcactgtttgggtctacactgcctttatgagctgtgacactccccaggaaggcctgcagcttcactcctgaaaccagcgggaccacgaacccatcagaaggaagaaactccaaacacatcccagtatcagaaggaacaaactccagacacgccgcttttgagaactgtaacactcaccgcgagggtctgcagcttcattgttgaagtccgtgagactaagaatcctccaattccgggcacaggattatgctgcagtaacaaacaacccaagtcccakgagcttaaaacaagagtttatttttcaccaaaattatctatttaataatgcaggttggcaagatggagactaggggagggttcagctagttgtattttttcagggatccagggtgatggaagtttcttctcaacttttgtcttcaagatcatctgtggt

SEQ ID NO: 17135 - DNA, 476 bp, Homo sapiens
aggcgctggggctgtcctgggtcgtcatgcgagaaatcgtctcaccccagccagtgtgacggagtgagagcaaaagaaagttttgatagcagcgtacgatttatattcagctgtatgctgggcaggtccaacttsgcatttcttggctgtatctctgaaggaaagtcatcttaatctctatgagcctccatttcctcagctgtaaaatgggaagatcttcctcacactgctgtgacatttagtgagtgcctgctgtgtgtcatccattgtgacagtgttgggaacacggagatgaataaaacaaggcccctgtcctgggagagccgagagscacctgtcagctgacatcttagggaggacaccatctacatccaaccctgactactgaacacttccagtttcttggaagaaagattttaaaatcttcagaaatgagaactcctccaaataggattttcatttgtttcatatatttt

SEQ ID NO: 17136 - DNA, 474 bp, Homo sapiens
  misc_feature 121,123,334: n=a, g, c or t
gttcttaaaggcggcgtgtccggagtttgttccttctgatgttcagatgtgttcagtttcttccttctggtgggttcgtggtctcgctggctcaggagtkaagccgcagaccttcaggganangatctgagatggtatagaagtgtttgtrtcccagcagcaggtggaagccaggggatgtctaccaaagttgtaaatgcatgtattctgtggtgtagctgagagatagctgcctcacagagtatgccatggaaaattctaaggatgatgaggccagaccrctctgcrtggatccacagcagtaaatccrcttctgagaagaatgaaagccaangcagatatgaaagagccatggactgctgacctttgaaccctgagaggagtgcagagctcrctcrtattctaatgaagtatttttctrcccttrttrtgattctgactcactatrcttcttatcaaarttacatgatgagg

SEQ ID NO: 17137 - DNA, 447 bp, Homo sapiens
gtttctagagctcggaggctgctggtagggggaagttgtacccgtcagcacctgctgagggctttgttgtccaaaccctgacagggcaccactttcagataaaaacatagacctgaatggcatcatccagtatccaaggaaaccatgcttgcttgaagagtgagcaggtgagcaaagagacaagattacatgtttaaaccaagaaaagaatcttgaaaattttttacagacaatgggaagcactgacacctttaagagggatgtgtaatacactcgctaatgtttcctgttgtgtttctgaaaacctgtgtcagaaaatatactgtctcgaactggaaagatgtgagattcttaattttaaagagctccattaatattgaacagattggaagaatgcgaaatgttattagacacaggcacagcatagcagtagaaacatcttaactg

SEQ ID NO: 17138 - DNA, 346 bp, Homo sapiens
agtgtgcagccttcttcaaaatggctgccagcatggaggagatccctgaaaattatgaggaagatgattttgacaatgtgctcaaccacctcaatgatgggaaacacgaactcatggatgccagtgaactggtggcagagattaacaaactgcttcaagatgtccgccagagctaggagattttagcgaasatttttgtttccatgtatatggaaatagggaacaacaacaacaacaaaaaaccctgaaagaactggcattgccaaatagttgcatttatcataaatgtgtctgtgtatattgaatattaaatactgtattttcgtatgtacacaaaaaaaaaaaa

SEQ ID NO: 17139 - DNA, 503 bp, Homo sapiens
aaaattgggatatgttatctgacagaccagaatatttgaagtttgggctgtcctgaaagtctggactttggtggtaccctcctcccccagcccatctgttgcacattatactccgtgtgttcttcaactttcggcgcccttattcccctgccttcctggcttgattgaaggaaagcttgaaaaggcgcagagccctatacctcatttcctccatgataaaaggatccaagtgaggccctgtcacagcctgtgggtaggggatgcggcgggatcctcattgccatggtactcaaaggtagaagagcctggagtttgttgcttctctttgctattctttcatatcctcttgggcctggtgattaattagcaattctcattcctctcagccaaagcctgcactgggctttatttgtctttttttattttttaagcactgcctgccagagatgggcctggggctgatgaggaccttagcgctgctcgttctcctttttctgttcatg

SEQ ID NO: 17140 - DNA, 374 bp, Homo sapiens
  misc_feature 279: n=a, g, c or t
attcttttcccccttctcaccggccaggatgcagacataatgatggcaggagctggagcagccacctgaggacccagagctcaaagccacatgttgagaagggcakagataactgtatccactctggactgctgacctttgractattatgttatttccagggaaatgcaaaccaraggatgtggtctctgatctaatccttagagaatgtgaccatgaagacacttttcctacctggtaaacaaaagataatgagaaaagtgaggttggaagttggtntactgagccaggagctataacaggtgctggagcaggggtcgtgatctgaatgaccagagggaaggactgatggaattggatggtgakagctccag

SEQ ID NO: 17141 - DNA, 250 bp, Homo sapiens
actttgctgctagtttcggttcgcggcaggccgggtgtagtctcggcggcagggcggagacactagcactatgtcggaggagcagttcggyggggacggggcggcggcacggcaacggcggcggaagaagaaccagtgaagaagataatggaaaagaaataccacaatgttggtcttagtaaatgtgaaataaaagtagccatgtcgaaggaacaatatcagcaacagcaacagtggggatctagaggag

SEQ ID NO: 17142 - DNA, 258 bp, Homo sapiens
  misc_feature 247,256: n=a, g, c or t
actttgctgctagtttcggttcgcggcassccgggtgtagtctcggcggcasggcggagacactagcactatgtcggaggagcagttcggcggggacggggcggcggcacggcaacggcggcggaagaagaaccagtgaagaagataatggaaaagaaataccacaatgttggtcttagtaaatgtgaaataaaagtagccatgtcgaaggaacaatatcagcaacagcaacagtggggatctagangaggatttnca

SEQ ID NO: 17143 - DNA, 169 bp, Homo sapiens
tataaagagaagtaagataatggcaaaattatggcatatataaatgttaaatcagggatgtccaatcttctggctttcctgggccacattggaagaaaaattgtcttgggccacacataaaatacactaacactaacgatagctgatgagcaaaaaaaaaaaaaaaaaa

SEQ ID NO: 17144 - DNA, 133 bp, Homo sapiens
  misc_feature 128: n=a, g, c or t
tataaagagaagtaagataatggcaaaattatggcatatataaatgttaaatcagggatgtccaatcttctggctttccggggccacattggaagaaaaattgtcttgggccacacataaaatacacntaaca

SEQ ID NO: 17145 - DNA, 144 bp, Homo sapiens
tataaagagaagtaagataatggcaaaattatggcatatataaatgttaaatcagggatgtccaatcttctggctttcctgggccacattggaagaaaaattgtcttgggccacacataaaatacactaacactaacgatagct

SEQ ID NO: 17146 - DNA, 149 bp, Homo sapiens
tataaagagaagtaagataatggcaaaattatggcatatataaatgttaaatcagggatgtccaatcttctggctttcctgggccacattggaagaaaaattgtcttgggccacacataaaatacactaacactaacgatagctgatga

SEQ ID NO: 17147 - DNA, 147 bp, Homo sapiens
tataaagagaagtaagataatggcaaaattatggcatatataaatgttaaatcagggatgtccaatcttctggctttcctgggccacattggaagaaaaattgtcttgggccacacataaaatacactaacactaacgatagctgat

SEQ ID NO: 17148 - DNA, 144 bp, Homo sapiens
  misc_feature 138: n=a, g, c or t
tataaagagaagtaagataatggcaaaattatggcatatataaatgttaaatcagggatgtccaatcttctggctttcctgggccacattggaagaaaaattgtcttgggccacacataaaatacactaacactaacngatagc

SEQ ID NO: 17149 - DNA, 146 bp, Homo sapiens
tataaagagaagtaagataatggcaaaattatggcatatataaatgttaaatcagggatgtccaatcttctggctttcctgggccacattggaagaaaaattgtcttgggccacacataaaatacactaacactaacgatagctga

SEQ ID NO: 17150 - DNA, 505 bp, Homo sapiens
ttaagtcttatagtaaccataatgaaaacacatacattttccttcttaatactttaaacttttaattatgatataatttcaggctcaatgaaaaactgcaagaacagcattctgtacatattctacatgttacacacattctagtgacgagtctagagaaaattcagtgaaaaattcctctaaacttttcactgagattccccagtgttaacattttaccttattttttttattgttttctgtttctgaactttaaaaaagtaagttacagcagaggtgggcagatcatttgagcccaggagttcaagaccagcctgggcaacaaagcaaaaccctgtctctacaaaaactaaaaaattagcgaggcatggtggcacatgcctgtagtcccagccacttgggaggctgaggtgggaggattgcttgagcccaggaggttgaggctgcagtgatccatgatggtgtcactgcactccagcctggatgacagagtgagactttgtgt

SEQ ID NO: 17151 - DNA, 149 bp, Homo sapiens
tataaagagaagtaagataatggcaaaattatggcatatataaatgttaaatcabggatgtccaatcttctggctttcctgggccacattggaagaaaaattgtcttgggccacacataaaatacactaacactaacgatagctgatga

SEQ ID NO: 17152 - DNA, 114 bp, Homo sapiens
aaaaggatccgtctgaggcggcgacgagtgagtactcctgattgtgacatcacattcatcccctgggcgatggagcttgtcactgggaaggaatactcagtcggagaatagcct

SEQ ID NO: 17153 - DNA, 269 bp, Homo sapiens
attattgtttgaagttgtggtagtgtttggtcaactatttttaatggctccatgacattttcttgactgacagcagcaatcacagtcacattccacagcctctccagcacccagccagctctccgcgggggcagcagggactggtccacccaacaacagcagccatgtcctcacctcttgctacagcagtaactttatttgatttgatgtatatgaagaaataaaactcagaagtcaattgacttaaacatgcaaaaaaaaaaaaaaaa

SEQ ID NO: 17154 - DNA, 498 bp, Homo sapiens
ctccctgcagtttgaaactgtcaggttgccgtctaggtagcggttgtgcttgctgaggctgcacttgctgacactgcagctgcgacgcggctaagaggcgcagagcgaggagtcgggatttggtcgcgagcggcgacgagcatttgtgcagaatgtcatcagatgaggagaaatactcacttccagttgtgcaaaatgactccagtcgaggcagttctgtctcttcgaatcttcaggaaataactctgaagtaagagaaactgcaatagaagttggaaaaggatgtgatttccatatttcaagtcattcaaagacagatgagtcatcaccagtgttatcgccaaggaagccttctcatccagtcatggattttttcagttcacatcttttagctgactcttcctcaccagcaacaaattctagtcatacagatgcccatgaaatacttgtgagcgattttcttgtttctgatgaaaaccttcagaagatggaaaatgt

SEQ ID NO: 17155 - DNA, 449 bp, Homo sapiens
agtgtgtttataaaacacagtaatttgtttacttatctgtctcctctactagatttgagtgcctggttccctattgtgcccttaccatctagcatagtaccaactatttttgatacttttacttcctatgagttttggctgatggtttgaggactggtgtcactgaatggctcgagcccctggaagcaaaatctgctgttgaacttgttcaggaatttctgaatgacttaaataagctggatggatttggtgattctacaaaaaaagacactgaggttgagaccttgaagcatgacactgctgcagtcgatcgttccgtcaagcgtcttttcaaagttcggagtgatcttgattttgctgagcaactgtggtcaaaatgagcagtagtgtgatttcataccaagacttggtgaagtgtttcacattgatcatccagagtctacaacgtg

SEQ ID NO: 17156 - DNA, 356 bp, Homo sapiens
gagagagggccccgtcgcgaccgcgtccccttgggtccttgatcctgagctgaccgggtagccatggccttgcggctcctgaagctggcagcgacgtccgcgtccgcccgggtcgtggcggcgggcgccagcgcgtgagaggaattcatagcagtgtgcagtgcaagctgcgctatggaatgtggcatttcctacttggggataaagcaagcaaaagactgacagaacgcagcagagtgataactgtagatggcaatatatgtactggaaaaggcaaacttgcaaaagaaatagcagagaaactaggcttcaagcactttcctgaagcggggattcattatccagasaggtaccac

SEQ ID NO: 17157 - DNA, 515 bp, Homo sapiens
actttgtctagcagatctccggctctggattacttgttctccctcagagtcagaaattaaccttttcctgaaggttttttctttagttaggaggggaaaggcagtacctttgttttagctgaaatgatttggcagcttacttatttttaggatggttggtgttgacacataaggggtagtgtagtctgtcaccttgaggccagggaccacatctcattaatagacggtacacttgcagttgacctcatgaggagctgtgcccactctgtgcttgccggtcaaaaacatatgaggtgtgtttttcatcgcttcagccaggacagtattctcgcagtcttcagccttaactaaagagggatgtctcctggggctgcccagcaaatgtagctcttcaaggaagttatttgttttgtccgcagttccagctggtagtcatgagcccagtcaggtcatccccatcaaggatgtacactctggctaatagaatagaatttcctgatgtaaaaaaaaaaaaa

SEQ ID NO: 17158 - DNA, 576 bp, Homo sapiens
attttcctaagctatgagaacaattagaggaacagattcatgcttgtatcttgcattcagaaaacaaactgtcctactaatcaaagctgcatatctcatcagagataatggttgaattttattgcaaccatattggcaatctgaaactggcaaacacaaaggattgttttcactaggcttaccattttgctttgcttttttaacacactgagccaaagatgcagtgtaattattgggcttttgccttatgttgagttcagtgtaagcatggaagctagtgattctgaatgatatatatatccattgcatgttgaactcctttagaattttgttcttaaacaaacttagaatttcaaaagaaaaacatatgatccattaagttggagtgtttatgattattgctagaaagaaggcagacttcatattctcatcgcccatttttcaaacttgtacattgatctgtacattattttaagccacatgtttgtaattgtttaaaacaaagtggaaacattacacaatgtccttaataaataggcccatgtaaattttaattacaattaataaatgatcaaa

SEQ ID NO: 17159 - DNA, 441 bp, Homo sapiens
aaagattccaacttcctgggcagagggtcatgtagtggaatagakctgtacctggcttcaggcgagacttggagctcaaaactttcagtaggacagccaggcgcggtggctgatgcctgtaatcccagcactttgggaggccgaggtgggcggatcacgaggtcaggagatcaagaccatcctggctaacacgcaactccaaaatggaagtactattgttatctccgtttacaaattaggaaactgaggcacagatatgctcttgggtacttgtcagcagcagttgttctacaagctaaatatctggatatcttaaatctcagatgagcatcttagcctctggattactgcccaatgaggaaagctatgaaatgcatggataacttgctaatcagtatttgccatatgtgctagcagcatcagcatcarttgggagattat

SEQ ID NO: 17160 - DNA, 502 bp, Homo sapiens
agtgaagattccaacttcctgggcagagggtcatgtagtggaatagagctgtacctggcttcaggcgagacttggcaactccaaaatggaagtactattgttatctccgtttacaaattaggaaactgaggctcagatatgctcttgggtacttgtcagcagcagttgttctacaaatgagcgtcttagcctctggattactgcccaatgaggaaagctatgaaatgcatggataacttgctaatcagtatttgcaatatgtgctagcagcatcagcatcagttgggagattatggtggcctccatgtcagacctcctaaatcggaatatcagagaaggtggcccaggttaccatgtttcatctgccaatgcattgaaaacttggaatgtaaattaattcaaccattgtggaagatggtgtagtgattcctcaaagacctagaagcmgaaatatcatttgatccagaaatcccattactgtgtatacacccaaaggaatata

SEQ ID NO: 17161 - DNA, 417 bp, Homo sapiens
  misc_feature 336..337: n=a, g, c or t
agcggagccsctctcgcaactcaagatggcggacgagagtgagacagcagtgaagccgccggcacctccgctgccgcagatgatggaagggaacgggaacggccatgagcactgcagcgattgcgagaatgaggaggacaacagctacaaccggggtggtttgagtccagccaatgacactggagccaaaaagaagaaaaagaaacaaaaaaagaagaaagaaaaaggcagtgagacagattcagcccaggatcagcctgtgaagatgaactctttgccagcagagaggatccaggaaatacagaaggccattgagctgttctcagtgggtcaganncctgccaaaaccatggaggaggctagcaagcgaackaccagttctgggatacgcagcccgtccccaagctgggcgaagtg

SEQ ID NO: 17162 - DNA, 416 bp, Homo sapiens
acatactaagttaggttgcagttccctacatagcaactcagagtagggaggaaattttaggccaaatttaatttaaattatgttggagcatgaccaaagttggtcatgaccagaagctgaacacagatatggaagctaacacaatatccagtggagagagattgtggtagagtacatggggcgaaatggttgatttctgcatttttgttggtgacgccatcaggatttgctgaagaaccaaacgtgtgacaggaaaggacaacacaaggagctgccagctttggaaaccagttctactctcagtattaccttcgcaaaagatagagctttgtaaatttctagattcctcgttcttattatcctagactatttaaccagaatctccagggtcgtggtcctggaaacaatacgtttaa

SEQ ID NO: 17163 - DNA, 520 bp, Homo sapiens
cttcggagttggacaaaaggatttgaatttaggttctgtggattattatgggtccttgataaattctcaaagcctttttttttgttcatctctaaaataggaatataggattacctaccacattgactcgtaaggactatatgagaccatgtatatagaatgtttaacatagtaccaggctttacaaagaactcaataaatgtttaccattattgaaatagttttgtagactgaggatctcattattttacagccttgaattatgtcctgtatactctgttaaagaaactgggaaaaaaatgccaactggttgtttctgggtggcggaattatggctgtttcttttcttttttaatttctatagtaagtttgaataactttcataacatttaggaaaaaatattaaaggaaagaaaaaagatcagggaatttaaatatatttttagtagatatttttatccaaacttaattcttagaattgattagamcacatagtttaccagaaaactcagctgttcaa

SEQ ID NO: 17164 - DNA, 501 bp, Homo sapiens
acttgttggcctacagaggtgtggcaagcagagcacctcagaactcaggcgtactgcccgccgcccgagccctgcgaggccgatagcgagggtgtggcccttatctgcacccagcagagcgccggcggggtacggtcttaggacctcgatctccttctccctcattttctctcatccctacctattgtgggtttccgcatgggccggaccgtggtcgtgctgggcggaggcatcagcggcttggccscagttaccacctgagccgggccccctgcccccctaaggtggtcctagtggagagcagtgagcgtctgggaggctggattcgctccgttcgaggccctaatggtgctatctttgagcttggacctcggggaattaggccagcgggagccctaggggcccggaccttgctcctgatcttcccttagtttctcctcttctgagggcatgtggagagcaggtttctgagcttggcttggattcagaagtgctgcctgt

SEQ ID NO: 17165 - DNA, 474 bp, Homo sapiens
cattctaagtatcatttatgtgagtttgactactccagatacctcaggcaggcaactgacccctgcttcctgagccacctgggacttgaagttctaccactgtggctccaaagctgcccaactagaaaccccaaaaggcaagagaactcctcacccgaaaccagaagagggcgtatggctagagtttcaccctaagaagaaaggggaagcaggtggaaaagcaattaaaaaaaaatcagcatctctctctagcctattatctcctgttagacacagcccagaaaatgaattgagacaagtcctggctgggtctgggttcagaaacataatagaaggattcatctaatggaagggaattctttccacagttgctagttcctcacacctctgcctctatgggattctcctggtccccacatgctctgctgtgtcttctagctgtcggccactgtggaggaagtgaaccttctagat

SEQ ID NO: 17166 - DNA, 477 bp, Homo sapiens
tatatcaagcaaagaaaagtgtggacacatccatgcacactggagaagtagcagagtggtttaattttgtgttggagaatcaaaggccagaatgaaaaggcactttttacatcccaaaggaaaattcccattcagaaagacattgatggcttttttagcggcatccattcatctgctctgcaaaggcatggggtcatgtgattttgagagtactgactctactcccaatgcatagcagtcatgtataataatttaggggacagtgattccattcacagttccagaggtaaacccccctccaattgactaaacccaatcagaaaatcctactcttgcataggattgtttcagagataggcacaaatctcatcctaagccaatcagagcacagcacttccgtcggccatggtgattgattcagagatgggcatgtgactggtttgctcagttagagtgaaacctaggattttttgtttg

SEQ ID NO: 17167 - DNA, 626 bp, Homo sapiens
tatatcaagcaaagaaaagtgtggacacatccatgcacactggagaagtagcagagtggtttaattttgtgttggagaatcaaaggccagaatgaaaaggcactttttacatcccaaaggaaaattcccattcagaaagacattgatggcttttttagcggcatccattcatctgctctgcaaaggcatggggtcatgtgattttgagagtactgactctactcccaatgcatagcagtcatgtataataatttaggggacagtgattccattcacagttccagaggtaaacccccctccaattgactaaacccaatcagaaaatcctactcttgcataggattgtttcagagataggcacaaatctcatcctaagccaatcagagcacagcacttccgtcggccatggtgattgattcagagatgggcatgtgactggtttgctcagttagagtgaaacctaggattttgtttggtaattgagataaagacacttttcttcaggaagatgtggtgtacggaactgttccagacattttgtcaccatgataaaagtgagtctgaaaagtaaccatcatgttcaggaaggcaaatcaacagaactgcagagcaatggagtcagcacc

SEQ ID NO: 17168 - DNA, 473 bp, Homo sapiens
tttgaacaactgaggttaagcaaaagcacggaatcatgaaaattattctttgaaatggcaaagatttctatggctggatcatgggatttattgactggagcgatttctcctcagaagaccagacacatgtgagctatgcgaatccacggaagtgttgttatctttctattttttcctcgcttatatgaaggactataggtcaggaactgtgcaagaggaggaatgtgcatatgttggggtggggatagataggggaggtctggaatggataaatcatttcaaactcaaaaaagcagactgagagaagacatagggagaactgacagagaaaccataaagctggaaaaagattagagaaaaccacaagaagatctgtttaaccctaatttctgtgttttttctgatgaagatgtagtattaattgtttcagagttcatcagagatccacgtatcttaaatctgagatataagcc

SEQ ID NO: 17169 - DNA, 396 bp, Homo sapiens
tttgawsaactgaggttaagcaaaagcacggratcatgaaaattattctttgaaatggcaaagatttctatggstggatcatgggawttattgactggagsgatttctcctcagaagaccagasacatgtgrgctatgcgratccacggaagtgttgttatctktctattktkkcctcgcttatatgaaggactataggtcaggaactgtgcaagaggaggaatgtgcatatgttggggtggggatagataggggaggtctggaatggataaatcatttcaaactcaaaaaagcagactgagagaagacatagggagaactgacagagraaccataaagctggaaaaagattagwgmwaaccacaagaagatctgtttaaccctaatttctgtgty

SEQ ID NO: 17170 - DNA, 506 bp, Homo sapiens
atcatcaatcagtaagtcccttccacattaagaactaaggctcaaagagaagtataagactaggtctttatatttgtaagttacttacactctagatatcaaacgaaatgtaactcacatgaagtgcttcaatgctgaatagtgaggaacgcacagcggaaacatattcttgcagcccatcagatcatccacagttacacggaaagcatggttcaaaagaaattaactgagggagagcaagatgaggcctcaaatgctgccatgttacttgagaaagaaactcaaaatgagaacaacagctaagattgtgatttttttgtaaaagaagctgtacgaatcatcataaataattccaatagtctgcacttctcccaaggtgtgcactgctcataaacttgccagtgtgtgattcatgagaaaggagatttattttccttaaacatccaataatttaaaatgattttcaataataataatcaaaygaaaaagctcaaaaaaaaaaaaaa

SEQ ID NO: 17171 - DNA, 564 bp, Homo sapiens
atcaatcagtaagtyccttycacattaagaactaaggctcaaagagaagtataagactaggtctttatatttgtaagttacttacactctagatatcaaacgaaatgtaactcacatgaagtgcttcaatgctgaatagtgaggaacgcacagcggaaacatattcttgcagcccatcagatcatccacagttacacggaaagcatggttcaaaagaaattaactgagggagagcaagatgaggcctcaaatgctgccatgttacttgagaaagaaactcaaaatgagaacaacagctaagtccttggtccaatagaatggaatcttaagtctcaatcaaaaggaatcatggaaggagggttgagatgagagggaagattgtgatttttttgtaaaagaagctgtacgaatcatcataaataattccaatagtctgcacttctcccaaggtgtgcactgctcataaacttgccagtgtgtgattcatgagaaaggagatttattttccttaaacatccaataatttaaaatgattttcaataataataatcaaatgaaaaagct

SEQ ID NO: 17172 - DNA, 431 bp, Homo sapiens
acttacactctagatatcaaacgaaatgtaactcacatgaagtgcttcaatgttgaatagtgaggaacgcacagcggaaacatattcttgcagcccatcagatcatccacagttacacggaaaagcatggttcaaaagaaattaactgagggagagcaagatgaggcctcaatgctgccatgttacttgagaaagaaactcaaaatgagaacaacagctaagtccttggtccaatagaatggaatcttaagtctcaatcaaaaggaatcatggaaggagggttgagatgagagggaagattgtgatttttttgtaaaagaagctgtacgaatcatcataaataattccaatagtctgcacttctcccaaggtgtgcactgctcataaacttgccagtgtgtgattcatgagaaaggagatttattttcctt

SEQ ID NO: 17173 - DNA, 407 bp, Homo sapiens
  misc_feature 316..317: n=a, g, c or t
atrtttgwaagttacttacactctagatatcaaacgaaatgtaactcacatgaagtgcttcaatgttgaataggttggtacaaactcaagtgcgactttcagaatgaaaatttttctattactttggcacagtgaggaacgcacagcggaaacatattcttgcagcccatcagatcatccacagttacacggaaagcatggttcaaaagaaattaactgagggagagcaagatgaggcctcaaatgctgccatgttacttgagaaagaaactcaaaatgagaacaacagctaagattgtgatttttttgtaaaagnnctgtacgaatcatcataaataattccaatagtctgcacttctcccaaggtgtgcactgctcataaacttgccagtgtgtgattcatgaga

SEQ ID NO: 17174 - DNA, 347 bp, Homo sapiens
  misc_feature 314: n=a, g, c or t
aattaatttgaagttaaaattattgttttaagtactgtcaagtatatcttcaggcaagaatactcaaggtagtatttatattttataagttttgttttttttttttcctcagacctcatgatttctagtgacaaggtactttgtgaatttgtattaacttgaaatttcactgcaactgaattagctaaatacctttcaaaagaaatgactaagcagccagaacagggatagaattacaaagtttycaagaaagtgcattttraacaactaggttcaaaactattttycttacactaaaaktagggaacattatnatwattttaaacatttgaaaatgaggttaataa

SEQ ID NO: 17175 - DNA, 477 bp, Homo sapiens
aaccaccgacagcgcccgctttgtgcagcgcccgttgctcttcgcgtcccggcgccagtcctctgcaaggagaactgagaagattttcttaagcacttttcagagcgaggccgagccccagtctaagtcccagtcattgagtctcgagtcactagagcccaactcaggcgcgaaaccagccaattctgctgcagagaatggttttcaggagcatgaagtttgaatgtcaagcgagggagccttgagtgggaactggccctccagccctaagaaaacgtcactctcactctgcagtctcaaactatgcccccatcagggatggaatggacactggaggctttacaaaaggcagatgcccacctcagtgacttctaaggactgactctgccagcctggccttgactccggttacacagacatgggggtgaactttcactccasctccttccttcaagtacatactgaaaattcagtcag

SEQ ID NO: 17176 - DNA, 853 bp, Homo sapiens
cagaaatgttcactatagcatcacatagggtaatcaaaaaattaaaaataacctacatgctctcaaagtaggaggaatggttaaattaatagttgattttgctttgtctctcttggtttcaaggagtagaaattctaactagattaagtaaaattgggctttgttgaaaagggtaaaaggtgctctaataaccccaaacagcaagatcactgaggccttttggcagtggggagccagagctactttcccatttcacccgttcagggaccaggctagtcactgcttcttcctctgtagacctgctttgttctcagcttcttcttcagccagtcttccttgtacatggctcagtgttgtttgccaccttggacttactcagtttttgttaaaattcacatatttccagaacaggaatctgaaagagctgttctttttgagccttaggtgggtcagtgaacaacctgtggtttggtctttttcttcatccccttccagggggtctgtatttaggtttagatagctagtgaaaatgaaatggcactgggtaatgacattgattcaatacatcttggctaggcacactggctcacgcctataatcccagcactttgggagactgaggcaggtggatcacctgaggtcaggggtttgagactagcctggccaacatggtgaaaccccatctctactaataatacaaaaaaactagctgggcatggtagtgcacacctgtaatctcagctactctggaggctgaggcaggagaatcgcttgaacccggaaggtggaggttgcagtgagccgagattgcgccattgcactccagcctgggcagcaacagtgaaactctgtc

SEQ ID NO: 17177 - DNA, 498 bp, Homo sapiens
tttttatcactgaagtctctgttcgtcttttttgggagtcctcctgaccatccgacctaaagtgatgtaggacttttaggggcagaagccattccaggcagagggattatgctggtcctcatacatggaacaagtgaatcaatttagtgaatccaaatgactttgtccaggtcacagaggaagtgggtgtcattgccagaactgaactctatgcctccctgtccagcaaaattccactacatagaacatgatgtaccatgatcacgacagttccaggcagggagtgaagggagagagcccaggcttcggagctaagcacataaagtttgaatccagctcttctgcatattctatgaatcactgaatatatttacatacattcactgtattcagtttcatctctaaaattagcataatatcccatttttagagttgtgagaaagataataaataatgcatattttaaaactggtaataaaaagttcttgaaaaaaaaaa

SEQ ID NO: 17178 - DNA, 142 bp, Homo sapiens
tgttaccaatgtgtatcgtctccttctccctaaagtgtacttaatctttgctttctttgcacaatgtctttggttgcaagtcataagcctgaggcaaataaaattccagtaatttcgaaaaaaaaaaaaaawtgcgaaaagc

SEQ ID NO: 17179 - DNA, 571 bp, Homo sapiens
ttaaggacgattgtaaaaaaaagaaaggaaatatgtgaaccgtcactgcagttatgctagcaggcatgaaaaccttgtactttttgcaaaatacatttttatcttgtactgaaaatgcagcctttatgtgggtgcagggttattataagaaaggcatacttttgactcacatatgatttgagaaaaaaatgaagacattgtatgacaacctaaaccaaaaggaaggtgaaagatctgaagctgaagaatttaataccagcaaaggatggttcgataattttagaaagatttaaaagtcaagataacaggagaagcagcttcagttgaccaggtggcaacagtgtagactccattaagaaaatcattgagaagaaacaatatctgcctgaacaagtttttaatgcagataaaagtgacctagtctgggaacgaagaaatgccgcaaaggaaatttactggtaaggaagagaagtgagctccagcaattaagggagggaggaataggctaactccagtttttcacgcaaatgcagtcagggttatgactggaactgccttatctataaagcag

SEQ ID NO: 17180 - DNA, 165 bp, Homo sapiens
agctgtgtatgtctcataaatactgaaaacatatcctaacatttggaagcagccaagggaagctatggtgattttaattcaaatttaaatacataattagtgagtgagcgctcagcaatgatgggaatgtactagaatgatagcaccagtggtgcggagtcagag

SEQ ID NO: 17181 - DNA, 433 bp, Homo sapiens
ttgagctcttgagccagtgacttccctgcacgttcagctttctcctttgtgaaatggtaatagaagcacgctgcacttgggattcttgtggattacatgtgagggtcttagaaacacttgatgtgtaagccaactattatgtattactgtatatggaacacaagggatgtagccaaaactaaatgcaagtttgtgcctcagatgtcttcctatcagaacagagtcaaatccagattttgatgcttaaatgtgacagcttattcagatttagaaaaacttttggtatgggccaaagaaaacatatccttaaggggatatggcccctaggcctcattttccttttctgtctgagcattaaaaaaagcattaagtaaattccacaaattctttggaatacctagagataaacagatatcatgttaaactgtatgat

SEQ ID NO: 17182 - DNA, 159 bp, Homo sapiens
gattagtctgtattttccggttcaagtgtatcttgtttttcgtttgctccacttcccttgtcccttgcaccccactaacaggaaaattcctggtggtcaaaatgaaaaaaaaaaaaaaaaaaaaaaaaaaaaaaaaaaaaaaaaaaaaaaaaaaaaaaa

SEQ ID NO: 17183 - DNA, 109 bp, Homo sapiens
gattagtctgtattttccggttcaagtgtatcttgtttttcgtttgctccacttcccttgtcccttgcaccccactaacaggaaaattcctggtggtcaaaatgaaaaa

SEQ ID NO: 17184 - DNA, 137 bp, Homo sapiens
gattagtctgtattttccggttcaagtgtatcttgtttttcgtttgctccacttcccttgtcccttgcaccccactaacaggaaaattcctggtggtcaaaatgaaaaaaaaaaaaaaaaaaaaaaaaaaaaaaaar

SEQ ID NO: 17185 - DNA, 110 bp, Homo sapiens
  misc_feature 110: n=a, g, c or t
gattagtctgtattttccggttcaagtgtatcttgtttttcgtttgctccacttcccttgtcccttgcaccccactaacaggaaaattcctggtggtcaaaatgaaaaan

SEQ ID NO: 17186 - DNA, 354 bp, Homo sapiens
gtagccaaggaagaagagaagagaggaaggacacgcccattaaccaaaggacccaaaacatatctcaaggagctcatgaagtcatcctcatgcacacagtttcccaggtgtcagatctgtttgggccacaaacctaagaagaacatcatgtgaggatgaaggcagagagcagggtgatgcagctgaagccaaggacactgaagacttcctgcaaacccccagaagctggggcagaggccctccagtctccagaagaggccaaccatgctgataccttgaccttggactcctagccccagaactatgagaaataactttctgttatttaaaaaaaaaaaaagaaaaaaaaaaaaa

SEQ ID NO: 17187 - DNA, 339 bp, Homo sapiens
gtagccaaggaagaagagaagagaggaaggacacgcccattaaccaaaggacccaaaacatatctcaaggagctcatgaagtcatcctcatgcacacagtttcccaggtgtcagatctgtttgggccacaaacctaagaagaacatcatgtgaggatgaaggcagagagcagggtgatgcagctgaagccaaggacactgaagacttcctgcaaacccccagaagctggggcagaggccctccagtctccagaagaggccaaccatgctgataccttgaccttggactcctagccccagaactatgagaaataactttctgttatttaaaaaaaaaaaa

SEQ ID NO: 17188 - DNA, 323 bp, Homo sapiens
gtagccaaggaagaagagaagagaggaaggacacgcccattaaccaraggacccaaaacatatctcaaggagctcatgaagtcatcctcatgcacacagtttcccaggtgtcagatctgtttgggccacaaacctaagaagaacatcatgtgaggatgaaggcagagagcagggtgatgcagctgaagccaagaacactgaagacttcctgcaaacccccagaagctggggcagaggccctccagtctccagaagaggccaaccatgctgataccttgaccttggactcctagccccagaactatgagaaataactttctgtt

SEQ ID NO: 17189 - DNA, 491 bp, Homo sapiens
aaactgccctgcgcctccgctggcccgcgtgaamcctctctgctgcctcgactgactgtcgtttccgtgtcttgattgtggcctctgcctctcccccttccgatttcgttcgacttctttctacagttactaagcgcccactgtgtgccctggaagggactagactcagcaggaaaaacatccaggcaagtggacagcatttgcaacagcccagcaataagaaggaccatattctacttgggaaaaggtaaagtcgtttcatatggacggagcctgccaggaaacctgtcattcaaccctttgcaataaaacagctcctcatgaatgaagcaaaataaatcagaagttgtgggcttttaaactcactaaatgaaagcacagcatgcatgcagcctccctccaaattaatcaccagattaaatgcaagatgtgcacaccaaatcaatagcttgtgacggggactcctgsctgtgcttcaggaaattccattt

SEQ ID NO: 17190 - DNA, 375 bp, Homo sapiens
aagttaatagaaagttggccaatttcaccccattttctgtggtttgggctccacattgcaatgttcaatgccacgtgctgctgacaccgaccggagtactagccagcacaaaaggcagggtagcctgaattgctttctgctctttacatttcttttaaaataagcatttagtgctcagtccctactgagtactctttctctcccctcctctgaatttaattctttcaacttgcaatttgcaaggattacacatttcactgtgatgtatattgtgttgcaaaaaaaaaaaagkgyctttgttwaaaattacttggtttgkgaayccatctkgcttttyccccattggaactagtcattaacccatctctgaactgg

SEQ ID NO: 17191 - DNA, 450 bp, Homo sapiens
accacacctggaactgttgaacagctctttcttgctctgtgtctcattcaaatttgacagcctttaatgtcacctgtaaaacatattcccaaaggtagaatatgttttctccaagtctgaggaggcctaccagatgagctttcttatctgctgggcaagaatttctccttttctttggaggggatgtctagtcatgcttctgactaccaaaccactaaagatctcactgatattaggactctgcagaaggttttgtttgtggaaaggcttttactgctgaaagtaacagtaggacattctatggaatacctgaccagtactccttgaaacttcagtcatgaaaaacaaggagagactkagaaactctcaagaaccagaggagaccaaggagacacaaacaccaaatgcaatgtgatatcctgggtggaatgcaacggaaaagggacctta

SEQ ID NO: 17192 - DNA, 527 bp, Homo sapiens
tcatagaaattagggtagatttttatttcaactactactggagaatttaataaaaggcattatttgaaaagtttttctaacatagatttagggtttttrttttttagagtggacacactacatttaaaagcaattattttgcwattcagattttttattatctgaaaatgaaattatctgttttacttttcaaagctttgtgaaacaaacttgaagttatagggaggtaagccatctccaactctgcaggtcaaacgaaagtttgggaaatacttttgacatcccacaatacagaatggtcttaacatgagaattggaatttcatgatgtkkggttccatttaawagcgggacaccaccccaatcycatggttttcctggttaccctaaaacagttggaaggaaactggggtgtttggtagacttctaaatcatgggtctctggamaatttggaatctggagattctcacctccatttactaaagaatcggggacttaattcaaattkgcacagtaatcagtaaagg

SEQ ID NO: 17193 - DNA, 443 bp, Homo sapiens
gttgatgtgaatgttctttatgttctacataataccagtcacatgtaggtraatgataactkrraatgtggcaaatgtaacaggagcttctgcttccacccaagatgaataaattgggacaaagggattgtcctcatgctataaacaactagaaaaatgaaaaaaaaatgtatgaaacaacagttccagatgttggagaaaggacagaggaggatatgctgccagagaaaagtctccacagtaaacctgctggaatgaatactattatttactcctcattttgcagagaagaaactggaattttagcgagtcctttctgcccttccccactggaaagacctaatcatttaaccacaaaactgargcagaggaactttcgcaattgaactggcaagaattattttaaatacatggcattaaacttcaaaaaaaaaaaaaaaaaa

SEQ ID NO: 17194 - DNA, 519 bp, Homo sapiens
attttattttatctaacataattatttgtaattgacaccctcgttcatttatttaaagcctaaacatttaccaatctcctgtgtgtactgactgcctttttttatcattgaatattttctggtaaatattttattgtggaatcaactttagagatttttgtaagaggctttaaagcagttatgatcgttagtactgttttcttgacggcaaaggatgggcgcttactagaggaccacttttcctaaatgcacacttcagattgatcataatttataattctgagttcctttgcctaattactggaatgaaaagaacattgaaatcacttgctctaatctcttcttaaggcagaaatcagaaagaatacgaggttttgttatcaggatgattgctagcctcatagaatgagtttgwtgagaagtccttcttcctcagttttttggaacagtttcagcaggattggtaccagctcttctttatacatctggtagaatttggctgcaaatcatctggtctgg

SEQ ID NO: 17195 - DNA, 319 bp, Homo sapiens
cagtgtcctgggtgtaaacctctgcgagatgcccctgggtgtcaggtcctggctgcaccccatcgttaggactgggggcagcagcagatgagggaagacttgtctcctctggcccatggagtgtccctgtttttcagctcagccagcatcccatactcaattctgccggcgagagctgtgggcctgttttgcaggttgtgtcgtttcagcgggtaactggtatgtgtgtgcatgcgtgcaaaagaaaacatcaaaatgtttggggagttggttgctattgtaaaataaaatatactgttttcaaaaaaaaaaaaaaaaa

SEQ ID NO: 17196 - DNA, 348 bp, Homo sapiens
aaaagaaccagggctgagctgtggagggaaggggagccatttctctccaccgactgcaacctccgtgctcacagctcacggttcaccagaatccaggggcttggtcggcctaggaatccacaatgctggatattttcatcctgatgttctttgccatcataggcctggtcattctgtcctacattatctatctgctctagtggcctggagctgcggccggagcctgctggagaacagctcagaaggaaggatggagctgaatggccgagtgccctgcttgctgacgcaccggtggatttttgcttctgctgttatctcgggtattgattccaaaaaaaaaaaaaaaaa

SEQ ID NO: 17197 - DNA, 565 bp, Homo sapiens
gttccgagcatgtgctggcagttgctctttggagcacccacttcacttctcccatgtagttcctgagtgcaggactctcctgaagaaggggcttctaaaaggccagcccatgcatcttgttcagaccaggctgctccatctccgctaagcccagggatccacttaacctcgtcgcgacatttctcagaagccatgacatgtccctgcggctggaggctttcaagggtggcccaggaggcctcaagggcccggtgtggcctgcaaaggaagagaacagctgttctcacggaaggatccaaagggttcaaaggcgaagggtgccatctgcttccccactgattcagaagataaacaggagaagtgtcctgtttcacccatattgctggtcctgatttttcaatagtgtccctaccctgaagctcttccattggtcatcatggagttagctaacagcccagggaactggtctcttttcccttttcccttaccacctggaactcacctggaaagggcaatcagctggctctatatcagacgccaccacctggtctttraagtttctctc

SEQ ID NO: 17198 - DNA, 54 bp, Homo sapiens
aagaaagttctgggaaaccgactcccgggagcagggaggaacgcgcgctccaga

SEQ ID NO: 17199 - DNA, 430 bp, Homo sapiens
agcgcccgckkcgcggcgtccccggcccaaccatggcgtcctccgcggccggctgcgtggtgatcgttggcagtggagtcattgggcgamgtggggccatgctgtttgccagtggaggcttccaggtgaaactctatgacattgagcaacagcagataaggaacgccctggaaaacatcagaaaggagatgaagttgctgggagcaggcaggttctctgaaaggctccctgagtgtggaagagcagctgtcactcatcagtggttgtcccaatatccaagaagcagtagagggtgccatgcacattcaggtgaatccgccatactacatcccgctggttgagctgggtcccccacccggagacggcccctacgacagtgggacagaacccacgccctgattaagaagattggacagtgccccatgcgagt

SEQ ID NO: 17200 - DNA, 248 bp, Homo sapiens
agtttctaaggatcatgtctgcgagccaggattcccgatccagagacaatggccccatgggrttggagcccgaagcgtcatcgagagtaactggaatgagattgttgacagctttgatgacatgaacctctcggagtcccttctccgtggcatctacgcgtatggttttgagaagccctctgcccatccagcagcgagccattctaccttgtatcaagggttatgatgtgattgctcaagccaatctg

SEQ ID NO: 17201 - DNA, 401 bp, Homo sapiens
agttctaagaaaagtctggcaaggccagcaggaagttcatgagccaaagtcaccggtcagtggagtcctgcatctcccaggaatggacctactttatattcctgctacactcagttactgactggcagcagcctttgggaagcatggcctagaaaatgcagggatggatttcctaggccagcagctgggccttggataattacactccctgcagttagaaatctaaaagatgcatattcatggtcacctcaaaaaaaaaaaactataaagaacacacacacaaaagtatgtgattctttgtggataaattattttaaaacatcagcccagcctctaaatgaggttccaggaagaaacagactttttggaagctgaatagatcctagagctcactatttcaa

SEQ ID NO: 17202 - DNA, 364 bp, Homo sapiens
arrysgsmkgrarccgcckggagysgmckssrsygrrssccgsmgwsgcscskrswsrcrcmksmwswmmymrsmkykrstcasckykggkmacmtcwstgamyrymasygwcysymaryytcyskyrmwkycyrkyrsrgmccmwcagsgmcysrsagsryskkgsrgrwywkkgcsratskkgrmmwmkkgsrrratsrygmmssmygaskrmssmcsastrmssascmmymmmsagsyascawkmskyrrcakwsctyswymrasmkkskycawsrkgskccmysrkgskscyccwggsccccgccagcagcaggcaggtgccaggctggggtgctgcagtggcatcttggggcatcttgg

SEQ ID NO: 17203 - DNA, 414 bp, Homo sapiens
tagaaattttttacggttcaacatataaaaagctatgcaacagataaaaataaggcaattattaatttttaaaagtatgtttaaaaacatagtatactagttagccctagaaactatactaaactatatttatgtagccataaaaatgtaaatactatgattatgattgctaaaacatcagtgggggggagaggatagtagagggagagttaaatcctcatctaccataattagaagttattaatgtctaaaatgaaaaaataaggtgcacatattatataaatatgggacatatatatatgtatatatcagaagagttagctaaaagttaaaaatatttgcctctatggttggggggaaagtggagggttatagcatttttatatactttgagtatttgcattactttgctag

SEQ ID NO: 17204 - DNA, 398 bp, Homo sapiens
atctaggtgaccatggatgggagctgagcttggaggaggacgcacagctgtggggtggggtggtgaagagttgttttgagggaaaaggcccacaaagagaagcccaaccagccagcccccaggccgccccgccaggacccaccaatgaggcacagatggcagccgctgccgcmamtagcccggctggagcagaagcagtcccgggcctggggccccacatcgcaggacaccatccgaaaccaggtgagaaaggaacttcaagccgaagccaccgtcagcgggagccccgaggccccagggaccaacgtggtatctgagcccagagaggaaggctctgccacctggctgtgctggcgtgtacttcacctgtccgctcactggggccacctgaggaagga

SEQ ID NO: 17205 - DNA, 369 bp, Homo sapiens
atttttttgacgggctcccgctgggattcgggtgtctgctcatctggaagcctccatgctggagaggtagtcagcacagcgcacgcagggcgtaggcgtgttttctcgtccctccctcgcaaccacagtcccgctcaaggcgtgggggtgtcacccgagacccgggcctcccctgcactttcctttaggccgaaaccgcgagccttcgcttcagtgtcgcttttccttcgccgccttcagaatgcagtgaactgcgagagcagggaatgagagagaaattaaaccgtttagcaaaaaaaaaaawtaagagacatgatggaggcagaaaataaattgtaggggggagggaaaaaagcgttacaaaaaaaa

SEQ ID NO: 17206 - DNA, 465 bp, Homo sapiens
  misc_feature 142: n=a, g, c or t
atttttttgacgggctcccgctgggattcgggtgtctgctcatctggaagcctccatgctggagaggtagtcagcacagcgcacgcagggcktaggcgtgttttctcgtccctccctcgcaaccacagtcccgctcaaggcntgggggtgtcacccgagacccgggcctcccctgcactttcctttaggccgaaaccgcgagccttcgcttcagtgtcgcttttccttcgccgccgccgccgccgccgccgccgctcttctcaggacctacatcgactgcccagtcggctgagctgggccctgggcaccgaggccsggggagctgaggggctcgggaccctgcgagccgcttaagaagaaaggaccgcaagaaccgaatgcagtgaactgcgagagcagggtaatgagagagaaattaaaccktttagcaaaaaaaaaaaataagagacatgatgggggcagaaa

SEQ ID NO: 17207 - DNA, 580 bp, Homo sapiens
aaaactttagttagtagttggtcccagtcagtaacactctgggagggctcaggccacatcacgaaatgtgacaggatagccttgaactcatcaattgctgggtaagaaagaattttaatgcaatggcaaacaaccaatcaaacaagcaaacaaaaacaataaacccttccttgaggaccaagaagacattgattagctaacctaagagctccaggtggagacctaggtcctgattgggtttctgaatttgaccactaggcagaaaactagcacccaaaaccagttggaataaaattacccacctacagtggagccaaggcccccagatcctttttgtcaggggcacctcaaactcaactccaaaattgatctaatgaactttcccaaaccacattcccttcttgcatttctgagagaatggattcccattcatctgactacagtgctaccctgaaagcagatccagagactaagattcacctgcaggtgattcatttgcaaggtaagctgtcatcagttggaggtaagcggaagacagtagagagtacagagcctggactgtgactcagaggatgagcac

SEQ ID NO: 17208 - DNA, 450 bp, Homo sapiens
attaaactttaatgggtaactagtagacagtaacactctkggagggctcaaaccacataaccaaatgtkccaagataatcctgagctcastattgtcagtcctgaagattttcctcagataatctttcatctctttgttcctgagastatatattagaggattacagagtggtgttatcacagaaaagaacaagagaaccagagtcactccacgagtcctgcctggggccccatgaaagtggccaacaatgtcactgagtttatattcctgggactttcccaagattctggaatgcaattgatgttctttgccttatttstcststtctacgtcgtgatcatgtggatttttatctgagatctacaacttatgaagaatacaaatgatgtatattcttttctactcttcatgtatggactagaggggcttgcacagtagtaagaaaaaaa

SEQ ID NO: 17209 - DNA, 510 bp, Homo sapiens
agtaacactctgggagggctcaggccacatcatgaaatgtgacaggatagccttgaactcatcaattgctgggggcactcaaactcaactccaaaattgatctaatgaactttcccaaaccacattcccttcttgcatttctgagagaatggattcccattcatctgactacagtgctaccctgaaagcagatccagagactaagattcacctgcaggtgattcatttgggtctcaactcaagcattcctttctcaagaagccttttgtggtatgaagagtgagacagagttccctgcgccacctccattgaatcatgttaggccttaatgtacctttcctttataacacttactgaatgattaatttggcatttatttacctggctattttattcagtgtttaggatttatactagattgtaagctcctcaagagtgttccaggtctagtttaggtcaccatgtatccctgattagtaccacacatcccagtgcaccatggttctcaac

SEQ ID NO: 17210 - DNA, 478 bp, Homo sapiens
cctgtaatttatgagagtatgttcattgctgtgagctttgaaggtgctctaatccttcctcatatttggccttagaatgcacctcggatcccccaaggtttaggctttcttcatttgtctttgaaactatatcttctgtctcttgtcatatctgcttattgcgtgtttttcataccttccacctctctaaaagccgttacctgagccctcgttatcacttttggttgaatgtgctgcacttagctgcatttctaagtttctgattcttgcaagtttgtggaaacagaggagtctttaacccacatcagccttgatctaagtgtaccactttacttaaaagttcgtgggatctggagctcctggtctagcaagccatgaaaatgccaataaatgtttgtaataaagcttttatttaaacatccattttgttcgaccttgaagctttactaatatgctgaagaacaaacagccgacgcca

SEQ ID NO: 17211 - DNA, 462 bp, Homo sapiens
attactgctgggagaagctgcggcgtgcggaagtggacttggagcgagcgtgtgtggtacaagctggacgagctgtttgagcaggagcgcaatgtgcgcacagccaagacaaaccgcgcgggattgctggccctgatgctgcaccagacgatccagcacgatcccctcactaacgacctgcgctccagtgccgaccgctgagcctcctggcccggaccccttacaccctgcattccagatgggggagccgcccggtgcccgtgtgtccgttcctccactcatctgtttctccggttctccctgtgcccatccaccggttgaccgcccatctgcctttatcagagggactgtccccctcgacatgttcagtgcstggtggggctgcggagtccactcatccttgcctcctctcctgggttttgttaataaaattttgaagaaacaaaaaaaaaaaaaaaaagg

SEQ ID NO: 17212 - DNA, 447 bp, Homo sapiens
acttagctgatagctagcattagctgctggccaggtgcataagccatcttagatgtccagcccaggttcatagaatgggatgcccactgatgacaatgccaggccctccagggaaacgaggtaagagaggccgaagaggagaatctggtcctcctggacagcctggtcctcagggccctcctggtccaaaaggcgataagggagaacaaggtgatcagggacctaggatgstgtttcctaaaatcaatcatgggtttctctctgctgatcagcagctcattaaacgccgcctgattaagggtgaccaaggacaggcagggcctccaggaccccctggccctccaggcccaagagggccacctggggacacagggaaagatggcccccgtggaatgccaggagtacccggtgaaccaggaaagccaggagaacaaggcttgatgggtc

SEQ ID NO: 17213 - DNA, 373 bp, Homo sapiens
  misc_feature 68: n=a, g, c or t
agttagctgccttggggaggggaggaagaccaccagagcccaggacgatctgctgtgcagatcatganccgtcgccgcagtgccagacagactcttcatccggaccggccgtcccactgggtcccctcaggaaagcgcagaagccggggaccccaaaccgcgtccagctcctcccacccgcccttctcggagccgcgcacttggtaacttgcgtgtgaagaactcacggccgtgttgccaggaaactgcggggagcagcctttgtggtctcacatatgcgtaacataataataaataacggttaacgtgataataaataaacaaataacaataaaaaaaaaaaaaaaaaaaaaaaaaaaaaaaaaaaaaaaar

SEQ ID NO: 17214 - DNA, 423 bp, Homo sapiens
ctccgacccgccccgsgsgcattgtgggatctgtcggcttgtcaggtggtggaggaaaaggcgctccgtcatggggatccagacgagccccgtcctgctggcctccctgggggtggggctggtcactctgctcggcctggctgtgggctcctacttggttcggaggtcccgccggcctcaggtcactctcctggaccccaatgaaaagtacctgctacgactgctagacaagacgactgtgagccacaacaccaagaggttccgctttgcctgcccaccgcccaccamactctggggctgcctgttgggcaaacatatstacstctccacccgaattgatggcagcctggtcatcaggcsatasactcstgtcaccagtgatgahgatcaaggctatgtggatcttgtcatcaaggtctacct

SEQ ID NO: 17215 - DNA, 404 bp, Homo sapiens
acgttggaacggaacgtggaggtggccctggccggggaggaggggcggcggcgaatgctgggagagtccgacgagcgctgcactaacgcaggatccggctgccgaagtcctcgccagcaggatgaagttaaagggragtagatcgtacagccatgcaggcatggagccctgcccagaatcaccccatttacctagcaacaggaacatctgctcagcaattggatgcaacatttagtacgaatgcttcccttatctaagaatagaatctttaaaccattctgtggttatatcatttttagttaaagtttttaaggttttattctgtttatcgtgtgcaggaaagaaaaaaatggtaccaggttaaactttaaactttattgttgtgcagattatttcagtaggaa

SEQ ID NO: 17216 - DNA, 439 bp, Homo sapiens
  misc_feature 403: n=a, g, c or t
aaaaactaaaccggagcactggccatatggttgtgatcaggtgggctgcagaggaaggaatcattacttgctgaagcatagccagtgcaccaaggagaggaaagcagataggcagaaaagtctgctgtgttcagagccttagggaggtctggggagttgagggatatagacagggtcacaggctaaaatgctaggccttgttcaagcttccaatcgcccctggaaatgggaaccagggacactcaccgctgatggggttggtgcacccagcacacttcttggcatacaagtcacagaagcagttcaggcagtaggcaaagtcatcgcgagctgtgaascgcttgcccagacagctgcttcctgcaggcggtgcacacgaagcactcctttgtgccagggctgnctcccgcttaaagtattttcagaaatctgaggggaa

SEQ ID NO: 17217 - DNA, 432 bp, Homo sapiens
acttccggtgcgaacgcctcggccgttccctcgcggasttactgagcgcggccgccgagcccagctccgccgccgagcgcctgtgccggcacgkwacaccatggagcgcccggataaggcggcgctgaacgcactgcagcctcctgagttcagaaatgaaagctcattagcatctacactgaagacgctcctgttcttcacagctttaatgatcactgttcctattgggttatatttcacaactaaatcttacatatttgaaggcgcccttgggatgtccaatagggacagctatttttacgctgctattgttgcagtggtcgccgtccatgtggtgctggccctctttgtgtatgtggcctggaatgaaggctcacgacagtgtcgtgaaggcaaacaggattaaagtgaacatcacctttttatagcatt

SEQ ID NO: 17218 - DNA, 221 bp, Homo sapiens
agcagcagcgccgggtcccgtgcggaggtgctcctcgcagrttgtttctcgagcagcggcagttctcactacagcgccaggacgagtccggttcgtgttcgtccgcggagatctctctcatctcgctcggctgcgggaaatcgggctgaagcgacttgagtccgcgatggagagagaaaaggaacagttccgtaagctcttttaattgggtgggcttaagc

SEQ ID NO: 17219 - DNA, 400 bp, Homo sapiens
tcctctgtgctttgtgctccaggaaaaagcactgtgtattgtaagaaattagatgaattttcaaactcacatagcgtttgaaaaacgagatagaaatctcgttttaggctgggcgcggtggctcacgcctgtaattccagcagtttgggaggccgaggcgagtggatcctgggtggtcaggagttcaagatcagcctgaccaacatggtgaaacccatctctactaaaaatacaaaaattagccgaacatggcgcacgcttgtgatcccagctactcaggaggctgagtcaggagaaccgctggaacccgggcggtggaggttgcagtgagccaagattgtgccactgcactccagcctgggggacagagcaagactgcatcccaaaaaaaaaaaaaaaa

SEQ ID NO: 17220 - DNA, 535 bp, Homo sapiens
acaggaagtgggtaagggtaatatggaggagcttccggcaggccccggcggctgaaagccgcgsagaagtgctggtctcggtcgggattccgggcttggtcccaccgaggcggcgactgcggtaggagggaagaggttgttggacgcgctggcctcccgccgctgtgcattgcagcattatttcagttcaaaatgaactatatgcctggcaccgccagcsctcatcgaggacattgacaaaaagcacttggttctgcttcgagatggaaggacacttataggctttttaagaaggcattgatcaatttggacttggaaaagggagagtgacacacccctccaggcaagtatccattgaagaaattctagaagaacaaagggtggaacagcagaccaagctggaagcagagaagttgaaagtgcaggccctgaaggaccgaggtctttccattcctcgagcagatactcttgatgagtactaatcttttgcccagaggctgttggctcttgaagagtaggggctgtcactgagtga

SEQ ID NO: 17221 - DNA, 565 bp, Homo sapiens
atttttggtggggcctttgtatctcactcccgccacagcttgggatcggtctctgctgttttacgtcctccacctcgggagcccccggtgactgtcacagcctcttgccctgtgatctgcaggttctgggagacgcacagctaagatgccaggacatcctggaagctgggaaaagatggagtttcactcttgttgcccaggctggagtgcattatcccaatctcggcttactacaacctccgcctcccaggttcaagtgattctcctacctcagcctcctgagtagctgggattacaagcacctgccaccacacccggctaattttttgtatttttagtagagatggggtttcatcatgttggccaggctggtctcgaactcctgacctcaggcgatccacccacttcccaaagtgcagggattacaggtgtgagccaccacgcccagcctctcaacctatcaacctaatttttattcttagtagacacgttggtggtgagccaatcagatgttgttattgatgagaaaaagcagaaatgatttctgttgatcttgaataaattt

SEQ ID NO: 17222 - DNA, 571 bp, Homo sapiens
atttttggtggggcctttgtatctcactcccgccacagcttgggatcggtctctgctgttttacgtcctccacctcgggagcccccggtgactgtcacagcctcttgccctgtgatctgcaggttctgggagacgcacagctaagatgccaggacatcctggaagctgggaaaagatggagtttcactcttgttgcccaggctggagtgcattatcccaatctcggcttactacaacctccgcctcccaggttcaagtgattctcctacctcagcctcctgagtagctgggattacaagcacctgccaccacacccggctaattttttgtatttttagtagagatggggtttcatcatgttggccaggctggtctcgaactcctgacctcaggcgatccacccacttcccaaagtgcagggattacaggtgtgagccaccacgcccrgcctctcaacctatcaacctaatttttattcttagtagacacgttggtggtgagccaatcagatgttgttattgatgagaaaaagcagaaatgatttctgttgattcttgaaataaaatttttt

SEQ ID NO: 17223 - DNA, 362 bp, Homo sapiens
gtatctcamtcccgscacagcttgggatcggtctctgctgttttacgtcctccacctcgggagcccccggtgactgtmacagcctcttgccctgtgatctgcaggttctgggagacgcacagctaagatgccaggacatcctggaagctgggaaaagatggggtttcgctcttgttgcccaggctggagtgcattatcccaatctcggcttactacaacctccgcctcccaggttctgacaacaaaggagattgtgacatattgctgggcctaacactaaggtgatgttagttatttgctttggctgtgccttggaaggcattgagacatactgctgtgcccagcaccaagatgatgtgagt

SEQ ID NO: 17224 - DNA, 479 bp, Homo sapiens
ttaattattttcattttgtcaaggtttatacatttacattctgtacatttacattctgttctgtagctataacagcctaactatgattttttaaaataggattatttatttaataggtttttttttaatagggttatagtgggttaacagccctctgttgcccaggttggagtacagtggcgcaatcatagctcactgtatgtaaccttgaacgcctgctcaaactatcctcccggctcagcttcccaagtagcttgggactacagatacacactaacacctggctaatctttaaattttttgtagagacagagtcttgctatgttgctcaggctgatctcaaactcctggccccaagcaatcccctgcttcggcctcctaaagtgctgggagtacagatgtgagttacagcacccaatcctataaagtttatataaattgttttcccaactccagtactcattaacataaaaaagctt

SEQ ID NO: 17225 - DNA, 285 bp, Homo sapiens
agaggacgatgttccctagtctaatctgctctttccttccttcattcattcaatcaatcattcacgcagctggccagcagacactggatgaccacccctgggccaggccttgtggcaaatgctacagtaatgaccagacacatcacacccgccttctagaagccctccctcacaaaccggatcaactgctatgataaagtgtccactaccattccttgagggcttacaatggcttctggttgggagaaagatkggaagaggaggacattcaagaagatcagagac

SEQ ID NO: 17226 - DNA, 462 bp, Homo sapiens
attgaaggaagcccagtcctctgggttttagagatttaggccccctcccgccttttgatccccaaattttattgtgttgggcggttctaggggacgtgagataaagatttagcaacaagtcccagcgatttggggcttggaagtggccaggaagaatcggcgacttaggaaaaacgccaacaatacggattctaattccaaaggaatcatttggttaaaggtcaccttcatgtaaggtctggaggaatggcggagaatctaggggactgttttacattttccttgtggaagatagggtatagcataccctgaagaattacatgcaagatgagaagaaatcatttatatggaaactagaatagctgatattccagactaagagccaaaaaaatgtgtgtcagagtcagctagcaaacaccaggaatcggctgtgaaggaagattgaaatttaaattcatatta

SEQ ID NO: 17227 - DNA, 126 bp, Homo sapiens
catttgtccccaactccccatctggccctgctgttgctagtacctgttatttattacctggaggcctgtccagcacccaccctacccccataaagcattgtttacacctgaaaaaaaaaaaaaaaa

SEQ ID NO: 17228 - DNA, 377 bp, Homo sapiens
  misc_feature 305,309: n=a, g, c or t
gtcaagcgtgcggcggcccgtggaagggaactccctccactagaatatgagctccttgtggtcaagactgggtcccctgttcccttccccccagtgccagckgasaaagagtctccctctgttgcccaggctggagtgtggtggcgtgatcttggctcactcaacctccacctcccaggttcaagcgattctcctgcaacctctgcctcccaggttcaagcgattctcctgscttggcctcctgagtagctgggattataagcgtgtaccaccaaccctggatgatttttgkatttttagtagangcanggtttcaccatgtttgtcargctggtctcgaactcctgacctcgtgatcctcctgcctsggctcccaa

SEQ ID NO: 17229 - DNA, 382 bp, Homo sapiens
caggatgggccaccagccacctcctccaactcaacaacattctataactgataactccctgagcctcaagacacctgcggagtgtctgctctatccccttccaccctcagcggatgataatctcaagacacctccgagtgtctgctcactccccttccaccctcagctccaccctcagcggatgataatctcaagacacctcccgagtgtgtctgctcactccccttccaccctcagctccaccctcagcggatgataatctcaagacacctcccaagtgtgtctgctcactccccttccaccctcagtggatgataatctgaagaaactaacgaagaataaataaataatataaaaataaaatgaaaaaaaaaaaaaaaaa

SEQ ID NO: 17230 - DNA, 453 bp, Homo sapiens
atattccttttctttttctcttgtgccaaactgacagaaaccgtcaccacactggtctttttctttaatgtctcattccccttgaggccagctgctatgccaggtggtgtctctgccaggctcctcaggcccagacagaggccagcccacaacctatgaccccctcccccaggacaccacctcccacccacagaccttccctttagctgttgacacaacttcccagctctgcaagtgtgccccctggatcaaggcgggtcccctcttgtttttttctttgctgccacgaggtggtccaagccttcagggtgggctcctatcaggctgggtgtgcgagtgtccatctgtccacatggatgtcgagggtggtttgtgtggagctgtgctcgtcagctgggtctgccctcttcccccttttctccttcttctctcctcatggactttttctgcaat

SEQ ID NO: 17231 - DNA, 248 bp, Homo sapiens
acctgatggcagaactcccacaaccacatgtatttattcctctgtcctaaaccgtcccctccttccctcacccccagcacagggggattctgagcagtgcctcttgtctgagggacatatcagtgacctcgacgttgcctttagactacagttgtgttagcctcttgcgtattggctttttcagagtcatttatgagcagaaaaaaaaaaagtaaaactttgctaatattaaaaaaaaaaaaaaaaag

SEQ ID NO: 17232 - DNA, 391 bp, Homo sapiens
agaatcagttccgtctccaactcactagtactcagccgccgcaatcagggggacaggtagctcgagcgcgcgctccacctgctccgacgcgatgcgggccaagtggaagaagaagaggatgcgtaggctcaagaggaagcgccggaaaatgaggcagagatctaagtaggcgcatcttgggaccgaggatggcgagcttctcctgcaccatggctgagccgcgttgggatgatggtctcccttttttagacgtgctttgctgtagacgtaggcgattgtaaaccgtcctttttgattaattctagcatgttctgagactgggtttatattgtaatttgaggataattatatgatgctctaagttaaattagattcctggcaaaaaaaaaaa

SEQ ID NO: 17233 - DNA, 387 bp, Homo sapiens
agaatcaggtccgtctccaactcactagtactcagccgccgcaatcaggggggcaggtagctcgagcgcgcgctccacctgcgccgacgcgatgcgggccaagtggaagaagaagaggatgcggaggctcaagaggaagcgccggaaaatgaggcagagatctaagtaggcgcatcttgtgaccgaggatggcgagcttctcctgcaccatggctgtgacgcgttgggatgattgtctccctttgtagacgtgctttgctgtagacgtaggcgatgtaaaccgtcctttttgattaattctagtatgttctgagactgggtttatattgtaatttgaggataattatatgatgctctaagtttattgatattcctgtcactcgagaa

SEQ ID NO: 17234 - DNA, 407 bp, Homo sapiens
tttttccctaagcccctcccttttctttcagcctttttccttcccccattatgtcatgacctcacttaagtggaacactattatcataacccagagattcgtcccagccccagagtccgacagactgtctggtccctattcctaatgaggggttgtgttggggcccaggtggagggaggggatttgggggttcagactgcggggaagccagggtctccctcttcaacgccctcctccccctcaacccaccttcccaactgggacattctcaagcttttcacaccgaaaaggaaaaaaaatgttatttttagatacattttatgaataacttttgttatgaatatggctggtaaccattgtgtatgttattaaagatacaaaatgttggaaaaaaaacaaaaaaacca

SEQ ID NO: 17235 - DNA, 422 bp, Homo sapiens
tttttccctaagcccctcccttttctttcagcctttttccttcccccattatgtcatgacctcacttaagtggaacactatatcataacccagagattcgtcccagccccagagtccgacagactgtctggtccctattcctaatgagggggtgtgttggggcccaggtggagggaggggatttgggggttcagactgcggggaagccagggtctccctcttcaacgccctcctccccctcaacccaccttcccaactgggacattctcaagcttttcacaccgaaaaggaaaaaaaatgttatttttagatacattttatgaataacttttgttatgaatatggctggtaaccattgtrtatgttattaaagatacaaaatgttgggaaaaaaaacaaaaaaaccaaaaaaaaaaaaaaaa

SEQ ID NO: 17236 - DNA, 286 bp, Homo sapiens
  misc_feature 117: n=a, g, c or t
tgctaggcggcctgcccagctgcagcccccggactctgatctctgtagtrrmmccctcctccccggccccttttcgccccctcttcaactcctctcactttttaaagcattgatatnaktatcttctcagatacagaccattttatgattttttaaaaagtaaaagttctaaaatgaagtcacacaagacaattattcttatgcctaagttaacagtggataaaagacttttctgtaaacaactccagtaataaatatcatgaactaaaaaaaaaaaaaaaaaaaa

SEQ ID NO: 17237 - DNA, 463 bp, Homo sapiens
actagctgagacccgcagcagccgcagagcacgctcagggctaaagtagccgcacccgctgtctaggaaacggttacctgagcggttgtcaggacacaacgacccagacgccagagccaacgccaaacgggtagaggcctatcgagcgcccttaaccacsggcatttgactcgcagcccgcggcgagacttcggcctggagcccccgcgcggagacgccgacgccgaacacatttattcttatttcgaatgagccattttttccccactggaaaacctcccttcaattagaaagatgaatttcaaaggttctgaagagtgggttagcaactttcgtcagagtcatcttggaaaggtgaaattgatggttccataggggaaaaaaaattggtttcccaatctgcttctgaaaaggaattcttctggctgaataggttggtagcttgagtcgagtaaccttcctt

SEQ ID NO: 17238 - DNA, 415 bp, Homo sapiens
gttgttagccaagatggcggtasgatcgctgcagcgagggtctggcggctaaaccgtggtttgagccaggctgccctcctgctgctgcggcasctggggctcggggactggctagatctcacccccccaggcagcagcagcagttttcatctctggatgacaagccccagttcccaggggcctcggcggagtttatagataagttggaattcatccagcccaacgtcatctctggaatccccatctaccgcgtcatggaccggcaaggccagatcatcaaccccagcgaggacccccacctgccgaagagaaggtgctgaagctctacaagagcatgacactgcttaacaccatggaccgcatcctctatgagtctcagcggcagggcggatctccttctacatgaccaactatg

SEQ ID NO: 17239 - DNA, 276 bp, Homo sapiens
taaaccgttgctgtttcagcccgggctgggggccggggacggggagctcctggcaccccgtgcacttgtggcctgcggcggtccttgcagagctgttcgccgaccggggcccgcgggaacctgccaccggcgcctcccaccgcggcccacgcgggcggcgcgcggaggagggggcgggggcagcggcggctgtagcggccgcgacctgggcgggcggaggagtgtgacgggccttagggccgctgtggatggtttctaaaatgatcattgaaaact

SEQ ID NO: 17240 - DNA, 324 bp, Homo sapiens
  misc_feature 154,239: n=a, g, c or t
gaaacgcaccgtgaagaccctctaactgtgcctactattctgctcccctccgatcggcgcggggctcttgtccttcctctctccacccagcgaatgaatgaacgcaggagcgctcggagtacacgtcttcaactcggcgacgccctgcttcggnccaccccgcaaacamccgscccggaccaggcccarggtaggcgcccatgaggacccgtmcstgctcctgamcatcaccgtcactngggtsactgtgctcgtgttggtcctgaagagcatgaactccaggaggagagagsmaatcassttasaggaccctgaagccaagta

SEQ ID NO: 17241 - DNA, 523 bp, Homo sapiens
taccaataatatttagagctagtctccaagcgacgaaaaaaatgttttaatatttgcaagcaacttttgtaaagtatttatcgagataaacatggcaatcaaaatgtccattgtttataagctgagaatttgccaatatttttcaaggagaggcttcttgctgaattttgattctgcagctgaaatttaggacagttgcaaacgtgaaaagaagaaaattattcaaatttggacattttaattgtttaaaaattgtacaaaaggaaaaaattagaataagtactggcgaaccatctctgtggtcttgtttaaaaagggcaaaagttttagactgtactaaattttataacttactgttaaaagcaaaaatggccatgcaggttgacaccgttggtaatttataatagcttttgttcgatcccaactttccattttgttcagataaaaaaaaccatgaaattactgtgtttgaaatattttcttatggtttgtatatttctgtaatttatggtgatatttaagg

SEQ ID NO: 17242 - DNA, 329 bp, Homo sapiens
agcacgtcgacgcggggcttttctttagccgggtcccgctaactcggctacggtgtatctgcgtctttggtcaggttgttccttggctaagagggcagtcgtcgcggacccacgcggttagcaaggcttagtgctcgggccggccgccttcacttccctcccggcttttcctcccgacttatccactttaggggcgtctcggagtgccggagccccggggaagagcggggtgccggtgtccgctccgggctcggatgggaartggtgggaggagcgacccgggatgttcagtctgatggccagttgctgcggstggttcaakcggtggc

SEQ ID NO: 17243 - DNA, 510 bp, Homo sapiens
aagggaataaaattggccacctcagccagcagcagcaaccagctcgggtctctttctaccctgggatctttgttcttttgctgttcactataaactttactactactcactctttgggtctgtgccatctttaagagctgtaacactcactgcaaaggttcgtgagaggccatgaacccacctggtaggaaccaactccggacacagtacctactagatagctcattttgcattattctgaagtgagaagaacattgctgtggacctcgttcttaagtgtattctcaagattaacacctccacactggaatgtgaaattaatcaaagcagccaggccagcacgttgggtgtcactgatgttttccaggttgtttttccttcttaacctgaaaaaaattagaaagcttctttgccctccaaattgtaggcaacagaaaaggttagaatacattggaaaacttagtttttaaaaaattccacttttagactgcacctgtagtccaagctact

SEQ ID NO: 17244 - DNA, 468 bp, Homo sapiens
ttctatactactatgttaaacctactactttaatgatctggctaccgtctgccaaatgtcacttttcaagtgagaacagaagaatgagattgtgaagattctgtggacaatgtctatataatcatttaagtgttaaatataaactaaatgacaatagcagcttgtaaattaatgctaattctggctgggagcagtggctcaggtggctcatgcctgtaatcccagcactttgagaggccgaggcaggtgaatcagctgaggtcaggagttcgagaccagcctggctaacatgatgaaacctctctactaaaaatacaaaaaattagccgggagtggtggcacatgcctgtagtctcagctactctggaggctgaggcgggagaaccgcttgaacctgggagatgggttgcactgagctgatatcgtgccactgtactccagcctgggagacagactccgtcccaaaaa

SEQ ID NO: 17245 - DNA, 424 bp, Homo sapiens
gtttactcgctgctgtgcccatctatcagcaggctccgggctgaagattgcttctcttctctcctccaaggtctagtgacggagcccgcgcgcggcgccaccatgcggcagaaggcggtatcgcttttcttgtgctacctgctgctcttcacttgcagtggggtggaggcaggtaagaaaaagtgctcggagactcggacagcggctccgggttctggaaggccctgaccttcatggccgtcggaggaggactcgcagtcgccgggctgcccgcgctgggcttcamcggcgccggcatcgcggccaactcggtggctgcctcgctgatgagctggtctgcgatcctgaatggrggcrgcgtgcccgccggggggctagtggcacgctgcagagcctcggggctggtggcagcagcgtcgtcata

SEQ ID NO: 17246 - DNA, 318 bp, Homo sapiens
actttwmcgggaggscttcacrtrttccagcamrrgawaccactttgcagtgccagactggmwgaagtaacggtcamtctgaaamcagggtgggagagctgcctctctttgaacctctcccaggcccaactctaacccagggaggcamacttggtcgatgtaagcggtggcttggagacagaatcatctavtggarmaggatacactagaaggtgctggggatacatcagaggtgaawvaatactcaggcgggctccgtggatgwmgagaatggccgacagttgggtgaggtagagctgcaatgtgggatttgtacaa

SEQ ID NO: 17247 - DNA, 311 bp, Homo sapiens
atttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcactacctaaagcagtctatttatattttctacatctaattttagaagcctggctacaatactgcactccagcctgggcaacagagtgagactccgtctcaaaaaaaaaaaaaaaaa

SEQ ID NO: 17248 - DNA, 384 bp, Homo sapiens
ctttcgcatttcgggacggctggaggctggcaccgtggcccctgcgccccacgtggcgccctttccgggcggggggggtggggaggcacctccagcgacaactctcccccctcccccggcwcccggctgatttgctgtgccactgggagggttcgggggtggctgagctgagagggctccgggaaggagtgacgtcaggacctgccttcagccccctttgtgccgcgggacgcccagcggcacgacgtggagctcctggagagcagctdccctgccattttgcgggacttcggggctgtgagctgggacttctcagggactacccctccgcctcggggctggtccccacctctggcccccgggtgctascagctcctgctgtac

SEQ ID NO: 17249 - DNA, 457 bp, Homo sapiens
aattgtgaaatcagaaaaaaattcagacttccaattgaggtactaaacaatgtatttctgaaattatctggattgaaaacaaatctaagagcacacatcttgatacgtgcaatcacgttcaacagawactcgcccacgttaggatgtaatcagaatcctgawtagacctgmactcgcaacagactggaacgggaatagagcaccgagggctgtaccaggggcagggcagaagacagccamccgcccaggscgaatcactcactgggasccggctcaggtaatcctgargcgtcctcgggggtacgaaggatcgaaamcttycgtcaagtcgsaaggstctaacggcaatagscgaggcatcaactcttccamtgcggactccgctggtamccamgscatggttttcaaaccagccagttccgctcggcgcatgcgccmattctaggtcamagcgcag

SEQ ID NO: 17250 - DNA, 291 bp, Homo sapiens
caatgtgtttgcaaccttaagtaaggaaagggaaaaaaaaaatagccctctgaactctgatcttttgccgcttctgtagattttgattgtgaagttgggagtgaggacattcaaaagcccatggkgaatgcatatgcctttagaatatkgkgcctgttttaaaatgtttgagcttttaaaatactttgttaaaacatgaatccatttttgtaattgtataaatactcataactaattttgaatgctactgattgtgtaactgaatttttgtatccaaaaatacattcttga

SEQ ID NO: 17251 - DNA, 274 bp, Homo sapiens
aactctgtttgggtctcagccctttggatgttaatcgactgggtccgtgcacctaaataattaaataattcctcctcaatcccacggtctctctgattccttaattatcccactgcacactctgtcacccaggctggtgtgcagtggcgtgatctcagctcactgcagcctcaacctccagggctcaagggatccttctacctcagcctcctgaatagctggactgcagatatgcatcactacacccagatgttgaagtgctgttttttaaagc

SEQ ID NO: 17252 - DNA, 443 bp, Homo sapiens
  misc_feature 207,266,312,314,350: n=a, g, c or t
attttgtcttgtcggctcctgtgtgtaggagggatttcggcctgagagcgggccgaggagattggcgacggtgtcscgtgttttcgttggcgggtgcctgggctggtgggaacagccgcccgaagaagcaccatgatttcggccgcgcagttgttggatgagtttaatgggccgggaccgaaacctagccccggacgagaagcgcanaacgtgcggtgggaccacgagagcgttttgtaaatattatctctgtggtttttgtcctncggaattgttcacaaatacacgttctgatcttgatgtatttggaanangagataacattagagatgtcagcaaatttttggaanatgacaagtggatggaggagtagcagcaaacgcaacagagcagagcaacctgtaccctaaaagcctgcagaaggggatactaaacagaagcga

SEQ ID NO: 17253 - DNA, 560 bp, Homo sapiens
tatttgctaaggaaatttatttattgctgtggctaatgatattttaacataataattggaattgtgactggtaacattatgccaaacctatcatgaataacatattgacaaatttctatcaactttatataactcctgaaacacttatattaataacatatatctatatacatataacctaaagaagatatagcatcagttcttatttgacagtacttcctctgtaatttaacaaatcaaactaattaacataacatctctcttttacaaggcaagagacaaatcctttgatattttccaggaaccctctgggaactctcaatgttaatttaaagtcaaagatacgttatgtagaatttgatttgggccgggcacagtgcctcatgcctgtaatctcaacactttggaaggccgaggcaggcgaatcacctgaggtcaggagtttgagaccagtctggccaacatgatgaaacctcgtttctatcaaaaatacaaaaattagctgggcatgttagtgcccgcctgtaatcccagctactcgggaggctgaggcggggagg

SEQ ID NO: 17254 - DNA, 433 bp, Homo sapiens
ttttgccctccttccccccttcgtccgctctcattggctctgctgagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtaggtgggctgatcccagtctttttttcaaatgttttctagtagcatcttgagctcttttcttgaattattaaaaataactatcattaattaaaaa

SEQ ID NO: 17255 - DNA, 335 bp, Homo sapiens
cctagacccacagcccctcgggagcaccccacctctgtgtgtgatgtagctttctctccctcagcctgcaaggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatcaactgttttgtatacttgttttcagttttcatttcgacaaacaagcactgtaattatagctattagaataaaatctcttaactattaaaaaaaaaaaaaaaaagg

SEQ ID NO: 17256 - DNA, 722 bp, Homo sapiens
aattttttggttttgttctttttaaaaaatacatacttttttgaatgtatcatgtcttcattaacaacagaaaatccacatggtgtttactaaacttgtttacgacattaaaaatttcctttttatttttagtagcccaggttgagtttttcacaagagatttttttcttagctgaggtatagttgtatagcaagaagaattaagccacatttttgtgtgtggaaagacagttttctatccacgtctttttctgtttgtcagaaggtgggagtatggtccaaataaatccattaggttactcctgcagcatgcgcttttagcttctctcttgactgaggatcaaatatcctttgtgagctggccctcagctcctttgctcatgtgtacaaacctcagatgttactacattttatatctaccagagctattcaagcaatagtatttgaaccactagccttttaaataaaattctgccccattactgatgtgcagatattgagttcactttcattttttgccagatttctttgcactactttaggtaaaaatagttaatctatttttctttgacatcctagtttgcgtcagtgacagaacttactgcttagtctttgtactttttaaaaaatctataaatttaatgcactgtccaagtgaaatgtcctagttgtcattgtgattaaggggccaactttccaggcagctagcagagatactattc

SEQ ID NO: 17257 - DNA, 447 bp, Homo sapiens
  misc_feature 371,395,397,407,410: n=a, g, c or t
aatattgcgcctgcgccacgccggctgcgagactggggccgtggctgctggtcccgggtgatgctaggcggctccctgggctccaggctgttgcggggtgtaggtgggagtcacggacggttcggggcccgaggtgtccgcgaaggtggcgcacatgggcggcaggggagagcatggctcagcggatggtctgggtggacctggakatgacaggattggacattgagaaggaccagattattgagatggcctgtctgataactgactctgatctcaacattttggctgaagaaattcagttcatgaagataagaagtttcttgacaaatacatgccccatttcatgaaacatctkcattatagaataattnatgtgagccactgttaaagaactntncagggcmttnatnacattagtgaagcatcaragagcttcagtttttaccg

SEQ ID NO: 17258 - DNA, 479 bp, Homo sapiens
agactattgcgcctgcgccasgccggctgcgagactggggccgtggctgctggtcccgggtgatgctaggcggctccctgggctccaggctgttgcggggtgtaggtgggagtcacggacggttcggggcccgaggtgtccgcgaaggtggcgcacatgggcggcaggggagagcatggctcagcggatggtctgggtggacctggagatgacaggattggacattgagaaggaccagattattgagatggcctgtctgataactgactctgatctcaacattttggctgaagggtcctaacctgattataaaacaaccagatgagttgctggacagcatgtcagattggtgtaaggagcatcacgggaagtctggccttaccaaggcagtgaaggagagtacaattacattgcagcaggcagagtatgaatttctgtcctttgtacgacagcagactcctccaggggctctgtccact

SEQ ID NO: 17259 - DNA, 351 bp, Homo sapiens
tgtttttagtctcttgtgctgtgcctagtggcactgggctggggaggacactgccccgtctaggtttttataaatgtcttactcaagttcaaacctccagcctgtgaatcaactgtgtctcttttttgacttggtaagcaagtattaggctttggggtggggggaggtctgtaatgtgaaacaacttcttgtctttttttctcccactgttgtaaataacttttaatggccaaaccccagatttgtacttttttttttttctaactgctaaaaccattctcttccacctggttttactgtaacatttggaaaaggaataaatgtcgtcccttcaaaaaaaaaaaaaaaaag

SEQ ID NO: 17260 - DNA, 480 bp, Homo sapiens
ggtgtggcctcgctcctccaggaagcttgtcctccactctgaaacctccagggcgctttctgtcttgtgcatttcagcagctgaaccgctgagtatctgctattctttttgatcttttggcatgcgagatattaactaagggatggctgggcctcactttaagcagctgcaaagaagaatgatgattttctaacaagagctttttttctgtccaccttgaatgctctatctctggacttgtaagacaatccttcctgctgattgcgagtaaargtaacctgatgaatcttcttggtgtgaaacttgtccatattacggattgtgtccttaggaaagaccccagaaaggaatggcaaggcccccaggtgatgtcgacaccgctggcctgaggacctcacttgagtagagaagtgtgaggggacttaggcaagcacatgcatcctcagtgacagagctggaacccatgtctgcccaacgcca

SEQ ID NO: 17261 - DNA, 69 bp, Homo sapiens
agagcagcgggcgcgctcataaagggcacagccgagggtacgtggatcgcggtgcggagactgaggtta

SEQ ID NO: 17262 - DNA, 536 bp, Homo sapiens
agattcaatcttttaagtctgttgattgtatatactggaatatatgtttagtgggttacaaacccaatttatctttttcaatttaattttgttttatatgttgggtatggctctgactaccactcctaagaaaaacatcttaggtccttaatgaaggccatggtttccctttgtcctcctaggattctgcaaatttttttattgagccatctkgaaggggacatkgagacagcctaaagaaagaaataagttatgaatgaaaaaagcaagtgatagaagaatacatatggtatgattcacagaagaatacttgcaatgtgatccatttataaaatgttctaaaagagacaaaccaacaatatattgtctagggatacagtcaaaggacagggaatgattacaacaaaaatcaaggtactagttacctggggatggttaaggagagggatgtaacctcagaagggtacacaaaatgtatttctgatattactggtggtgtatttcttaacctgaatcataaatatgtacacaacgaa

SEQ ID NO: 17263 - DNA, 466 bp, Homo sapiens
agtttacaagtctgttgccctaggtgatagattcaatcttttaagtctgttgattgtatatactggaatatatgtttagtgggttacaaacccaatttatctttttcaatttaattttgttttatatgttgggtatggctctgactaccactcctaagaaaaacatcttaggtccttaatgaaggccatggtttccctttgtcctcctaggattctgcaaatttttttattgagccatctggaaggggacatggagacagatgagcccagccctaacagctattcaaggtgtcagacatgtaagtgagtgatcatgagtgttccagcctaatcaagctcctagataagtccatctaacatccaacatcaagtggagcagaagaactgcccaacaagcaagtcaaccccacagtatcttgagagataataaaacatcttttttaatccacaaaaaaaaaaaaaaatg

SEQ ID NO: 17264 - DNA, 454 bp, Homo sapiens
agggtctcacgtggccagccccctccgagaggggagaccagcgggccatgacaagctccaggctttggttttcgctgctgctggcggcasgttcgcaggacgggcgacggccctctggccctggcctcagaacttccaaacctccgaccagcgctacgtcctttacccgaacaactttcaattccagtacgatgtcagctcggccgcgcagccggctgctcagtcctcgacgaggccttccagcgctatcgtgacctgcttttcggttccgggtcttggccccgtccttacctcacagggaaacggcatacactggagaagaatgtgttggttgtctctgtagtcacacctggatgtaccagcttcctactttggagtcagtggagaaattataccctgaccataaatggatgaccagtgtttactcctctctgagactgtctggggagctctc

SEQ ID NO: 17265 - DNA, 489 bp, Homo sapiens
taaacctcctatttgctggtcttagtgtctgtatctgtcttttaatgttataaactcttaaatgtagatttagattcttgttttggggttctttgtttgtttaagtatttggtttaaaatacaaatagaggcctggcttggtggctcacgcctgtaatcccagcactttgggaggctgaggcaggtggatcatgaggtcaggagttcgagaccagcctggccaacatggtgaaactctgtctctactaaaaatacaaaaataagccaggcatggtggttggcacctgtaatcccagctatccaggaagctgaggcaggagaatcacttgaacccgaagcagaggttgcagtgagccgagattgcgccactgcactccagcctgggcaacaagagcaaaattccatctcaaaaaaataaataaataaaatacaaatagaaattcaggccaggcacggcagctccttgggagactgaggcaggtggatcac

SEQ ID NO: 17266 - DNA, 472 bp, Homo sapiens
ttgatgttgcttacattgttctcctttgctggggtgggggctggaggggcgggagagagtgccatgtgtagaaagagcactgggcggggagtcaggagacgggcattggagggatggcactaactgcgagaagaaggcaggccccagtgtttcatctgtaaaaagggaagactgggctgggcttggtggctcacacctataatcccagcactttgggaggtcaaggcaggtgggtcacctgacctcaggagtttgagaccagcctggccaacatggcgaaactctgcccctactgaaaatggaaaaattagccaggcatggtggcaggtgcctgtagtcccagctacttggggggctggtgcgggagagtcgcttgaaccagggaggcagagattgcagtgagccgagattgcactactgcactccagcctgggcaacagagtgagactctgtctcaaaaaaaaaaaaaaaa

SEQ ID NO: 17267 - DNA, 544 bp, Homo sapiens
aaaaagcagaggccagttatatttttcaaagatgctacagcagttatctcccatccaacaagctctttggtgatgggaacttgccaacccagagtctaactttcctccccttaagtatggattggacttgatgacttgcttgaccagtaaaatgtggcagaggtgatggtctgggacttttaaagctaggtcagaagcagcctcacagctttttacctggatctctagggactctagctgttagaaagctcactctgggaacctagtcgctgtgttgttaagatgcatggagaggccatgtatgggtacttcaattgacagcccaaggtgagcttccagctgacagccagcaccaactgccagccagcaccaactgccagccatgtgagtgggccattttggcatcaagcagtagtagaggctttggatgactgcagctcctgccaacatctgactgcaacctcctgagccaccccaagtgagaactatccagttgggcctggccaacctgcaggactgtaagagctaataaaacattactgtc

SEQ ID NO: 17268 - DNA, 555 bp, Homo sapiens
  misc_feature 24: n=a, g, c or t
gttggcggasagagcggaggcgcncgkggcggagggcccacgagggctcagccttcccggtcagcggtggtgacggtatcccaggagtgccagagaaccgttgcttttccgagttgctcttcktbcaaggytcgtttgggtggtcggcatggcccgtggaaatcaacgagaacttggcccgccagaaaaacatgaagaaaascccaggaaattagcaagggaaagaggaaagaggattarsytgrmtggctytcagagaaaagcagagggactctgagatcatgcaaagaaaagcagaaggcagctaatgagaaggaagtctatgcagacaagagaaaagtgatgactggctatttggaaaacctgggtgctactgccaactggggtgtatcataagctctaagatcaagatttttgtagagtgggacagtcattacatatggttataacttatcctttaaaaactattttaaacttttatccttttcagctttactttagtgcgatgtttttagaagcagtcttcaagataaacctaccatgctgcgaaaaaaa

SEQ ID NO: 17269 - DNA, 586 bp, Homo sapiens
  misc_feature 24: n=a, g, c or t
gttggcggasagagcggaggcgcncgkggcggagggcccacgagggctcagccttcccggtcagcggtggtgacggtatcccaggagtgccagagaaccgttgcttttccgagttgctcttcktbcaaggytcgtttgggtggtcggcatggcccgtggaaatcaacgagaacttggcccgccagaaaaacatgaagaaaascccaggaaawttagcaagggaaagaggaaagaggattarsytgrmtggctytcagagaaaagcagaggggactctgagkatcatgcaagaaaagcagaaggcaggctaatgagaaggaagtctatgcagacaaaaggaagaaaagtgawgrctkggcyaatttggaaaaacctgggtgctactgccaactgggtcgtatcataagctctaagatcaagattttgtagagtgggacagtcattacatatggttataacttatcctttaaaaaactattttaaacttttatccttttcagctttactttagtgcgatgtttttagaagcagtctttcaaagaataawacsactaaccatgcatgcgaaaaaaaaaaaaaaatgcga

SEQ ID NO: 17270 - DNA, 464 bp, Homo sapiens
acgagggctcagccttcccggtcagcggtggtgacggtatcccagagtgccagagaaccgttgcttttccgagttgctcttcttccaggctccgttggtggtcggcatggcccgtggaaatcaacgagaacttgcccgccagaaaaacatgaagaaaacccaggaaattagcaagggaaagaggaaagaggatagcttgactgcctctcagagaaagcagaggtacgtggtactaatttaattctaaagtcactgacgttgtgattgaagcaacattttgggctgggtgtgttgcctcatgcctgtaatcccggcagtttgggagagtcgggagaactgcttgaagccaagagtttgagaccaacttggacaacatrgccagcccctgtatctacaaaatatttttttaaattggccaggcatggtagcacatggctgtggtctcggctactctggaggctgag

SEQ ID NO: 17271 - DNA, 294 bp, Homo sapiens
acgagggctcagccttcccggtcagcggtggtgacggtatcccagagtgccagagaaccgttgcttttccgagttgctcttcttccaggctccgttggtggtcggcatggcccgtggaaatcaacgagaacttgcccgccagaaaaacatgaagaaaacccaggaaattagcaagggaaagaggaaagaggatagcttgactgcctctcagagaaagcagaggggactctgagkatcatgcaagaraagcagaaggcaggctaatgagaagaagtctatgcagacaaggagaaw

SEQ ID NO: 17272 - DNA, 366 bp, Homo sapiens
  misc_feature 132,212,227: n=a, g, c or t
aaaaatgcgaacttaggctgttacacaactgctggggtctgttctcgccgcccgcccggcagtcaggcagcgtcgccgccgtggtagcagcctcagccgtttctggagtctcgggcccacagtcaccgscgnttacctgcgcctcctcgagcctscggagtcccagtccgcccgcacaggccggttcgccgtctgsgtctyccccacgccgnctygcctgscggcgngctcgtccctycgggccgacatgagtggggaccacctycaccacaaattaaagatgaacctgaagatgatggctattttgttcctsctaaagaggatataaagccattaaagagacctcgagatgaggatgatgctgat

SEQ ID NO: 17273 - DNA, 199 bp, Homo sapiens
  misc_feature 136,139..140: n=a, g, c or t
tgcgaacttaggctgttacacaactgctggggtctgttctcgccgcccgcccggcagtcaggcagcgtcgccgccgtggtagcagcctcagcsgtttctggagtctcgggcccacagtcaccgccgcttasctgcncsnnctcgagcctccggagtccccgtccgcccgcacaggccggttcgccgtctgcgtaaccac

SEQ ID NO: 17274 - DNA, 321 bp, Homo sapiens
aaaaagcagattcatcagtttaaaaatacagtttgaaaacaccagcctagatgatctttgaatctccttgctctgaactcagtgatttcaggcaaaccagggatgaactgctcaaggccaccaactaggccttggctcttcttgatcatgaatcaggcctcttccatttgttaacaacaatgtctggtagaaagaactgatgttcccccaagcctgaaaagcagagtctttaaggaagaaattttcaaaattatctgagagggcaaagtggcaaattggttctgttttttacctctcaataagcaagcgataaaactgcaa

SEQ ID NO: 17275 - DNA, 473 bp, Homo sapiens
acaggtgaacttaagaatggagaatgaaggggggaggaggcacaagggactggctactccttatgggttctctttagttcttagaggtctttggatgtcaccaagctgagaacagctggaaggggaatttgaacatcttccaaacctctctattacttgaagttgagaagaaagtgattctgtctcacagtagcatatcaattcagtttaaactgcatttatactcaagtgtagtaattactagcccaatatttagtaattgtagattttaaaattctggccaaaactaaataatttaaaagttgaattgtttagcgcgagtgtggtggctcatgcctgtaatcccagcactttgggaggccaaggtgggcagatcgcttgaggtcaggagttgcagaccagcctggccaacatggtgaaacccatctctatcaaaatacaaaaattggccgagtatggtggtgcctgcctgt

SEQ ID NO: 17276 - DNA, 222 bp, Homo sapiens
aatctgcgacgtggccggcttcttctgcccggagaggacgtcatttccgccgagtccctgacctgctgctaggatcgcgacgggaactggagcccgaggtccccgcgcggcccgggcctggcgccctgaggggaagagcggcccggcccgagccatgacggacgggatcctagggaaggcagccacaatggagatccctatccacgggaacggcgaasaggg

SEQ ID NO: 17277 - DNA, 191 bp, Homo sapiens
tcctgctgctaggatcgcgacgggaactggagcccgaggtccccgcgcggcccgggcctggcgccctgaggggaagagcggcccggcccgagccatgacggacgggatcctagggaaggcagccacaatggagatccctatccacgggaasggcggarcarggcagckkcctgaagatgatgggctggags

SEQ ID NO: 17278 - DNA, 486 bp, Homo sapiens
acatcaaggagccaatctgggaaacactatcagaagaaaaagaagaaagcaagtcttaaagcctcagggaggccatttttgcctgaatttgaaatgagggtgggccagatgagtatgtttaagtggagagtgcttccagctgagatgatttgagtctgccctaactgctctattgagttctcgtgccctcatcagctgagagcagggaatggaactttaatgcaagaaccacttttatctactcttttttgtacatgtcattgtttcagttctgatttcaacaaacatgagcaaaccactttgactcaaagcggaaagagtgaaaattctattttgttatgctactggtgttcaattattagtttgtaccatttttaatttatgtcagttgatgcatctgaaaataagtgcttgaagtgttcacacccttactttttttttttaarattcctagaaggaatctttggttaattcagattgagcagt

SEQ ID NO: 17279 - DNA, 421 bp, Homo sapiens
actttttcgcctccagggacactgacgcatgcgcatcgtgccctggaccaggcggccgtggcgcgggtggcggctgctgtgctggctgtggggacggaggcggtgaagtgccatcttcggctaggtcgtcacaggctccggctcatggcatcaagtggcatccatcataasatcgttaactgaagacaatatgcaaaattctcacatggatgaatacagaaattctagtaatggcagcacaggcaacagttcagaggtagtggtagaacatcctactgatttcagtactgagattatgaacgttacagaaatggaacagtcacctgatgactctcccaatgtgaatgcatctacagaagaaactgaaatggcaagtgctgtggaccttccagtgacgctgacagaaacagaagcaaatttc

SEQ ID NO: 17280 - DNA, 524 bp, Homo sapiens
agtgctgggtcgggcttccagctccctacaacgcagaccagtactggagttcgtggtgctggaagaccgccgcccgactctgggccccgggtaggaaacaacaatttcggacctcctggggtctatgctaggtatgaggtgtatctttgccctccatcaagtagcaaagatggacatgtaaacaaatttcgacactgtgatgactgccacaaaaagcagcattatgaggttgaatgtaaaaggataaccttagcggcggcgggggccggaggatgaaggaaggcttcctkaggtaggcgctggttgaaactgaagttggagagagcaagtggcatttgctgaagtgcatttccggtagaaaactccagtggtccctcacctgactgagtgkcgcagtcagagataaatggaacagagtctacaaataaacattttataaagatgatccttcaatacatattctacagcccagttaaaatgtgagaggccatgatctacagacagccatttataaaggtggatca

SEQ ID NO: 17281 - DNA, 448 bp, Homo sapiens
taatcatagtcttaaatgttagaaatcctatataatattatttattaaaaattgcagatttttaatttaaaatacatttttatttttaaattttgtcttttccctttttttttcagatcaacaacccctccccgtcgtaaacgctgaggaatgatgtggcaagaatgccatgatgttctttaaaaaaattccatkagttttaagggcttgtctcattatagaggcacattgtggctgtgtaggtgaaacagaatcttttttttttttwaatctgtaaataggkgtactttttccaatgctgctccaagttacttaataggatttctttgtattacgtttttttcaaaaaatatagtgcataataagctataaacatgccattctctttcagctgtaatgttcttaaaattattcttgaatgtactgtgatgtcaataaggctctttag

SEQ ID NO: 17282 - DNA, 486 bp, Homo sapiens
aaaaacgaggctgaaaggaaaatgttggggagcttggtggagtctgggtttagggctagcccaggagggaacgagcctgaacttcaggggtgagtttctttcagggacatcgagcgaggcaggtgttccaccccactttcttatttgaggggagaaggaaaccaaagccagtagaaatggaatttatggcctccgtgctctcagagggagaaaaaaattctcactcatcagcctaaagagaaaccctgtcttatcccagattaccaccatgggatttaaaattcagtgagaagactgcttgggaaatactgtctccgaactgccggtacagacactgcccattggtacaatatttttaggtcatctgtcaattgcatgtttgcatttctttcatgcaatacaagttgaaatcataatgaatttcttgagtttcaggaatatctcaaaataaacttcttcatcctcaacaaatgaaaaaaaaaaaaa

SEQ ID NO: 17283 - DNA, 468 bp, Homo sapiens
tctctgttttagagtttggggctagtgtgtttgtgtttccattctaagattgagtctggcagtccctgtttttttgcattggggtaactgctctttgattttttttaattgcagtatttgtgtgattgcaataataaagtttggtttggkttttacagtcatgcgcagggacgatccttsttctctgctgtaaactgtaaaaagtttatggagacttaaagtcttgatgttgtgaagcagaggttattttgtggaaagattaaaaggattttgttggtacctggttttgtgttgtgtatatatacatgaggttgaacagtgaaaggaaagttcagtagtgatgttagaagggtaactatgacaaagatacttttgagataacatttaaaagtactttatattttacataatagcatgtttcattttgattaaaagctacbaaaggaattttgatcatggcataagtgt

SEQ ID NO: 17284 - DNA, 499 bp, Homo sapiens
atataaaattctctcatgctaacaactggcatactatcaatttctcctgaagagcataggtatagtactctgcactgaactgatgagtgatctctggtatcgttgagaatcccacattctcctcttacctagtacttggtttcttcctctagaagatggcacactagtactatcaatgatatccattttgaggactttttttcaaaagaagactacgttgtcttcaaaacaaagaaaagaaccatatagatatcaagccatctttactaactctatctttttaaataatctcattcagaaacttcttctgacaacataagtcaagtcaggaaccatcagaacctacaactcagaaagataaccaggtcgccaatcatttactcaactattccaccatccagtattgtatggttgaatcagaaatcgtgctaaaacatgtttttaacctggcacttcaaagtattcacattttcaacaatatgctttcagcaaatgaatt

SEQ ID NO: 17285 - DNA, 512 bp, Homo sapiens
  misc_feature 355,395,398,400,402,405,449: n=a, g, c or t
acctccttgattctcagttttgctggaggccgcaaccaggcccgcgccgccaccatggtacgttgaatcccgatctctggaaggkttargggcagagctctggtgactgggggatgacgagccacctctcctgtcatccttagcgtcgcccggtgccacgaggtatgagagcctcggcagacggccgggctccggcagtgattcagcatctccggcctggccgggctaggggttatcggtagccagtgcggcctttccaccgctttcgcttcccggggagcctccgacacttcctcctcggtcagctagatgagttcgcccctcaggttccttcagtggagtagattctgagcgntccagaatagctcctagtgctgtgtatggkagakkawcdnahnhnmnaandgacwtggaggcctacctgtaccaccagtgcggacttgaccccnaggtttgtgttcctggamagcgtcgttttcctgkttcgaatcatatgacaatgatgtcactgt

SEQ ID NO: 17286 - DNA, 53 bp, Homo sapiens
astttcggcagcacctccttgattctcagttttgctggaggctgsaaccacca

SEQ ID NO: 17287 - DNA, 369 bp, Homo sapiens
  misc_feature 210: n=a, g, c or t
agagcgcggaggcagccatggtgcggttcaagcacaggtacctgctctgcgaactggtgtctgacgacccccgctgccgcctaagcctcgatgaccgagttctgagcagcctcgtacgggacacgatcgccagggtgcacggaactttcggcgcascctgctccatcggcttcgcgggtgcaagggcgctgggggaagaggggaaccggngaggatggcgggatgtggagggggcaggcgccggagaagaaagaaggggcacgattggccaagcccgtgcaccgttttttgtaaggtacaataagaacatgtcagaagttcctaattcagtacaacaggagacagctgttgatcttgttgcagaactgc

SEQ ID NO: 17288 - DNA, 510 bp, Homo sapiens
taaggtgataagaagtttgtatgcttttttatctgtgaaccacctggagatcgactggccactgggtcttgcattttaatagaggggaatagtagtgtggagaatataaaatagtaaataacaacaacacaaaattctctgacttcttagtgctttaaatggtttagaggaaattcactgtggctgggacgctgaggcctcccaccatgtgtggcctaaacttgacattttataaaggcaaactgcacagaggagagtaacaaataaccacacttaataaggaggcagtaactttcagctcttcgtgattctagccaagtccaaggccacagtgactggaaagacagcttgcagccagcctgacaagggagtcaagacaacaccctcctcctctgcaggtttctgtgttcgaatgtccctccctcaccgccttctggagagagaccttgtttctttgggatggttttggatgcagccttgcatcacctgagaagacacctggcctggagc

SEQ ID NO: 17289 - DNA, 501 bp, Homo sapiens
ttttgggacctcttggggcattttgaagtatttaactgtcttgaccagttggaagaagatacgtgggccataagcatcttctggacaggggaactgctttcagagagaaaacctttccaagagagttttgttttgttttggtttcgttttgtttgagatagggtcttgctctatcacctaggctggagtgcagcggcatgactgcagccttgaactcctgggcttaagtgaccctcccacctcagtctcctgagtagctaggactacaggcacacactactgtgcccagctaacttatttttattttttatggagatggggtcttgctttgttgcccaggctggtcgtgaactcctggcttcaagcagtcctcctgcctcagcctcctaaagtgctgagggctttaatggtttcacattgaagcctgaagttgctaagacttaggttgtttcttatatctggttttaagtagatgaaacaaccagaaacttttacttgtga

SEQ ID NO: 17290 - DNA, 559 bp, Homo sapiens
caagttatccaacaggttggactttgtaacatgatatccaaggaccaagttgcatatttaacatcgaatgaaaatgtagttgtacagttccaaaaataattaattttttaagggaatttttcaagacaaaaggcaaatattttgtttcaaacctacaagcaaattcattccaagaagtgaatatagtagtaaaacataaagactattgcaataaaaagtttccaggccagtgacttgtttaattacattcacatttttacattcactttgcctttcaaagcaggagtattttataaaactgaaataaaactttaaattgtcaagctggtgcttaaagttatgtaaaatctgatttaagtttatttcatttccaaggaaaggaccctgaaagaggggacagggagcttcctaggtctgttgataaactaactgatgctttgtcaaatcttccaagttttcactgtaaataatacaactaacaatgtaattttgctgttttctaatagagaatgaatgaatatattaatgtattacatttgtttcatgataaaacagtttt

SEQ ID NO: 17291 - DNA, 450 bp, Homo sapiens
aaattcatcactagtgttttgaaatcccaggatgtgttcctgagacagtcttcgttgttttattgtcctgggcattctgcgtcctttcagtctggagatttttagcttcctttgcttctgagtctctatttgcagtgccccgatgctagaaacctgagatcccatggcttctccagaatggaggcttgggcattgtcagcaccctccttccaagagttgaaagttcctctcttctgacttgtggaagaaagcaaactgatcccactcatttttgaagtaactctggaacatcaggagagcattctgggtaataccatgcaaagtgtgattgcattactcagcaatctagttgcctgcaaagattcgaatatgtaactactttatgaacaaggacttgtcagtcacatctgtaacctgctcactgaaactgccacactgtgcttggatgtg

SEQ ID NO: 17292 - DNA, 415 bp, Homo sapiens
aacaacactgccagtgcttgcaaacttagaggatttaaattcatcactagtgttttgaaatcccaggatgtgttcctgagacagtcttcgttgttttattgtcctgggcattctgcgtcctttcagtctggagatttttagcttcctttgcttctgagtctctatttgcagtgccccgatgctagaaacctgagatcccatggcttctccagaatggaggcttgggcattgtcagcaccctccttccaagagttgaaagttcctctcttctggaagacaaactgatgtgaggatgaggaggagtcagaaataaactcattcaactaatacttgagtagctactgttgcctacagtatgttcaaggttttgctagtcatccatatgatcactattgacagcttgggagactcacac

SEQ ID NO: 17293 - DNA, 471 bp, Homo sapiens
attcttataggcagttaaattaattgcagttcagtttcttcttttcaagcctttgttagggtaagtatagagtgagcttcaccccacagagagtttaacaccatttctaaggcatagctattgtgggatcactagaaaattctgtgagtgatcagctgggacactcaacactggctagttggacctcagatgcctcacaggcctgtgtggcactctgcttgacctcgtagagttttgctctaggcttacatgtcttaatatccagccacctctcaaggggctcctatgcagatttctggaattctgtttttacatatctgttagctctctggtactctgctctgcaacttcagccacttcagcctccctgaactccagcctctgtcttctcaactacatgaaaccaccatgctttgtttgggatcccctaccctgctctgaggtctgtgcctgcaggtagaaatctagaat

SEQ ID NO: 17294 - DNA, 403 bp, Homo sapiens
attttcctttttgtttttgttgttgatgtgaccgcgtgtccacaaccctgggattccctcgccctcagattccagaatccaatttcttggatttcagtgtttttaaggtcagtggaaacttttttaaaaagcaacattaagctaatatattcttactgcagaaaaggagctttgttctatttatctctaaaactgatgctcactagtagttctcagatttggaaaggtatttgtactatttatttataggagcatttatttataggaaatactggctgggcgtggtggctcgtgcctgtaatcccagcactttgggaggccaatgtgggcggatcagtttgagaccagcctggccagcatggcggaaccccgtctctactagaaatacagaaattggctgggc

SEQ ID NO: 17295 - DNA, 217 bp, Homo sapiens
agggacctggattcttagtatttcaggctgctgtcccttttttttttttcatttcctttttgtttttgtkgttgatgtgaccgcgtgtccacaaccctgggattccctcgccctcagattccagaatccaatttsttggatttmagtgttttwaagybgstcgggaggytgaggsaggagaatcgyttgaacstgggaggsggaggttgsagtgagc

SEQ ID NO: 17296 - DNA, 344 bp, Homo sapiens
ttctattattttggcttcttagaacaggctgccccttaatggttataagatggctgcagcacctccaggccttaagtctcaacattaagagtagcagatatagagaaatttcctcccaccaataagacactcctggcctgattcaaactagcctgggttgggtcctgtgcttattctagagctaatctcaatgaccagaacaatgggatatgctgatgactggacagtagcccacccctaaacctgagggtggggtcaacattacccaaaaacctatgagagtttgagatgaggtggttcacctgaagaatttggggttgcttttttttttttttttttttttt

SEQ ID NO: 17297 - DNA, 330 bp, Homo sapiens
ttctattattttggcttcttagaacaggctgccccttaatggttataagatggctgcagcacctccaggccttaagtctcaacattaagagtagcagatatagagaaatttcctcccaccaataagacactcctggcctgattcaaactagcctgggttgggtcctgtgcttattctagagctaatctcaatgaccagaacaatgggatatgctgatgactggacagtagcccacccctaaacctgagggtggggtcaacattacccaaaaacctatgagagtttgagatgaggtggttcacctgaagaatttggggttgcttttttttt

SEQ ID NO: 17298 - DNA, 488 bp, Homo sapiens
tataaaggcttgttttctacccctaataatttagtctctagttttgaatatgtttgggtaaaactcaagacaagactatttttgtgtgtgaaatctattaatacctagtgtttcgctagactgttctgtagcatagcaatcttttactgtaacagtaaccatcttttgccattaaatagaagacaaaattgcttcagtgagatttgttaaaatcacaaatgctccaaaattcttttggkgctttttagatctttaagagtgggagattggggatgttaatatttttgcttgcagtagtgtacattttgtaatatagaaatagtgaaaaaaattgttattaaagtctcttcagatatattcaattattaatcatgcaacaaacatttattgagtacctaccatatgtgaaacagagttcaaggtgctatcaatacagctagtcttccaaagctcgtgaccttcagatcttttggtttagatctgttatg

SEQ ID NO: 17299 - DNA, 438 bp, Homo sapiens
agttagaactgagactctggaactaatgtcacagcatggatataatgcctagaaagtttacaatgaaaatctagttcgtatgattgaamsactcacagaaagaacttcagaagactccagtgacccttcatgagaagaacatgtctgcggtascactggtccaaggagaatgaggaaatatgtagagcagctttgaacctaatcagcagtctgaagtcaagcccagtggattccagccaagcacagcagaaccacagccaatctatagaactatgagagaggaaataaatatttgtggctataagctattgagagtttaaacttgattgataggcagcaaaaactttcaaatcaattgttcttattaaacattttgcttttgttttgttttgtttttgagacggagtgtcactctcctccaggctggagtgcagtggg

SEQ ID NO: 17300 - DNA, 372 bp, Homo sapiens
wwttttttgtgttccggccgatcccacctctcctcgaccctggacgtctaccttccggagcccacatcttgcccactccgcgcgcgggctagcgcgggtttcagcgacgggagccctcaagggacatggcaactacagcggcgccggcgggcggcgccsagratggagctggcccggaatggggagggttcgaagaaaacatccaggctctagcttcgaggatatgggtgagctgcatcagcgcctgcgcgaggaagaagtagacgctgatgcagctratgcagctgctgctgaagaggaggatggagagttcctgggcatgaagggctttaagggacagctgagccggcaggtggcagatcagatgtggca

SEQ ID NO: 17301 - DNA, 130 bp, Homo sapiens
  misc_feature 124: n=a, g, c or t
ttttttgtgttccggccgatcccacctctcctcgaccctggacgtctaccttccggagcccacatcttgcccactccgcgcgcgggctagcgsggtttcagcgacgggagccctcaagggacantggcaa

SEQ ID NO: 17302 - DNA, 209 bp, Homo sapiens
attggccccatctgcaggtcctctttgacacctaccttactctctccctccactcacactctgagaactgtgctcaggggcagcgctacaacttccacattggtctttacagggcttgagtgattatttcaagaacagaacgctgtgtggaaacctttaccatatttcgttgtatctaagacacattttttttttttkgaaattwaaca

SEQ ID NO: 17303 - DNA, 235 bp, Homo sapiens
attggccccatctgcaggtcctctttgacacctaccttactctctccctccactcacactctgagaactgtgctcaggggcagcgctacaacttccacattggtctttacagggcttgagtgattatttcaagaacagaacgctgtgtggaaacctttaccatatttcgttgtatctaagacacattttttttttttkgaaattwaacaycycwaaggtkgggtwakgttyctyc

SEQ ID NO: 17304 - DNA, 348 bp, Homo sapiens
  misc_feature 328: n=a, g, c or t
acatttagaatacctctagagtttagagaataaaattctttagaatgcattgcttgtstttagctaaacacatttaacaaccacgacacaaacggggaggagtgaagaagggggacttgaaccaaaagacctttaaaaaaaaaaaagtctgcgagtcaaaaggtcattctccaagtttgtaaataaaattgcaaagggagtccttaagaaaggagaggaaagaaggggaagaaggttaggaagactcacaagttacataaaacagtgcattggaaaaacgacagggagattctgtaataaaaaaaaaagaagattcttaagaacccangagagagaaaaaaaacctgg

SEQ ID NO: 17305 - DNA, 456 bp, Homo sapiens
actttcttctcgtctgtcgccatgtgagatgtacctttcactttcctccatgattgtgaggcctccttagccacatggaactgtgtcagtgtttggtactttaccatggcacgtgtttacatacaaacgtgaccagagaactacaacaaatvgtttacaggaggtgaagattatagaggccctggcaatcactattccagtctctgcttctatgagtttgactatttcagattccacatgtagcaaactggggctacgtttctaagaattcccttcactgaagagttccaagttactggaagaaacttggaacaaaaggagttctgcatgaattttgaaaggcctactgactcaacaggcagtcagatatgtaagatgggtataaagcggtgagagtgaggacaaacccataatcaatgtctggatccctgatgaactgagactcacattgatctt

SEQ ID NO: 17306 - DNA, 442 bp, Homo sapiens
agtcaggctgcgtccccttcaaagaacgccaccgctgagaactgaccctcacatctcccttcctgaatttctttagggaaagcaacaaccatccctgtaagccatgggktttcakgcggagggaaggagagggctagttgtctgagagggtaactgcttaaggctgcagactaggaaatgggattccaggtttaagatagctcctttctggacctcagtccttcacctagtcacctagtcacagggtggattgcctctaaggatacttaggggaaaaggaaccaaatttgggatggttctccttgctttaagccttgataggagacggggaggccaacccttctctgcagaccgtgatcctcactagacagaggagctccaaacctgcccatctcatcccatgcaccgacggtsctggcctggctccaaactcccgaaagga

SEQ ID NO: 17307 - DNA, 499 bp, Homo sapiens
acatatagcatgggtttctgggtgccaatagggtgtcttaactgtttgtttctattacgttagtttcagaaagtgcctttctacaaggttttgaagttgttaatattttctgtagttccattggaagatcgttcgtcctgtcatttatctcattttaagataaagggacgacaaaactgcagtcacttttgaagtaaggaaaacatttaggggtgactttctgagcacatttagggtttcggtggaccgggtcttaaagaccctgaaagaaaacgctaataaagccaaaagcttactgctcactaccatacctcagatagggtccacagaatggtcagaaaccctccataacctgaagaatatggcccagttttctgttttattaccaagacattaaagtagcatggctgcccaggagaaaagaagacattctaattccagtcattttgggaattcctgcttaacttgaaaaaaatatgggaaaagacatgcagctttc

SEQ ID NO: 17308 - DNA, 137 bp, Homo sapiens
aacacgggaacacccacctttagagatgagacacaagcaggagaagagggattaaacctgctagttttggaaaaaaaaaaaaggammcgaaaagaaaagaaagaaagaaaaacaaaaaacaacaacaaacagaaaaa

SEQ ID NO: 17309 - DNA, 478 bp, Homo sapiens
gactgacggtaacggggcagagaggctgttcgcagagctgcggaagatgaagttgtggtatttgagaagaacactgagtcaccattgccacagactctgatatcggtactgctggtaggccatccatccaaatctagaaagtttctattgaatgccagaggacttggatctgagctaaaggacagtattccagttactgaactttcagcaagtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggaattcaaggcagtgcagcaggttcagcgtcttccatttctttcaagctcaaatctttcgctggatgttttgaggggtaatgatgcga

SEQ ID NO: 17310 - DNA, 124 bp, Homo sapiens
  misc_feature 67: n=a, g, c or t
gctcagatagtctctttctctgacactgtgtaagaagctgtgaatattcctaacttacccagatgtngcttttgaaaagttgaaatgtgtaattgttttggaataaagagggtaacaataggaa

SEQ ID NO: 17311 - DNA, 136 bp, Homo sapiens
gctcagatagtctctttctctgacactgtgtaagaagctgtgaatattcctaacttacccagatgttgcttttgaaaagttgaaatgtgtaattgttttggaataaagagggtaacaataggaaaaaaaaaaaaaw

SEQ ID NO: 17312 - DNA, 139 bp, Homo sapiens
gctcagatagtctctttctctgacactgtgtaagaagctgtgaatattcctaacttacccagatgttgcttttgaaaagttgaaatgtgtaattgttttggaataaagagggtaacaataggaaaaaaaaaaaamaaar

SEQ ID NO: 17313 - DNA, 181 bp, Homo sapiens
  misc_feature 140..141,181: n=a, g, c or t
gctcagatagtctctttctctgacactgtgtaagaagctgtgaatattcctaacttacccagatgttgcttttgaaaagttgaaatgtgtaatystyytggaataaagagggtaacaataggaaaaaaaaaaaaaaaaannaarraaaaaaaaaaaaaaaaaaaaaaaaaaaaaaaaaaan

SEQ ID NO: 17314 - DNA, 471 bp, Homo sapiens
atgcgctgttccccgtgaagaccacctctagatctgggagagcggttgctactcccaccctcctttctctctcagaacccaggtctttcccacaatgtagaccttccctgaccacagcaggacaagctattaataggataataacaacataacaaatactatttattgaagaagtactgcatactagaccctttacaaagcacgttccwtacagtattaggttatttatactgcacaccaatccttcaagatggttttttttctgtcagtttcacggatgaagcaggacgggacgcttcctgtcattttaccgtgacttgccccaggaggtcacacggtcaagtgaaagattcacacctatgtcggcctcctgacattcaaacctgctctgtcttaagaaccaagcttacttctccggatcagggaggaagggctagaaaggagatcaatggcagagagaggagtgggggt

SEQ ID NO: 17315 - DNA, 412 bp, Homo sapiens
  misc_feature 112: n=a, g, c or t
gacttggctggcgggatcaagtgcagctgcttcaggctgaggtggcagatagtgagcgctggtggcggagttaaagtcaaagcaggagagtaattatgaatagcgcaggtgnattctcacacctagaccgtcgcgagcgggttctcaagttaggggagagtttcgagaagcagccgcgctggscyttccacactgtgcgctatgacttcaaacctgcttctattgacacttcttctgaaggataccttgaggttggtgaaggtgaacaggtgaccataactctgccaaatatagaaggttcaactccaccagtaactgttttcaaaggttcaaaaaaaccttacttaaaagaatgcattttgattattamccatgatactggagaatgtcggctagaaaaactcagcagcaa

SEQ ID NO: 17316 - DNA, 520 bp, Homo sapiens
atatagactgcatagatctttggccattgagtgcattgagttttactgtgagtaagatggggagctattagaggattttggagcagaggagggaacgatttggctgacattttagcagaatgcctatgacagctgtgtggagaatcaactgcaaagtggaaagaatggaagctgagggaacagttgagaggctattttaggattcaggcaaagatagtgatggtttggagcagtgggagcattggtggtgataggtgttgggtttggaatattattccaaggtagagttgacagaatttgctgatgaaaattttgaagaatttaaggtaaagagaagaatgaaggatgattcttggtttttggcctgagcagcaaggtgaatagtaggatggaggaatggccatggaggaagatttgtgaaagaaaattgaagatttagttttagatataattttgaaacatttattttacactccaatgaatggtctagagttcagatgaggaaagagtcasggtggag

SEQ ID NO: 17317 - DNA, 492 bp, Homo sapiens
aacataggagttacaaatcccgaaaggtgcatcggttggtttcaaagacaggaaaagcagaggtgggaccaatacctgcgctccgttgaggtaaaatagataaagagtctgcagatgtatttttaaagttcaggatgcgtcaagtggcacgcagaagctttatcacgagttccctcgcccccaaactgaaagcaaatatgacatcgtatttcctctctgaagtaaatacgattcctctctgttctcagtaaaacatcccgaagtcggcaaaagttcaggctgcgttaagtggcacgcagaagctctattacgagttcctttactcccaaactgaaagcaaatatgacatcgtatttcctctctgaactgttctcagtaaaacatcccgaagtcggcaaaagttcaggctatgttaggtgacacgcagaggctctatcacgagtttctttactcccaaactgaaagcaaatgtgagatcctatttcctcgctg

SEQ ID NO: 17318 - DNA, 84 bp, Homo sapiens
ccataaaaggctaaatgtagagttcacttataaagtgaacaggtagatctaatcagtctagtaagtccaaaaaaaaaaaaaaaa

SEQ ID NO: 17319 - DNA, 526 bp, Homo sapiens
attaatagtcttctccacttgaacatgctgtctatgaagacaaaattgaataggaaagttctcactgagatgttcttccctgcttagaaacaatcctttctaatagttaaggaaatagcaaactgtagcctgtggaccaaatttacccactgccttttggataaagcccatgagctaagaatggtttttacattttttaatggttgaaaaaagacaactgagtatggtggttcatgcctgtaatcccagcactttgagaggctgaggcgagcagatcacttaagcccaggatttcaagattgcctgagcaacacagggagatcccatctgactaaaaattcaaaaattagctggtgtagtggtacacacctgtagtcccagctactcaagaggctgaggtgggggaatcacttgagcccagtaggtggaggttgcagtgagccaagattgtgccactacacttcagcctgggcaacaagagcaagactctatctccacacacacacacacaaaaaaaaaaaaaaaa

SEQ ID NO: 17320 - DNA, 250 bp, Homo sapiens
atcgcatcagtgaagggagagcaggtgcctgggatcgaaaggacattgtccatcacctggctctgaaaaacaaaatgcatttccttattcttaacaagctgagcaccagaaacctgctttaccagtccagggtgcctcctggaagctggctcgcttatctgcatgtatgtgagggctgggggtgtttttgtggggctggctccgggcagggtggctttggaaaggagaggcctgacctagcgagactcta

SEQ ID NO: 17321 - DNA, 490 bp, Homo sapiens
gactgtgtggaagcaccaggcatcagagatagagtcttccctggcattgcaggagagaatctgaagggatgatggatgcatcaaaaggagtatcactggtgcagtcgctagaaggctctctggcaacatttgctgaaattaaagatgcccatatcctgtgacacagcaattctgctttggaagatttctcttacaaatattgtcacacatgagtgcaaagatacatgtacaaggaagtacattgtagcatataagattttaaatggtctacatgtccatccagggggataatagctactaaaaagtaacaaggttgagaccagcctgggcaacataaggagaccccttcttcacaaaaaatgaaaaaattagctgggtgtggtgatgcatgcctgtggtgccagctactcgggaggatgaggtgggaggattgcttcagcccaggaggtcgaggctgcagtgagctgtgatcacgccattgcactccagc

SEQ ID NO: 17322 - DNA, 402 bp, Homo sapiens
accgactgtgtggaagcaccaggcatcagagatagagtcttccctggcattgcaggagagaatctgaagggatgatggatgcatcaaaagagttgaggtctcactttgttgcccagsctggcgtgttgtggctattcacagctgcaatcatagctcactgcagcctcaaactcctgggctcaagtgattctcccacctcagtctcccgagtaaccgggattacagagctgcaagttctccacattgacttcttgaatcaggacaacgccgtttctcaccacacatgggagttccaaacgagcagtcctgtgttccggcgaggacaggtgtttcacctgcggctggtgctgaaccagcccctacaatcctaccaccaactgaaactggaattcagcacagggc

SEQ ID NO: 17323 - DNA, 425 bp, Homo sapiens
caatacgagacgagattcgagtggggacacagagccagccatgtcagcaccttatgcgtactttatccacagcatcttcccaacaacctggagatggtatcacctccaggctgtggtgaagcaagtggtgaagggagtgaatctcagggaggtgaaaatgcccagtctctccagggcccttgcaagacgtgccaaaacttcatgctgtatggagctgcttttctgtctcatgcatcctgcccttgcaggggcgctcctggctgtccagggtcctgaccattccttgtctccaggctggttccagatgggatgagttgttaggactgacggattcttctgggaagcatttgtaagatttgggatctggccagagggggagatgtccaccttatcttatggtttgctcaggtcacagtggctgtcac

SEQ ID NO: 17324 - DNA, 498 bp, Homo sapiens
attgtgaacaagtagattgattgccttcatatacaagtatgttttagtattccttatttccttattatcagatgtattttttcttttaagtttcaatgttgttataattctcaaccagaaatttaatactttctaaaatattttttaaatttagcttgtgcttttgaattacaggagaagggaatcataatttaataaaacgcttactagaaagaccattacagatcccaaacacttgggtttggtgaccctgtctttcttatatgaccctacaataaacatttgaaggcagcataggatggcagacagtaggaacattgtttcacttggcggcatgtttttgaaacctgctttatagtaactgggtgattgccattgtggtagagcttccactgctgtttataatctgagagagttaatctcagaggatgcttttttccttttaatctgctatgaatcagtacccagatgtttaattactgtacttattaaatcatg

SEQ ID NO: 17325 - DNA, 517 bp, Homo sapiens
agagcaggagccctcggtggcagtgcttgggtgtcgaggctctgaggctccggcctcacctctccacggggtcgaagggaacgtctccggatgccaggagtcgcaaagggccgaccatgatgatgaaaccccaggcagagacgggggaagcagcacgggatcccagcctcaggcctgcacggacggtgttggttgggagacgaggtctcactatattgaccaggctggtcttgaactcctggccttaagcgatcctcctgccttggcctcccaaagtgctggagttacagatgtgagcctctgtgctcagtccatccttggctgttcaagtgtagaggtaagtagtagatgccaagtttacctccaggtaagaaggggcagatgtcccagggcagaatcataaccataatcaggcctcccactgcatgaagacattatgttctgaagcttaaacctggacaaaggtctgaccagtagcactgtgttcatgaatgtcaggtcaaaaatttaaaactgg

SEQ ID NO: 17326 - DNA, 396 bp, Homo sapiens
acacaataaagaaaatgtacaaaaggctatctttcagaaatgtaccaagtccagctgtttccgsarataattctacatatctttaaaaaacttatgaccccgggcgcggtggctcacgcctgtaatcccagcactttgggaagctgaggcggcagatcacgaggtcaggagatcgagaccatcctggctaacacggtgaaacccgtctctactgaaaatacaaaaaattagccgggcatggtggcgggcgcytgtagtcccaactactcaggaggctgaggcaggagaatggcgtgaacctgtgaggcggasttgcagtgagcgaagatcgcgccactgcactccagcctgggggacagagtgagactcggtctcaaaaaaaaaaaaaaggaaacc

SEQ ID NO: 17327 - DNA, 542 bp, Homo sapiens
ttttatattctggaagaaaagaactgtgaacaaattagaaccccggaacactctgacgtccatggacgcattccagaaaagtggcaagagatgagtctttcctcctccaggaagcattttggtagaatttccatagagcattgtctgtgagtgactgatcccaacatgtatgttactaagccccaaaacgaacttcaaactgggtgtggtggcacgtgcctttagtcccagctacccgggaggctgcggcaagaggattgcttgagcccaggagttcgagtccaacctgggcaaaagagtgagaccccatctctaaaaccaaaaaggtaccttagaaggtcacctggttggctaaccttttaaaggcaggggcgtgacacgtaggacacattgggaatgtcttggctactacatgtagccttctgggatatatgtgcccagagggagaagcactgagcctgaagaaactagatgagtctcagaaccacagaccggccagaaatctctcccaccattatatcagcgtgatacagatctacatt

SEQ ID NO: 17328 - DNA, 595 bp, Homo sapiens
taaacctggacttccaggtctttaagattatatgtttgtcaagctgatccagcttttcatttcgactttcatctagagttttttcactgaattgctgtgtcctatatatatgacagtggtgcaatcatggctcaccgcaacctcgaactcctgggctcaagtgatcctcctgcctcagcctcccaagtagctgggactacagagatcgctgtcctatgttacctgttttctcatgtctgaaaatcattgttttgtctacttttctagttgtttaaggacctctgggttgtttccagcatttgactgtcacgaataaaaaagttgctatacacatgtgagtacaggattctgcatggacataaattttcatttctctggagtaaatacgagtgcgatcgttggagcatatgatcattagaatgatacttatcccacaacagagcaaccaagatcattcacaccttaaaatattcccatcaatcttctgagttgtcatttgaagtgaaaaatatcccatttcttcttcaagtcttggaagagaatacagagatgaagtaacagtgggacattcaaatgggaatgtacacagactgtg

SEQ ID NO: 17329 - DNA, 541 bp, Homo sapiens
atgataatgtgggttatcctcctctccatgcacagtggaaagtcctgaactcctagctttccaggagacatatataggggaacatcaccctatatataatttgagtgtatatatatttatatatatgatgtggacatatgtatacttatcttgctccattgtcatgagtccatgagtctaagtatagccactgatggtgacaggtgtgagtctggctggaacactttcagtttcaggagtgcaagcagcactcaaacctggagctgaggaatctaattcagacagagactttaatcactgctgaagatgcccctgctccctctgggttccagcagaggtgattcttacatatgatccagttaacataatcactttttttgaggacattgaaagtgaaataatttgtgtctgtgtttaatattaccaactacattggaagcctgagcagggcgaggaccaataattttaattatttatatttcctgtattgctttagtatgctggcttgtacatagtaggcactaaatacatgtttgttggt

SEQ ID NO: 17330 - DNA, 1549 bp, Homo sapiens
acttaaagtcttagaatggaaaaagtaaagaaatatcaacttccaagttggcaagtaactcccaatgatttagtttttttccccccagtttgaattgggaagctgggggaagttaaatatgagccactgggtgtaccagtgcattaatttgggcaaggaaagtgtcataatttgatactgtatctgttttccttcaaagtatagagcttttggggaaggaaagtattgaactgggggttggtctggcctactgggctgacattaactacaattatgggaaatgcaaaagttgtttggatatggtagtgtgtggttctcttttggaatttttttcaggtgatttaataataatttaaaactactatagaaactgcagagcaaaggaagtggcttaatgatcctgaagggatttcttctgatggtagcttttgtattatcaagtaagattctattttcagttgtgtgtaagcaagtttttttttagtgtaggagaaatacttttccattgtttaactgcaaaacaagatgttaaggtatgcttcaaaaattttgtaaattgtttattttaaacttatctgtttgtaaattgtaactgattaagaattgtgatagttcagcttgaatgtctcttagagggtgggcttttgttgatgagggagggraaactttttttttttctatagacttttttcagataacatcttctgagtcataaccagcctggcagtatgatggcctagatgcagagaaaacagctccttggtgaattgataagtaaaggcagaaaagattatatgtcatacctccattggggaataagcataaccctgagattcttactactgatgagaacattatctgcatatgccaaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcraaaagaaatgaaaatgttacactacattaatcctggaataaaagaagccgaaataaatgagagatgagttgggatcaagtggattgaggaggctgtgctgtgtgccaatgtttcgtttgcctcagacaggtatctcttcgttatcagaagagttgcttcatttcatctgggagcagaaaacagcaggcagctgttaacagataagtttaacttgcatctgcagtattgatgttagggataagtgcttatttttaagagctgtggagttcttaaatatcaaccatggcactttctcctgaccccttccctargggatttcaggattgargaaaatttttyccatcgagcctttttaaaaatgtaggacttgttcctgwgggcttcaagtgatgggatagtacacttcactcagaggcatttgcatctttaaataatttcttaaaagcctctaaagtgatcagtgccttgatgccaactaargaaatttgktttagcattgaatctctgaag

SEQ ID NO: 17331 - DNA, 346 bp, Homo sapiens
attttggtgggcacttcctgggtgcctgctctgggtcaggcctgtggggtgaccactgagggcaggaaacctggcctgtccctccaggaagcgaagtcaacactggcacctgcagatgaagtggcagagcagcccccagctttgatggcatggggtggttggggggcacattctgcatgctcagaagagagagcaactcgccctgtggaaggagcatacagtgggagatggggacaggcccagtgacgagcaccatccggaagtgaaggctgatgggtacgtggacaacctcgcagagcagtggacctgctgctgcagcacgccgacaagtgatggcctcctggga

SEQ ID NO: 17332 - DNA, 492 bp, Homo sapiens
atggctaccgagcccgaagccgcggascggtggtgccttcgctcgtggatcgatacttcactcgctggtacaaaccggatgtcaaaggaaaattttgtgaggaccactgtatactacagcactctaaccgaatatgtgtcatcacattggcagaatctcatccagttcttcaaagtggaaaaacaattaaaagcatttcctatcagatcagtaccaactgtagcagacttcagaacaaggtctctgagaaatttaagcggggggcacagtttctaacagagcttgcacctctctgtaagatttacwgctcagatggtgaagaatatactgtgtctagttgtgttagaggacgtttgatggaagtgaatgaaaacatcctccataagccatctattcttcaagaaaagccatctactgaaggctacattgcagttgtgttacccaaatttgaagaaagtaaaagcataacagaagggttactgacacaaaaac

SEQ ID NO: 17333 - DNA, 447 bp, Homo sapiens
aagaattatggcgacctccgcgacgtcgccgcacgcgcctggttttccagctgagggtagatgcggttactatgtggaaaagaagaaacggttctgcaggatggtggtggccgcaggaaaagattttgtggtgaacacgctggagccatggaggtgtggtatcgccctactctctcaagagtcggaaataagtatcctggtcctgtcggtgctggaacccggcccctcccctctttgacagctttctgcttgtgtcccctggattctccagctttcactttaataaacccagttttgccctccttgcggaggattatgagttctagtgatgagaaattttttatttttctaagtaaagcgccasmrktgacccatttattttgatctatttatctcgatcttaactcatggtaatgctaggttttaatttttaccccaagctaccgc

SEQ ID NO: 17334 - DNA, 499 bp, Homo sapiens
gatttaatccttacaacaacactttgtggaggatttagattttagaggtcctaattcagtctggactctggtttcatacaatagaatctggcagtggtaaacytaaccatatggggaatggatcagaagagtatgaagtaacccagcaaaaggctggcatcttgcaaaggtggatggagccaagactcttctgagatttcataagtggctttgctgcctgaaacaaagaatagccaaatgaagggatgagcagttttccagcaatgatttgtccaagtaaaatcatggtaccatccaacattgcgagacatctgcagggtgagagctacagcaacgcctctgacaaatggaatgctgaacttgagacatgatttatgcaactatttctcacctctttattccacattccaatcttaggataacatttaaaatcttaatgttgttttcaggaatagccaataaaataaatcggctctgcttttgtcaaaaaaaaaaaaaa

SEQ ID NO: 17335 - DNA, 437 bp, Homo sapiens
aagaggggagcagccagcagtcttatgctaccactgtggctcatcctgcgacctgagagaaacctgggcaactgtgagcaccagaggccaagtcctggacagtctttaggttcttcgtagactctggaatggagctggaagctgtcatcctcagcacactaacgcaggaacagaaaaccaagcactgcatgttcccacttataagtgagagctgaacgagcagaacacatggacatatgaaggggaacaacacactctggggcctgtgaggtgcagggagagcatcaagaagaacagctaatgggtgctgggcttaatacctgggtgatgggttgatctgtgcggcaaaccaccatggcacacatttacctatgtaacaaaccttgacatcctgcacatgtaccccggaacttaaaaataaaagttgacaaaaagaa

SEQ ID NO: 17336 - DNA, 411 bp, Homo sapiens
aaagttcagatgaggtcatagtggagtagggyssgcctctaatccaacaagactggtgtccttaaaagaagagggaaatatggacacagacatagacacagaggaagatgatgtgaagacacacagggaaaacatcatgtaaagacagtcttggagtggtgcacctacaagatgaggaacatctgaagctgccagaagttgtgagagaggcatggagtaattcctttcctagcaccttcagagggagcacggccctgcctatactgataacgatggttcaacttacaatttttcaactatacaatgctttaaaagcaattcagtagaaactatacttcaagtaacgatgcaactattcaatttttcactttcggtacagtattcaataaattacacaagatattgaaaaam

SEQ ID NO: 17337 - DNA, 447 bp, Homo sapiens
agacaccaagtggcttcagcatgagtcagcggcaaacaccctcaagtcatgagctggaacgctcagaaacgatatgtaccttcaatcaaattacakaattaactaggggaaaatgaggaagaactttaggtacagacagcgagagatcttcaaaatactattaaaagaagaaagcactctcggtgtaaaaaagaagccgaggcgagcagatcacttgacttcaggagttcaagaccagcccagccaaaatggtraaatccacctccactaaaaatacaaaaattagccaggcatggtggtgggtgcctgtaatcccagctacttgggaggctgatgcagaagaattacgtgaacctrgaaggcggaggctgcagtgagccaagatggtgccactacactccagcctgaatgacagaggaagactccgtcccaaaaaaaaaaaaaaaa

SEQ ID NO: 17338 - DNA, 169 bp, Homo sapiens
aatttcaagacctgagtgttcagtaaccttaccattatgcttctgttttctttttttttggactcagacagcaaagctccctttggatgacatagatttattacttagtagtatattatgtattggctgtcccacattttgaaatttaatggactcgtggtgatcagaa

SEQ ID NO: 17339 - DNA, 481 bp, Homo sapiens
agtgcagcctgtccttaggcgtagggtaatggtgggcgacctggcagttcttgggctccttgggatcccctcgagaagcccccttgttagkgtatgarrccgtcagttcactgccagtaatgaaaacatcgtgtccttagtcacctgccattagccttttcgaaaccattttttctgttccctaagctgtcacaaatcctcctctgcatcccaggagtgccgcttggtcctcgggctcgcagcgtggcccacacctgggtcgggcctctcacggggacgctcccgccactgtgataaagaggagaaaacgtcacaggggaagggcctgaccctgctgcatccattttttagatagtactgcacgactactcgcttctgaaactgtcataagaaactgcctcagctccctgcagggtggacacacaagagcagaatctccgtgggacatctctttggagcatcaatattactacagtatttg

SEQ ID NO: 17340 - DNA, 536 bp, Homo sapiens
aacgtcctatctctactccgggtctgaccgttcagggtcttaagacattttcagtgctagcccgtgcgtctttgtttccccatctttctttagttcccttgtaagcctttgtgatcacttcaaatcctttttagaaatagcttccagatgaagaagtgaagctgcctggcgcatagatgtgttcaagtctcccttcttttcgctcaaggagagtgaagagtggatggtgccaattctagctgggaggagtgaaggacggggagggggacgatgaggcaggaggagaccacgccgccctcctgggagggggctgaytcgacccagctggttcgggtgtgcaccatcctcactctctccgcccttccagggctgcactgcgccccgctctcggcaagacacgggtgaggctcgggagatttaattcccctgctcaggtcagtgtagggcctcagggaagttcaaagctcgcccactagagggcattggcgcgtttcccagaagacacggccccgggagctttcgggctctccagcagc

SEQ ID NO: 17341 - DNA, 443 bp, Homo sapiens
ttttctcttgtcttgtgttcctttctgctttatttccctgctgtgtcctgtccttagcagctcaaccccatcctttgccagctcctcctatcccgtgggcactggccaagctttagggaggctcctggtctgggaagtaaagagtaaacctggggcagtgggtcaggccagtagttacactcttaggtcactgtagtctgtgtaccttcactgcatccttgccccattcagcccggcctttcatgatgcaggagagcagggatcccgcagtacatggcgccasactggagttggtgagcatgtgctctctcttgagattaggagcttccttactgctcctctgggtgatccaagtgtagtgggaccccctactagggttaggaagtggacactaacatctgtgcaggtgttgacttgaaaaataaagtgttgattggctagaa

SEQ ID NO: 17342 - DNA, 392 bp, Homo sapiens
  misc_feature 362: n=a, g, c or t
ccgttcaggaccccggcgcgggcagggcgcccacgagctggctggctgcttgcacccacatccttctttctctgggacctggggtcgcggttacttgggctggccggcgaacccttgagtggtcggggagcgggcctcgcgcgcctggagggccctgtggaacgaagagaggcacacagcatggcagaaaaccgagagccccgcgtgctgtggaggctgaactggatccagtggaatacacccttaggaaaaggcttcccagccgcctgccccggagacccaatgacatttatgtcaacatgaagacggactttaaggcccagctggcccgctgccagaagctgctggacggaggggcccgnggtcagaacgsgtgctctgagatctacatt

SEQ ID NO: 17343 - DNA, 301 bp, Homo sapiens
agattcatgtgtttgtggccacaggaacaactccatgttttctaaaaggcctacagaacatatatagggtgcctctgctctttccttttgcattcgttattttggtgaattactggaagatggcagttccggccaagcaggctagaatgttatttccttctgattactaaaatgcccatggcttctataccttccaaatcttctaatctccctgagcagtgcctattgattcaggtggtggtcactgaatgaaacaagatacaagcgaaaaaggaatatagagcataggtttgtgagtgag

SEQ ID NO: 17344 - DNA, 249 bp, Homo sapiens
agattcatgtgtttgtggccacaggaacaactccatgttttctaaaaggcctacagaacatatatagggtgcctctgctctttccttttgcattcgttattttggtgaattactggaagatggcagttccggccaagcaggctagaatgttatttccttctgattactaaaatgcccatggcttctataccttccaaatcttctaatctccctgagcagtgcctattgattcaggtggtggtcactgaa

SEQ ID NO: 17345 - DNA, 435 bp, Homo sapiens
atcatcatggactgtataatgcaatcagattattttgtttctagacatccttgaattacaccaaagaacatgaaatttagttgtggttaaattatttatttatttcatgcattcattttatttcccttaaggtctggatgagacttctttggggagcctctaaaaaaatttttcactgggggccacgtgggtcattagaagccagagctctcctccaggctccttcccagtgcctagaggtgctataggaaacatagatccagccaggggcttccctaaagcagtgcagcaccggcccagggcatcactagacaggccctaattaagttttttttaaaaagcctgtgtatttattttagaatcatgtttttctgtatattaacttgggggatatcgttaatatttaggatataagatttgaggtcagccatcttc

SEQ ID NO: 17346 - DNA, 417 bp, Homo sapiens
taattcatgtcaacttgtggcattttctctaactcgctcaagtacaacatttggaggcccgagtgagaaacaccaccaggcgagatccgggctcgctccgggctcccccggaaggacggccggcttgtaggtggggtgtcacctaaaaaaaaattttcaggtccccgaaaggtgaccgtcttccagaggagagcggatcgactaccgtgtgggtgcccataaaaattccacctctgagtcctcgacttctgaccccgaggtcaggtaggtcagatttgacttcagttcttgtaagagggaagcggccctgatgagggtgtccctctcttgactctgcccgtttctctaggaagctggaaggtagagccctggttttctgttaggcacttctgtgtctctttctaggagggaagtagc

SEQ ID NO: 17347 - DNA, 470 bp, Homo sapiens
aaacaaggaaggagtaggtcgggaagttctagtagtggtagttccagtagcaatagcagaactagtagtactagtagtactgtctctagctcttcatacagttctagctcaggtagtagtcgtacttcttctcggtcttcttctcctaaaaggaaaaagagacacagtaggagtagatctccaacaatcaaagctagacgtagcaggagtagaagctattctcgcagaattaaaatagagagcaatagggctagggtaaagattagagatagaaggagatctaatagaaatagcattgaaagagaaagacgacgaaatcggagtccttcccgagagagacgtagaagtagaagtcgctcaagggatagacgaaccaatcgtgccagtcgcagtaggagtcgagataggcgtaaaattgatgatcaacgtggaaatcttagtgggaacagtcatagcataaaggtgaggct

SEQ ID NO: 17348 - DNA, 672 bp, Homo sapiens
tttatgttctgagcaggaagggtaaaagacaggaacctgcttcactgtattaactagtccatgggctgagaccggggcatctcttttcttcatactgcaatgttgctagatacatgatcagacaccagagggttgggcattcttgcaataccttaacagtgctgaaatctgcagcatggtactaaggaagttaaagtttgaatgtaaccactttatttaaaaggtttttttctttaatttaaatgaaatgggttgaagtgaacatgattttgttgaccatgttcgtgaattacagatgcaacatgcattggtagaatcgtgtgatggtcttttgtgatacttaatttttacatatcccagtctctgtatgtatctgcatagacaaagaaaaaacaaactcctgctttgcttttattgaagggtttccaggactgcgtgtctgctcctgagctctgttttaagtatgtgtatcctttgcttgtattttgtattaaaaaaataagaaaaagaagcctttattgttgagcatgttggcattgtcccctttatttttttctctttttgggacatatgaagcaagttattctttttctgtatctttttttcttttgtaaactttttttttggttttgtttaaaaatggctttataaaagggcttttataacccaaaa

SEQ ID NO: 17349 - DNA, 543 bp, Homo sapiens
aattccggccggacgtggcgcacaggaagttacgcacgggaggcggtacctggttgtggagggtgacgccatgggtggggcggasgtctgggatgcgctgggagcctaggatccccgacagttttgcagaacactgaaatctatggactctaaaatggacttcatttaaagaaacccacggaccattaatggacaaaaacatgagtcaatatgtattgtggcattcaaatcctagcactctgggagagcatcaagtaccacgtttttgaagaccatggcctatcatcattatgcattcaagatttgagtttgaataacctcatcaagacttagatcttcttcagaagcttcaagtctcatctgcattaaagctctccattgaaccctctcacaaaagtacaagcttaaaggggctaaaatccattaatacattccattttatatcccttcctctgacttctcttcaatttccttggcctctagggtccttcatattgcttacgttcctttagactagagccaaggagacagtgctttccgaaa

SEQ ID NO: 17350 - DNA, 257 bp, Homo sapiens
acgattctccaacatggcggcggcggccctgcggagtggctggtgccgctgtccacggagatgcctcggcagtggaatccaatttctttccagccacaacctaccccatgggtcgacctatcagatgcgccggccgggcggagagctgccactgtccaaatcatattcttctggaaacagaaaaggctttctgtccggcttgctagataatgtcaaacaagaattagccaagatttttgtatccagcaagactaagc

SEQ ID NO: 17351 - DNA, 248 bp, Homo sapiens
acgattctccaacatggcggcggcggccctgcggagtggctggtgccgctgtccacggagatgcctcggcagtggaatccaatttctttccagccacaacctaccccatgggtcgacctatcagatgcgccggccgggcggagagctgccactgtccaaatcatattcttctggaaacagaaaaggctttctgtccggcttgctagataatgtcaaacaagaattagccaaaaaaaaaaaaaaaaagg

SEQ ID NO: 17352 - DNA, 476 bp, Homo sapiens
gaaatacaattttatgaaattcagttagaactatatgaagttaaatttgagatattaaaaaacaaagaaatactgcttactacacagttggactctcttgaaagacttataaaaggtaaagtttttatttaagtatatagattacaatgtttataaatttaaggaaatacagaccatattatcaattactttttgtaaactgtaacatctgaaaatttcctaaagttttccttcagtggtttattattcaaataatatattcattgttagcacatagcaaaacaaagaaagaaaaatgattattaccccaatcccatcatctagagatgctcaatggttggctgggcacagtggctcaggcctgtaatcccagcactttgggaggctgaggcgggcagatcacttgaggtcaggagttccagaccagtctgaccaacatggtgaaacccgtctctactaaaaatacaaaaatacta

SEQ ID NO: 17353 - DNA, 414 bp, Homo sapiens
  misc_feature 326,334,340,344: n=a, g, c or t
acttggatgaacatctgaggtgaaaatttcctctcgattatagaagagctgaagaacgaatgcctcggggattttgagaggcaaaagaaaaaaatgcgattcaacagtaaacatctctgtaatattgttaaaaaccagttgttattatacttgggatttttaataaagcaaattaggtggggatcatatttcaggggagagaaaattgctgtcacagaaatttttactgctgttgtcttagacacgctgaagagccttaagtcctggggagaagagcaaagttcttagaaggaaataatgttcttcagctgtttaaatcctccctngaaccatngaaatngatngcatctggatatcagcaaaggcacaatacacagaattttacagtattcggatgcagtcatgtttcgtttt

SEQ ID NO: 17354 - DNA, 502 bp, Homo sapiens
caaaatcatcgaaactgatgatatttcattaggtcatctaaaatttaccccaaccccattaaatctccactcctaaatctaatgcagacctgccatacttaaaagttgccttagaggaggtttcttactaaggccacagtgacaatacagttgctaattattagcatgatgactatatatattttcatttttacaaaacatttacatatggactcccaattcattttgtcttagatttatcctgttttatggggatcttaagtgatttgcttccacaatcatgtcccgcacaaatcgctgatagattagtgcacacacgaaaatttttgggtctaatttgaaatcatggttttgcttatcaaaacatctagtagacagaatagttgctcagcgtaccgagaatccagagtaaatgcctctgtcggcagtctgtttttgctgtgatactcaatggtgtgtttggattatagctgaccatattgtgttgtaactgtgtaggccc

SEQ ID NO: 17355 - DNA, 402 bp, Homo sapiens
gtgatagaagcatccccccagtttgtcctttatcaactaggattttcatatatgaggcttgctgaaaaaaggcagcgttgtccaggtttcctcacttggctcccaattcacccataagaaagaatgttcttgtaaaagatcatgtggttcatgatgcatttgtgcttactttaaaaaacaaagttggtcagatatccttaggaatctcttgtgattaaaattcctgggttgaaactctagaagagatttctcaaactttgaagcaattgtttagttaatatggacctgagagattctatgccttttaccaaaaaaaatatatcttctaggattactttgcagatgggacataggtaaaaaagcatggcctgaagtgaggagaagatgtgatgaatgacaaag

SEQ ID NO: 17356 - DNA, 507 bp, Homo sapiens
aagtaggaagtggtgagttcggagtagagatggccgcgcttgcaccgctgcccccgctccccgcacagttcaagagcatacagcatcatctgaggacggctcaggagcatgacagcgagaccctgtggtggcttattactgtcgtttatacgcaatgcagactggaatgaagatcgatagtaaaactcctgaatgtcgcaaatttttatcaaagttaatggatcagttagaagctctaaagaagcagttgggtgataatgaagctattactcaagaaatagtgggctgtgccatttggagaattatgctttgaaaatgtttttgtatgcagacaatgaagatcgtgctggacgatttcacaaaaacatgatcaagtccttctatactgcaagtcttttgatagatgtcataacagtatttggagaactcactgatgaaaatgtgaaacacaggaagtatgccagatggaaggcaacatacatccataattgtttaaagaatggggaa

SEQ ID NO: 17357 - DNA, 291 bp, Homo sapiens
tacttccaatattttgagcatgttcctgttttgttaaacattttaaaatttgattttttcatggctccccakatrkgsttgcacttaccattgattgagatgcaaatcagggcttggcaaactgtttggcctgtgggccagatccagccgtcagctgctaagaatgatccsttaacgtttttaaaggattggaaggaaaaggaaggattatgtgatggaaactgtatatagcttctcaaagcctggtatttgctatccggccatttacagaaaaagttttgacttctccga

SEQ ID NO: 17358 - DNA, 503 bp, Homo sapiens
ctcaccataaccccctctcagtgtttccccaacttctcccttttagcagggtccctttagagcccaactccaggtcaaatctggagctcaaatcccagtgctccctccccaggagtggggccccaactcttccaagataccagcattcctcaagtcctcccaaaacttcctacccacaccctcttcccaaggccctcaggggcagaaaacatctccttcaacccgtccccactccttcctctgcatgaccttgggcaaacccttgccctttcaagccatcagctcctgcctctctgccatgagggctttggatcagattcctcttctcgccaggatgaggacacgcactgccctccatagacacagatgaaggggtgggggtcattcagctcgaatgggtcccagatgctcacttggcctttccctgcaggatgagtgaagacgtttgcctctcacagtgtgtcttctacctgcattttggcatcagagcccccagcccaccc

SEQ ID NO: 17359 - DNA, 482 bp, Homo sapiens
aaaaaggttgtttctcagacctacaccttgttttgcgtttgagtcctaaacgggtagcaaggtttatatttagcactaagccgtgaatagtagagcttaaagtatcaagaagagcggttcaactctggtggaagtggaggtgttctgctttcgatgggtgacaaggagaagagcagtacaggccatagatacatggacactagccatttgaggttacagtctagaactggataaccctgcaagaactaatgataacagagtcagaaatatctacttcaaaaacctaattttttttaaaaaaaaattcttatttccctctttttctttcatagtatttttaaattattttaagactttaaccttctttggctgtgcaagaaggaaaaaacaaatagtttatgtttgggatagaatttttgaagaacaatgaggaatgcacccctgggaactggcattgatagtcaaagtaatttatgtgatgt

SEQ ID NO: 17360 - DNA, 483 bp, Homo sapiens
ataaatattttaggctttgcagtgttgttactacttaactctgcctttgtaacatgaaagcagctgtaggcaatatgtaatgaataggtatggctatgttccaataaaactttatttacaaaaacatgcaaaggcctcagttaggccctggagcagtacattgttgatctttgttttaatgttttaaatttttaattctcatggcctgtgaagtggctcatgcctgtaatcccagcactttgggagactgaagtaggaggaatgattgaggccaggagttcgaggccagcctgggcaacatggcaacaccctgtctacaaaaaattagctggatgtggtggcacgtgcttgtgattccagctgctctggaggctgaggtgagaggatcgcttgggcccaggaggttgaggctgcagtgagctatgatcacgccattgctctccagcctcagcaacagactttgtctcaaaaaaaaaaaaaaaa

SEQ ID NO: 17361 - DNA, 468 bp, Homo sapiens
cccttctttccgtcttttggaaatgaaaccctcttgccctgagctgcccatcccagcaccccctaaccacccatccagagaacacagctctggctgatcgtcgtgcctggtgacttcctcagggcggggcaatgacccaagcaggaccagtggaaatcaaccgggataattgaggcgaaaacgccaagaatgagagtctctcctttggattgcaataattaaggataggcagttggtatgccctccccggcgtttccttccgccaccggaaggaagctcatgcgagaaggaagcctccagcctggaataggggacggagctggagccacacgcgcasttgggtgagccacgcacccctcaggaccaccaagaactgcccagccaagtgagccaaaaaacaaatcacaaccacagacctctcactgaccgagctgaccctgagtttctctaatcttttaatgcagagag

SEQ ID NO: 17362 - DNA, 328 bp, Homo sapiens
  misc_feature 244..245: n=a, g, c or t
gaataatacagttagtatgttaaaaattaattaaaagaatggtcatcacaactttgaattccatggtacactttccacaaatgcttctgtttgtaccatgttgattagtaatgtgaccctttctttcccatgtttagtgatttagaatctagaagagaagtaaaaaaagaagaaggtgaagcttttgcacgagaacatggactcatcttcatggaaacgtctgctaagactgcttccaatgtannagaggcatttattaatacagcaaaagrratttatgraaaaattcmagaaggagtctttgasattaataatgaggcacaatggs

SEQ ID NO: 17363 - DNA, 535 bp, Homo sapiens
tttaacatctatttaggttaatgttcactttacaaaggtgatgggggatattttgttaggtgatagcagatgcttttcatttttaaacatagaattaaaattggatttgcttctctttaatacttcaacatattgaatttccctaggaaagtgactagctataatgaaaattcaagcgaaaagggaaaaagattgtaaatgcagatgaaataacttcatttttaagtacaaataatagtaggattggtgtatgtaggtttaaaattatagtgatgactagtcgaacttaatatacaatcagttcttgcaaatactttacacttagctgccattacacaacaaattggaattttccagctgttcaactatcatggactctgtacaggatagatgtgtataatggaaaatatgtactgcttctttctttgattgccactcaagatggaaacaccatgccaaggcattttggttatacacagatcattctaaacctgttattttggagaggtgtattggtttctttctcatttataag

SEQ ID NO: 17364 - DNA, 416 bp, Homo sapiens
gatttatttttcaatctaaagtttttcacctctctctagtaagacatctgaaactcataagccatctttaagaatttcttacaaaaacatgctggaagacagtggatcttgtttgtatcctgaagatttttttctcttcgttattttaaattaattgtcaacagatgtgcmactgktwaggttggttcttaagtcactcggagaagagagagatgcatctactcaaggttggcacttggagaaacaacactgcctcttcctggcttatgaagttcagtgttctttggcttgttagtcagaactgttgcagagcaagtgttgtttggatggcttatatgaacatatcatttcatgttgggaatcatgtgttgtcagagttgggagagactggagtctttggaagaagctccactttg

SEQ ID NO: 17365 - DNA, 472 bp, Homo sapiens
ctctctctttcctgctccgccgcggtgagacgtacttgcttctcctcaccttctaccgtgattaagatgcttgcttctcctttgccttctgccatgattgtaattttcctgaggcttccccagccatgtggaactgaaaatcactatctgaaattctccattgcttctttctaaaataaaataattttatcattttgctaaaaagatgtaatacaagctgtagagcttcaattagcccttagaaagcatggctattttcatgaagtgtgaatgttctctgagaatggaaattttaagaacaggaacttaactgaaagttaagattataaaagggaaacaagaatgaaagaggaacatcaaaccacagttcattaagtgtcttcaagatgttacctacttcgtatagacttagcactccaggtggagcatggcaaaggaagattcaattcccaggctgctctccctgtggttt

SEQ ID NO: 17366 - DNA, 87 bp, Homo sapiens
aycggcatcgkctgasactgctgcstccagctagttatttcgtcstcttcctttcttcasccctacaccttggaggtgaacttctca

SEQ ID NO: 17367 - DNA, 437 bp, Homo sapiens
tatttgtactgttggggctcagaaagcgataccccaaagactggcgctttgacatgctgagaggccttcgaagctgcctcagaatcaaggtccctctaaccttctctcccaagtatagggaggcactctctctagaatttcctaatctgatcgagaaaacgtctttccaaaagaaacaaaattgccttcctcccctctccgaaatctcatctagctcagaaaagaagactgaggaaggcaactacgcctggatggatttttcacaagatgatgcctgtttctcgggctcattcaaattctaaagagaatcatttacaagttaatttctgtccattttttcgccctaagaatcacttgctgccctcagaagaattgtctatattctccatctctccmcttcccctatgaaaaagagtgtatacgcttctgtaccccat

SEQ ID NO: 17368 - DNA, 460 bp, Homo sapiens
agttagttgtacgttcgaaacctgtcgycgtcacttgcgcgtttggcattatccattgtcaccgcggaggaacgagcgctcgagatatcatcagtgcccgcaaatctccgcgccaaggcgctgagctactcctttccgaggtgcgcctctggtcctccgtccctggtgcccagcagcggcgaggcggcmtctccgctcccgccgccgtgtccaccgagccctgggatcagggtggcagttctcaacgatgggcaggagggacctcggcggcgacccctaaaacaataccatgccccgggatccccgctgctgccgcgccastcttccctttccacctccctgaccctgtcggattcggatgagcccattgcaaggagaagacgcagccgtcaggcagtattcaggcacacggttcaataacgggaaagaatgtcgtcacatgattgcatcatgttcttca

SEQ ID NO: 17369 - DNA, 591 bp, Homo sapiens
taatttccttaatttgtaaatttagtgaccattagctagtgatcatttaatggacagtgattctaacagtataaagttcacaatattctatgtccctagcctgtcatttttcagctgcatgtaaaaggaggtaggatgaattgatcattataaagatttaactrttttatgctgaagtgaccatattttcaaggggtgaaacatctcgcacacagcaatgaaggtagtcatccatagacttgaaatgagaccacatatggggatgagatccttctagttagcctagtactgctgtactggcctgtatgtacatggggtccttcaactgaggccttgcaagtcaagctggctgtgcatgtttgtagatggggcagaggaatctagaacaatgggaaacttagctatttatattaggtacagctattaaaacaaggtaggaatgaggctagacctttaacttccctaaggcatacttttctagctaccttctgccctgtgtctggcacctacatccttgatgattgttctcttacccattctggaatttttttttttttaaataaatacagaaagcaaaaaaaaaaaaaaaaa

SEQ ID NO: 17370 - DNA, 443 bp, Homo sapiens
agttgtacgttcgaaacctgtcgccgtcacttgcgcgtttggcattatccattgtcaccgcggaggaacgagcgctcgagatatcatcagtgcccgcaaatctccgcgccaaggcgctgagctactcctttccgaggtgcgcctctggtcctccgtccctggtgcccagcagcggcgaggcggcatctccgctcccgccgccgtgtccaccgagccctgggatcagggtggcagttctcaacgatgggcaggagggacctcggcggcgacccctaaaacaataccatgccccgggatccccgctgctgccgcgccastcttccctttccacctccctgaccctgtcggattcggatgagcccattgcaaggagaagacgcagccgtcagagcgcctgcgaggtggctaaggcttggagagcatacgaggcggaatccggatcg

SEQ ID NO: 17371 - DNA, 250 bp, Homo sapiens
gataaattatgataatatatgaggaggcctcgctatagcaaaaatagttaaaatgctgacataacgccaaacacagaatcagcaaagaggaggccatgcgctggttccagcagaagtatgatgggatcatccttcctggcaaataaattcccgtttctatccaaaagagcaataaaaagttttcagtgaaaaaaaaaaaaaaaaaaaaaaaaaaaaawwwaaaaaaaaaaaaaaaaaaaaaaaaaargct

SEQ ID NO: 17372 - DNA, 50 bp, Homo sapiens
ctcttcctgytstscatsatggcggatcaaggtgaaaaggwgwaccccat

SEQ ID NO: 17373 - DNA, 502 bp, Homo sapiens
gaatcttccttagccaccttccagtagtttggtgtgcttatttctatcctaacaatcaatttgggggtatcttttaaaattgcagaaattgtatggaattagaggaaacaaagccacgttcaaattcttataaaaattttaaagtgagtggcttaatttcatctgtaaagtggggacaccatctaccatgtagttattagatgtgaataccagagaaaatacatgtagaaagtgctagtgcctgccacatactatgtgctcaataaaactcagtgttttatatgcctatctccaataaatggcagaaaagactaacctgtctcagagtkcctggctcatagcaagtaccatgttcatgtttcaaaaaacagatgaaagacaacaagaaagtcacattctaaagcttttcaagaaataaagaagtacaaacaaagtttcttcatcattctatttattacatgtatgaatattaacatctcatggtgtccatctaagtcaaaac

SEQ ID NO: 17374 - DNA, 479 bp, Homo sapiens
agctccctgcgagtggcgcagtaacagaccgcagggcaagacagccggcgcgggaggaggatggcgctgtcggtgctgcgcttggcgtgctgctcctggcagttaccttcgcagcctctctgatccctcaatttgatctgttttcaaaatatagaacgccaaactgctctcagtatagattaccaggatgtcccagacactttaaccctgtgtgtggcagtgacatgtccacttatgccaatgaatgtactctgtgcatgaaaatcagggaaggtggtcataatattaaaatcattcgaaatggaccctgctgatggagcagtttacagaaaagaagatggagagaccaccttcactggcagactagataaattgcatttcccctttttctcttttcctgtgtttctttacatgagatttgttaacacacattttctgagagcaggtatggaagacagccatgtgtagtgatggataat

SEQ ID NO: 17375 - DNA, 501 bp, Homo sapiens
cagattgtatttggagataggcagggcctttagaaaagtaattaagttaaaatgaggtcattagtatgggccctaaaaccaaacctgtggcaccttgatctgagactctggcctcagaactgtgagcggatgaatgtctgttgcggaagccacccagtctgcggtattttgtgatggctgcctggcaaactgatacaaccactcacacacagcaaactgcacagaggggcatgaatacaaatgtgaatgttatagcaggtgcaggttaagggaagtgagatatacaaaaaaaatgagattcagtccaagagctgggtctgggcattggctagatgtctgactttgagcaagttccttaactttttgagtttcagagtcatcaactgggctcatgagaaccacaagaaacctacgaaggcactgkgacagagcctggctgctggtaggtgctgcacagtatccatcctccctgtcctctgccctggctgtgtgtgctctttc

SEQ ID NO: 17376 - DNA, 434 bp, Homo sapiens
atgaaagttgatttgttttaagtttttgcctcactcctcagtttgccttcactttttctttagattctgacaaatgaacaagacatcaaacctgttaccacagactattttttgatggaagaaaaatattttatatctaaagaaaagaatgaatgtaggaaacaaccattccagagagccattggtccagaagaggagatcatgcaaattttaagcagctggtttccagaagagggatacatgggcaggattgtcttaaaaacccagcaggaaaacctagaagagaaaaacattgttcaagatgacaaagaggtgatcttgagctcagaggaggagagtttctttgtccaagtgcatgatgtttctccagagcaacctcgaacagtcatcaaagcaccccgcgtcagactgcacaggatgtcattcagcagacc

SEQ ID NO: 17377 - DNA, 441 bp, Homo sapiens
agcaccaagggatgaaaatggaaaaagaagaataaagagaaatgcttcaaaggagattgttccaggactaccagtagttctctactaggtttacaagaactgatccagcaatggaatacaaatgcactagtgatcccagccaagataccagaacctgaccaagacaatgttttgctgctgttatccagaattaacctttgattttgaggattgactttaaagtttggcagaaaagaagcagagtcaaggaccaggaattgcttcagtaaagttgcaagataccaaatcaacctacaaaaatgaatagcatttctatatcatagaaatgaaacagctgaaacaagagagcaatcccatttacaatagctacaaaaaaaagggatcaatttcaccaaggagataaaaaatctctataaggtaaaaaccataaaacactgatga

SEQ ID NO: 17378 - DNA, 504 bp, Homo sapiens
  misc_feature 483: n=a, g, c or t
aagattcaagtgaaccagggaaggagaatgacatcagactgggcttgtgcctgataattcatttctgaagtgcttcaagattgacgcatcagatttgcacaatgtscactttaggagattatttcttccttccttcagccagacagaagactgcagtagggcaataacagagaaatagaggccaccatctgtgtgaatacttcactgtgattatctctcaccatcatcaaatagttcagagcactgatcctcacgagttggacatttccccatgaaacagtagccttctgagttcttgcaaggaaatccattgaccctgaactggtccttaggacaggcaggcgagtggccagtgcacatctcaggaaaatcacattcatctttcgccggtctgcatatggaccctgctttttttatctgttgaggaaaaacaaagagactaaatcctggatacatttagggtcatactgcttccctgtactngaagtgtgatgtgagactatt

SEQ ID NO: 17379 - DNA, 480 bp, Homo sapiens
actcctgcttccctttgtctggcggccccgcgggattggccagagctggcgccgagggactgcagagccaccccccccgtggctcctactgcgcacgcgtgaaaaaagccagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaagggggtgacttgggttggatgaccagagggtccatggtgggaccatttcaagaagcagcatttgccttgcctgtaagtgggatggataagcctgtgtttacagacccaccggttaagacaaaatttggatatcatattattatggtcgaaggaagaaaataaaatcatatgaaagac

SEQ ID NO: 17380 - DNA, 446 bp, Homo sapiens
agttcagagttcaacaacaagcttccaagatgccgcccaaaggaaaaagtggttctggaaaagcggggaaagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaagggggtgacttgggttggatgaccagagggtccatggtgggaccatttcaagaagcagcatttgccttgcctgtaagtgggatggataagcctgtgtttacagacccaccggttaagacaaaatttggatatcatattattatggtcgaaggaagaaaataaaatcatatgaaagacaaaaaa

SEQ ID NO: 17381 - DNA, 454 bp, Homo sapiens
attattactactgaaggaagaacgccagatcagaaaagggagctcaggtaccttccagagagtgagacccagcgcccttgtctcgcacccagtaggctttcatccccgccatggcgagctgatccagaagaagctacagggagaagtggagaaatatcaacagctacagaaggacttaagtaaatccatgtcggggaggcagaaacttgaagcacaactaacagaaaataatatcgtgaaagagtaagcgatacgaatcccagcttcgggatcttgagcggcagtcagagcaacagagggagacccttgctcagctgcagcaggagttccagcgggcccaggcagcaaaggcaggggctcctggcaaggcctgaccccatggtggggggaggggaggggaggggagggaatgaggcagctctaggatctatactgtagctaataaaatgtaaaa

SEQ ID NO: 17382 - DNA, 488 bp, Homo sapiens
cacgcgggcgggcgggcgggcggagagaagtcgggatcccgaggggctgcggggtgcgagaagcatcctgtagtgagcggcctcccagctgactgtgaagggtgctgagcagccggggtgcgggctccttgaggagaatgaccagctgatccgctgtattgtggagtatcagaacaagggccgcgggaacgagtgcgtgcagtaccagcatgtgttacatagaaatctcatttatttggctaccattgcagatgccagtccaaccagcacttcaaaagcaatggaataatctttcaaaagcaatagaataatcttccatttggctgtcgtgaggagtaattgaatgtaatccatctcttacaaaatggagacagggtctttaccaactcaactggttaaaacatgaatgaaacctctgtggctctttcaaaacgtgaaaatgtgaagaaagctactaacttagctgtattctcatgtaaatatttttt

SEQ ID NO: 17383 - DNA, 481 bp, Homo sapiens
tcccctttttcctggctctggagccttgggtccctgagaagagcttccttggactggggtgctctgctgctctgggggtttggcccagaaggaacccctacccagccctgtccacccaccccagcgttcctgggcccccctctgggagcttcctcttggtcccaggagctgcggtggtgtctgccccctgcactgggctctgtgccctgtgggtgttcaggagactggactgtctctgctcctcatgcaaaccttgtgggggaagcaatgaccaggagcagcacctggcccctccctgaggcctgtgagtgtctcggatccgccctggagaagtgagtggctgagacccgggtggggccctcctacccttggctctgggggcttcccttctgggtcttgtccgggatatggccttcctgaaggtcttacctcccccagccgccctgcacttgaccaccaaagcaatctctaaagctttatc

SEQ ID NO: 17384 - DNA, 474 bp, Homo sapiens
tcccctttttcctggctctggagcttgggtccctgagaagagcttccttggactggggtgctctgctgctctgggggtttggcccagaaggaacccctacccagccctgtccacccaccccagcgttcctgggcccccctctgggagcttcctcttggtcccaggagctgcggtggtgtctgccccctgcactgggctctgtgccctgtgggtgttcaggagactggactgtctctgctcctcatgcaaaccttgtgggggaagcaatgaccaggagcagcacctggcccctccctgaggcctgtgagtgtctcggatccgccctggagaagtgagtggctgagacccgggtggggccctcctacccttggctctgggggcttcccttctgggtcttgtccgggatatggccttcctgaaggtcttacctcccccagccgccctgcacttgaccaccaaagcaattctctaagc

SEQ ID NO: 17385 - DNA, 149 bp, Homo sapiens
agtaagaagccagcagggctggtgctggggcttcttctcctgaaggggctgctgagagctaaacccagcaattttctatgattttttcagatatagataataaacttataaacagcaactararaaaaaaaaaaaaaaaaaaaaaaaaa

SEQ ID NO: 17386 - DNA, 481 bp, Homo sapiens
catttgctgctccctcgctgatcgacgcccaaaccttttatatactatgtttttcctacctacatatctatgatcgagtttaatttacaaaataggcgcttactaaggaagcgattaacaacaataacgaataataaacacaacaattgagtcaaataagggttacttgaacacaagcactgcaataccatggattggtctgataactaacagctactaagagactaatgggcaagtagcatctacagttcagatacactgaacagccggagattcacaggccgggaggggtgaagcaagacggtgtgagatttcatcacgccactcagaatggcaagcaactgaaaacatgaattatttctggaattttcagtttaatatttttggactacagttgaccgcakgaacagaccctgattgtttggaggagtctgaaggtatgcaggctggcagaaggaagctggcttggatgaacatcttg

SEQ ID NO: 17387 - DNA, 480 bp, Homo sapiens
amaatytwmcttccawymwttwaaaatgacatgggtgtcggttttgtagatctttggtttttttgtcaggtttaatttcagttaacaaaatgtaaaacatgacattccctgcagatattgttgtataccagtatggtttcttctctttctttaaatgtttttggccatcaagtagcagtcgtcagtaggagtttataataccaagaatgtgctgcgtatcttgtctcaataagttttaagtaacatttaaaaatattaaagcatgttatttgacctaattttttagcatttgagttgttccattaaatggagcatcttgtaaatttcaagtattttatacttgcaattgttaagagttaacaggtagttggatttgtcgcagacaatgagttaaaggaatcctttcacgtttttcccaactttaaaattaaggattctcaggtccctgtgtagagcagtgaaaataagatgtgcgtatgt

SEQ ID NO: 17388 - DNA, 318 bp, Homo sapiens
tttttctctgccgcatccacatgttgaacggagtttaaagtctgcagttggctcctgctaatgtgatgcatggtttcctgacttcagctgccgcgtccgcttcgggatgtaagtggtctccagtgggcagaggtggaaggaaagggttggtgatgaagctgggaatgtttctgacacaacaaaccttttaaattatcagtctccccaaggagaaatgcggcttgtttctgggaatgaatggatacagagttaactgagtcacaatttcaaaccatttaagttcctctacaagagtcaaaaaaaaaaaaaaaaaaagct

SEQ ID NO: 17389 - DNA, 304 bp, Homo sapiens
tatttttataaagataatttttcatgcctccactatttggttatcttgaggtatctcttacagaaaagggaggataaatgcgttaattcttctccattatttactaggtttcacataattaattgtttcgctaatatccttcaaaagtagcccaatgaagctgggcatgctaggatgggcctgtaaatcgtagctgctcctgaggctaagatggtacgaacctgtgagcctgggaggtcgaggctacagtgagccatgatcacttcactgcactactctgtctctttaaaaaaaaaaaaaaaaa

SEQ ID NO: 17390 - DNA, 232 bp, Homo sapiens
tttctaacttgctttcccgtttttcacatggtttcaaaccttttccactgtctagcaaactctttcttcacctttcatccactgcatatgactcttggtttaaagaagtagaagccaggtcatctggcctaccagagattcagagaaatgctgcagagagtagtcagtctttttcagtgcataattgggctggcaagaaaaggccagaaactaccaaaaaaaaaaaaaaaaa

SEQ ID NO: 17391 - DNA, 467 bp, Homo sapiens
ccctacccagcagccctcgcgcggtccggcacagcggacaccaggactccaaaatggcgtcagttgtaccagtgaaggacaagaaacttctggaggtcaaactgggggagctgccaagctggatcttgatgcgggacttcagtctagtggcattttcggagcgtttcaaagaggttactaccggtactacaacaagtacatcaatgtgaagaaggggagcatctcggggattaccatggtgctggcatgctacgtgctctttagctactccttttcctacaagcatctcaagcacgagcgkctccgcaaataccactgaagaggacacactctgcacccccccaccccacgaccttggcccgagcccctccgtgagaacacaatctcaatcgttgctgaatcctttcatatcctaataggaattaacctccaaataaaacatgactggtaaaaaaaaaaaaaaaaaa

SEQ ID NO: 17392 - DNA, 300 bp, Homo sapiens
  misc_feature 181: n=a, g, c or t
accaggactccaaaatggcgtcagttgtaccagtgaaggacaagaaacttctggaggtcaaactgggggagctgccaagctggatcttgatgcgggacttcagtcctagtggcattttcggagcgtttcaaagagagcacgagcgtctccgcaaataccactgaagaggacacactctgcncccccccaccccacgaccttggcccgagcccctccgtgagaacacaatctcaatcgttgctgaatcctttcatatcctaataggaattaacctccaaataaaacatgactggcaaaaaa

SEQ ID NO: 17393 - DNA, 413 bp, Homo sapiens
  misc_feature 258,293: n=a, g, c or t
agttggtgagtgtccggccccagtaccagtgaaggacaagaaacttctggaggtcaaactgggggagctgccaagctggatcttgatgcgggacttcagtctagtggcattttcggagcgtttcaaagaggttactaccggtactacaacaagtacatcaatgtgaagaaggggagcatctcggggattaccatggtgctggcatgctacgtgctctttagctactccttttcctacaagcatctcaagcacgagcgnctccgcaaataccactgaagaggacacactctgcnsccscccaccccacgaccttggcccaagcccctccgtgagaacacaatctcaatcgttgctgaatcctttcatatcctaataggaattaacctccaaataaaacatgactggtaaaaaaa

SEQ ID NO: 17394 - DNA, 579 bp, Homo sapiens
tagttcttgcagtaaaacaagtatcctctataggctggttacatcccacatctatttagcattggtataaaaagacatatgagaaacggttctgcactcaaagagctcttacttgagggccagagacatgcttgtaaggcagtaatgtacaaatcatggaaaactctagtgtgataacttagcagaaaatgcttgttttgatgatatcagagaacccatttcaaaagcagtaacatttgatttgagtcttgataggtaacgaggtttcctgactaaagaacaggagacaagtgctgtctgcccagggtatttgtagagggtgtgagaagaccagcagctggtggtgggtggggctggagggctgagattagagacaggctgggccacaccgggcagcatgtgccagtctaagccgtttcagctttctcctgggcagtggtcagccatgtacattacatgcatgcttcccttcactacatgttcttttatattgaataaggaggatgtgtaatacattaagatagccttcataggaagatytgccctaatttgttgttwtatgtgacttctatgcagcac

SEQ ID NO: 17395 - DNA, 97 bp, Homo sapiens
cttctccgcctccgcctcctcmmgacgcmrgcgmmgctttcwggaagrttcgtgaaggcagtgagggcttaccgttattacactgcggccggccaga

SEQ ID NO: 17396 - DNA, 464 bp, Homo sapiens
taaatatgaccactacttgatcccaaacgccctgctggagctggccctgccgcttatggagcaagacagaaacgaagaggccatcaaacttttggaatctgccaagtaaggcttgggtaacctcagtctgtcctttgctccctctgaactcagctcaggagctggctggggacagagttgcccagagagcagtgagtggagttgctagcaaggccagtctggcagtctagagggtggacctgtgtccctcggaatccagctctcgcctgtcataggaagacttctttcttaatgtataaatgcgcagttagactcccagaggcaggaagtaagttcccaaggtcacatcagaagccaactgcatggctgtgtgaggacccatgcctcctgccttccagggtaggggtctattccctaaaaccaccccttcaagcttaggaaccaggaggaccaggagtggttcc

SEQ ID NO: 17397 - DNA, 201 bp, Homo sapiens
tataactagattagtgctttctagcaaacggttctgttaattagcgagtcactgttgattctgctgtggtggtaagttgataccgtgtaactaatcccgtggatgcctcctggttatttttgtccaaacgaagcagccgtggtagtagctgtctatgattcttgctcagcaaagtaaaataaatgttaaatatggagaaaa

SEQ ID NO: 17398 - DNA, 457 bp, Homo sapiens
atattcctatcttgatatcaaactgtaagttataagaaaaacatgtttggatagttaagtcatttagggtggttctgctatggattcctgtttcaaatagaaagttaaagatagctttcttatatactctcaaacttagttaaatgagactaaagctattacttaaaatgtcaaatttgggccaggcatggtggctcacgcctgttgtcgcagcacttagggaggctgaggtgtgaggattgcttgagccccggagttcgagaccagcttgggcaacgtggtgagactccatctctacaaaaaataaaagtactagccgggcgtggtggcatgcgcctttagtcccagctacttgggaggctgaggttggaggattgcttgagcccaggaagttgaggctgtagtgagccgtgattgcactactgctgtccagcctgggtgacagagcgagasctgt

SEQ ID NO: 17399 - DNA, 532 bp, Homo sapiens
taaatactaaataaacacttcttcataacactgtaccaattcagcttttaaattttattactttgctttcctgtcctttgccaactcttaacctagttaatcctagttctgttgacattggaccaggctcagtaaataaacgaatggatttccagcctttttttcccatctgttcctgcttttagtcctctgaatctgcttcttttcttactgctgctttattttacagtgattttgtcaaacatagaatacaggactaaaaatgcaaagaaattgggtctgtgtttaattttgatgtttcaaattttgagcttccaagtctttgtggccacccaatgaagtttgagtctgcctgttcagatgtgaaaggtaagggctgcagcaggtttaagggtggcccttcaccaccctgttgtcacctgcacaggcactcccccatttgcagatgaagaaatgttcagagaagaaaaatgatggaccaaacgtctgtttgcacaattgaaactctaccagtggactattctattttccc

SEQ ID NO: 17400 - DNA, 493 bp, Homo sapiens
  misc_feature 467: n=a, g, c or t
gtcttcgccctccgtggatggaggctgagcgcctcagcmattttagagctctggaaattttattagcattttaaaatttgcattctcgaccgaagattaaagtgcaaattactttgaagatgttttaaagcacgcttaagaattttaaaaaatatgcgcaggtggaaaaaagcgcgccagggtttgagatttggtccgtctgtggttttgtttttttgaaggtggccctgagaaggcagcaggcccaggaggaggaattgggtatcagccaccccatcccactgcccagtgcggccgagctgcttgtcaaaagagagaacaatggcagtaacccgtgcctcatgactgagtgcagtggcacctctcagccaccgccggccagtgtccccaccactgcagcttcagggtctcgttctgtcgcccaggctkgagtgcagtgacgcgatctctgctcactgcaaacctcngcctcccgggttsaagcaattctcct

SEQ ID NO: 17401 - DNA, 560 bp, Homo sapiens
agaatgtcctaagatatgcagttggcaagctggagacccaagaagagccaatatttcagtttgagtctgaaggcaggaaaagactgatgtcccatctcaaagcagtcaggcagagggagttccctcttgttctcactcaaggaaggatgagtctcctgaggttcagaagggtgagatgacacattcaagatcacatggctcatttgtgttggagtcagaagtttccagatttcttgacttttagtccaaggagcagtccctgtgcatgtgtcagagttgaacaagccagctggactgagtgcccatgacctcagggacatcttggaagctatatgtagaagatggaaaagcctctgtcatctccatcaatttaatctccaaataactacttagaaaagggacagcttactaactccttcattgcccagtactattagctaaaaacattataacaggagattcaaattctacatggtgggagcaaaagtggatcttgtttttctatagcaacatggttgaccttcatagtgaagtttgaatctgacagcattcatgctcaa

SEQ ID NO: 17402 - DNA, 741 bp, Homo sapiens
acttccgctgctgtttcgtagccgactgctgaaggctggtttgcgtcgacatggcggttaccctgagtctcttgctgggcgggcgcgtttgcscgccgtcactcgctgtgggttcgcgacccggggggtggcgggcccaggccctattggccgggagccggaccccgattccgactgggagccggaggaacgggagctgcaggaggtggagaggtaccggcttctccccgggccctcagcttgaagcagggcctcgtgccccggcgctccaggccgcgcccccttggcgccgggtgtcctgccgctgcttgcgcasggcaccttgtttcttcttacccgttgttaggggcgcacgtcaggtgttcagctccccgggaccactggtccttcattagtgacgtatttmatcatcagtttagagagttcggcatgcttacaggcagttattgttctaggtgttagctttctgggtgtacggagcagctctaagccggcaacatggcccggttgcccttgcgatcaaagagaagagggctgggcgctccatgatttagcctgaggctcttcaaacatccattctgcttccacgcatggcttctgccattggttctcttcccccagcaccctgaaacgacagaaacaagcaatccgattccagaaaattcggaggcaaatggaggcgcctggtgccccgcccaggaccctgacgtgggaagccatggagcagatacggtatttaca

SEQ ID NO: 17403 - DNA, 412 bp, Homo sapiens
atttaacagcttttgttttgggcagaagaacctatgggcacaaaaagcaggaacgagtagcggtggctgaagaacgagcaggagcttgaatttcagttttcttatgaggaattttccagaaaagatatcttcactgtgaaataactaaataaatgcccactcagtacaacaaaaatacctgctacatgcttccttctgtatgaatacatgagacctaccttcattcatgtttcctctatgaagctttccctgcactccaaacacagagctgagacttccacctaatgtagaaagctagcacgagccggcgctgacagatggaagacttgagatgttacaagattatatatggaaacacaaaaggagtggagttgctgggtcatatggcaattcatttgaggaactgagaagc

SEQ ID NO: 17404 - DNA, 285 bp, Homo sapiens
aagctagggtcgccgccactgccgcagaggcgtgaggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaacgtaagtgtgctgtgaatagggtctcatgcaatttggagaaacaaaaaaaaaaaaaaaaa

SEQ ID NO: 17405 - DNA, 398 bp, Homo sapiens
cctgcagattttccagcggatcccccggtggcctcatgtcgcgcagtggaaccgatcctcagcaacgccagcaggstcagaggcggacgcgcagcagcaaccttccgggcaaacggtaactgcaccgcggcagggactcgctggggcgcggascgagccctccccttccttaggaagctttcgtcccctccgaagttggaacgctcatcccgagccagaccgacaaggcgtacagtctgcaggcctgtacgagcagcaggccaattggcgctgggaaagtccaatcctgggsctctagctcctgagcgggacarggccgagagggcgctcccgagcttgggcctgctggtgggtgagacccargagagarggagctagagagctctgaggactgatct

SEQ ID NO: 17406 - DNA, 386 bp, Homo sapiens
agattttccagcggatcccccggtggcctcatgtcgcgcagtggaaccgatcctcagcaacgccagcaggcgtcagaggcggacgcgcagcagcaaccttccgggcaaacgaccatcagcatatccgctacaacccgctgcaggatgagtgggtgctggtgtcagctcaccgcatgaagcggccctggcagggtcaagtggagccccagcttctgaagacagtgccccgccatgaccctctcaaccckctgtgtcwddgggccatccgagccarcggagaggtaagcctgtagagccctgcatctgcagctgggccacggggagtagttccctcttagaactgtcctccamccacagggatagtgaacctccttctgggtcatatc

SEQ ID NO: 17407 - DNA, 174 bp, Homo sapiens
tataaatataaatatataaatacaatatgtgaagacatcttcttggtttttattttgaaacaatttttaggcttgttccgggggtctctgtgctgcctgtactgtattgacctgttttataggtgcctttttattaaaaagaaaattcaaaatccgaaaaaaaaaaaaaaaaag

SEQ ID NO: 17408 - DNA, 440 bp, Homo sapiens
acattcaaatgactcagtcagcctaaggaaggaatatcagtgaagctcagccaatccaaataatgtctaattggtaactggttatttcagcaataggcttatgcaaaatgccaagccaattagacctgtggagactcagttacaaagatttgtaaggattgtttgaaaggattgttgttaagaagaattttttttttctataggacttagttttgagagaatgtaagcctgaagatgcttggaagcaagagagatgagagacaatttttttgtttctttcaataggcaagacatggaatcagcatagaaaaaagcaggactgaatgaagagtcaccaytttgattagattgtttaaatttccagcattaattctgcagtgcctctccgcaagaggctctgggtctgtgttgctgaattggcctgtgtcctcaaagcacgt

SEQ ID NO: 17409 - DNA, 547 bp, Homo sapiens
ttactatttgtagaaatatttatatgtcaaagggatgctaacaatttactttattgctctaaaatagaaaagttgccagaatgctgtggagttttagtggaaaacatgatagctggtgttactgagtaaatttgagtgttaaatgtcaatgtaagctaacggccaagatagggaccactgcagggtggttacttgcagctgtgactcaactggtccttcactgccaaacatacctggggttggatcattggcctgacgtttgcaaattgaggaaccttagggcaaatcagtgaacttctgaactgccttcgtcttcagttatatggggatttccccacttttgagatccttgtaaggattatatgagatgaagagatgagacaaggtatataaaagtcctagcacagagcgtgtcatataatatggcttcacaagtaccctcatctcctttccagtcgttttttgttgttgtttttgtttttttgagaccatctcactctgttgccaggctggagtgmtcttcatttttatttctttattcagcagt

SEQ ID NO: 17410 - DNA, 473 bp, Homo sapiens
  misc_feature 265,308: n=a, g, c or t
cagcgagaggctctgaggctgccagagtggttgtgtctgttcctccggtaaggggtgatttgccgaggggcgcggaccagacagacctcgggtcaggcccgggaaccccgagaggagagcccagcccctggtggaggcggcttggcggagattcggagccgtcagcaggtttggggagaaggaaacgagtgttgtggggggcgtgggtgcggggggtaggccactgckcacacccccggctcgcaggggacgctccgggtttgtnggcggctctcggggcctgtbgcaccagcttttgartattthhngcggtgtcaagtcttcggcagcgagaggagcaaagtccgaagaatgaatggatggtgaacgcctggacttggttttgttagagtgggagatgagccgtggttgttagtggaaggtgttcacgtgattgtgaagcggcattttggattttgtcaaaagttaacagt

SEQ ID NO: 17411 - DNA, 452 bp, Homo sapiens
tttttaacccggagccccgcccctcggstacaaaaccggagcctcgggccgggctgcgtgagggaggagggttcatcatgcctagtggcgtataagaagaccccgscamcsgktccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccccccaaaaggaaactgtcatcgataggaatacaagttgactgcattcagccagtg

SEQ ID NO: 17412 - DNA, 240 bp, Homo sapiens
ctctcggcaagctgctgcagcgctagacgccgccccgccgctgcccccggggaaggagcgcmscccagaccgtcctggcttcgaacccagctcttccaccttcagaccaccaccgcatattctgagcctcattttccccgtctgcacagtggggataagaaagcctacctcacgttacgattttatacataggataaacgcaagattaaatggatatttgcaaaaaaaaaaaaaaaaagg

SEQ ID NO: 17413 - DNA, 223 bp, Homo sapiens
  misc_feature 126: n=a, g, c or t
ctctcggcaagctgctgcagcgctagacgccgccccgccgctgcccccggggaaggagcgcmcccagaccgtcctggcttcgaacccagctcttccaccttcagaccaccaccgcatattctgagntcattttccccgtctgcacagtggggataagaaagcctacctcacgttacgattttatacataggataaacgcaagattaaatggatatttgcaaaa

SEQ ID NO: 17414 - DNA, 225 bp, Homo sapiens
  misc_feature 107: n=a, g, c or t
ctctcggcaagctgctgcagcgctagacgccgccccgccgctgcccccggggaaggagcgcagcccagaccgtcctggcttcgaacccagctcttccaccttcagancaccaccgcatattctgagcctcattttcscsgtctgcacagtggggataagaaagcstasstcacgttacgattttatacataggataaacgcaagattaaatggatatttgcaaaa

SEQ ID NO: 17415 - DNA, 228 bp, Homo sapiens
ctctcggcaagctgctgcagcgctagacgccgccccgccgctgcccccggggaaggagcgcacccagaccgtcctggcttcgaacccagctcttccaccttcagaccaccaccgcatatttctgagcctcatttttcccccgtctgcacagtggggwtaagaaagcctacctcacgttacgatttttatacataggataaacgcaagattaaatgratatttgcaaaa

SEQ ID NO: 17416 - DNA, 225 bp, Homo sapiens
ctctcggcaagctgctgcagcgctagacgccgccccgccgctgcccccggggaaggagcgcmscccagaccgtcctggcttcgaacccagctcttccaccttcagaccaccaccgcatattctgagcctcattttccccgtctgcacagtggggataagaaagcctacctcacgttacgattttatacataggataaacgcaagattaaatggatatttgcaaaa

SEQ ID NO: 17417 - DNA, 225 bp, Homo sapiens
ctctcggcaagctgctgcagcgctagacgccgccccgccgctgcccccggggaaggagcgcagcccagaccgtcctggcttcgaacccagctcttccaccttcagaccaccaccgcatattctgagcctcattttccccgtctgcacagtggggataagaaagcctacctcacgttacgattttatacataggataaacgcaagattaaatggatatttgcaaaa

SEQ ID NO: 17418 - DNA, 224 bp, Homo sapiens
ctctcggcaagctgctgcagcgctagacgccgccccgccgctgcccccggggaaggagcgcmcccagaccgtcctggcttcgaacccagctcttccaccttcagaccaccaccgcatattctgagcctcattttccccgtctgcacagtggggataagaaagcctacctcacgttacgattttatacataggataaacgcaagattaaatggatatttgcaaaa

SEQ ID NO: 17419 - DNA, 225 bp, Homo sapiens; identical to SEQ ID NO: 17416

SEQ ID NO: 17420 - DNA, 225 bp, Homo sapiens
ctctcggcaagctgctgcagcgctagacgccgccccgccgctgcccccggggaaggagcgcagcccagaccgtcctggcttcgaacccagctcttccaccttcagaccaccaccgcatattctgagcskcattttccccgtctgcacagtggggataagaaagcctacctcacgttacgattttatacataggataaacgcaagattaaatggatatttgcaaaa

SEQ ID NO: 17421 - DNA, 225 bp, Homo sapiens; identical to SEQ ID NO: 17416

SEQ ID NO: 17422 - DNA, 225 bp, Homo sapiens; identical to SEQ ID NO: 17417

SEQ ID NO: 17423 - DNA, 224 bp, Homo sapiens; identical to SEQ ID NO: 17418

SEQ ID NO: 17424 - DNA, 504 bp, Homo sapiens
aaaaaaaacacaaccacaagttatgcccgtgctgtgcctctagcagcaaagacaagcggtgtggggttggatgaatctacacttctcgtcgggggagaaagggtattttcctctttagcataagccatttacatagtgtctttagaccagagtttaaattcagcaggaaattgtagcttaatggttttttttctcttttcctctatatcttttgaaaagaagtctttggaattttggagaaagagaaagggtcattaactaccagagtttgcgcastaaaataaattattgtccaatgcactgctcatgatctagaaaagtttgcagtaggagtgaagcgcaattgtgtctgctaaaaagggacaatggtgactcgtttgtaagatgcatatggcaaagattagaaccaaagtcctttgtatatatagcaaatgttaaagaaattgttgcttatttacatccttctgaaatttttgaactccactctattaaaattattaaatt

SEQ ID NO: 17425 - DNA, 578 bp, Homo sapiens
  misc_feature 550: n=a, g, c or t
tattctttggaatgatactaaagtctctggtctaggaccataccttatataaaggtataagagaccatgacaatgtctgaaaatggaatagataatgatgccttttatttaaagtggcccacataatatacattgagtactccatctctccaaatgtatttccataatgtgttgaaaacatgctaacatttgtatgatttttatacttctgccgaatagacttagaatcagatgaattgtctgtgtgtcttgcaaaagagttggggacaacttgggcaggcctatgaagtgcatagggagtgtatgtcttctgaatggttttattgttcttgtaatctagcttaaagaaatgttaactgggagggtgctgaggccactcactgcattaattttgtgtgtttagagttctgttgtcaaaagaaaactaatgaataaattagtttgtcattctagaatttaaagttctaagattagtataaagagtatatagattgttaatccccaccagctagactttgaacttaagtcagacttaaagatttgagaaatnatttgtgtcatttactagacgtgatttt

SEQ ID NO: 17426 - DNA, 432 bp, Homo sapiens
  misc_feature 223: n=a, g, c or t
accctaatgtaagatggtggcccgtctggctgtggaacccaccgaaagctgagagtctctctctcagccgtaaaggtcggactcgctgaagcaatcaggcccggttctgaagagttttttccccgacgctcgttcggtggtttcttgtgaggacgcggcasccgtggagtcggctgagggawaagckaggcaaggcaggcgggtcgtcaaagtcctacatttnagctttcagtgctgaacttccttctcccttaaattattataaacttttgctgctgtttaataaacgtgaagatgtctcgcagtcctgatgcgaggaagaccctgtggagtgccctctttgcatggagcccttggagatagatgatatcaactttttsccttgcacctgtggctaccagatttgccgattttgttggcatcgaattcgca

SEQ ID NO: 17427 - DNA, 399 bp, Homo sapiens
acctgaacttggctcagctgccgggctgctccggttggaaacgccaagccagctgcgtcctaatccaaaagccatgaacagcggcgtgtgcctgtgcgtgctgatggcggtactggcggctggcgcctgacgcagccggtgcctcccgcagatcccgcgggctccgggctgcagcgggcagargaggcgccccgtagcagctgagggtatcgcagagaacggatggcgagtcccgagcgcacctgggcgccctgctggcaagatacatccagcaggcccggaaagctccttctggacgaatgtcatcgttaagaacctgcagaacctggaccccagccacaggataagtgaccgggactacatgggctggatggattttgccgtcgcagtgccgaggag

SEQ ID NO: 17428 - DNA, 496 bp, Homo sapiens
cttatttgggtcactggtccatcaaagccaagcctgggccagccaagtacaaggcctgctggagccttggccgctgtagctggtgggaaacaagaggccaggtgtggggctggacagtccaaggagccacatccggggacaaaacaagtgcaggggacatccatgcaggtcttgatgccagggagttagggaattggggtcctggcagggaagcagggctgggagctggctgcaagaatgaaaggaagactcagggggaggggcaggaaatagaaagggacatgtagggggagtgctgccgcccacttgcagcctgggggcaaatctgccagagccaggccgttctgggctcagcaaagctggtttctgggagccttcttcagtagggtggggtgggaagaccgaggtgcaggctgctttgggaaaagagtttcccatattcctaacgggagttagggcaggccaggtgcagtgcctcacacctgtaatcccagaa

SEQ ID NO: 17429 - DNA, 249 bp, Homo sapiens
  misc_feature 204: n=a, g, c or t
aaagtggggatgctctagaccgagtactgcccccagtgtctttccacctcctcctgcagcagcggcasgcagcagcagttagcagcggcaacttgaggctgcaccccgggcaagtccccagggtggtgctcagccgagaggggggcttggcgccccgaagkgtgttggtagggtgggggcgaccagctgggaccagckttgggncctgggaaaaacctcccacacacccacacccacacaccccttttg

SEQ ID NO: 17430 - DNA, 337 bp, Homo sapiens
tagatgttaattctctcccttggcatccggttagccccccagggggsmargcattgtggagaacttgatatttagttactgatgctcttccaggacacgaaaagaacccatctttgaatatcaatgatttttttttttttaaagtactgttccggggagaaaaacagtctcaaaacttgaacttcttgggaagagaagtgtkgggctgagaggtaacattcccaggaaatagtgagaagctcgccctgtgtttgaaaccgtgtgggtctctgtgttcctgggaagaaaacagggagcagcatcttttaaagcctgtccttaaaggtgtctcgttaga

SEQ ID NO: 17431 - DNA, 391 bp, Homo sapiens
caggatgttcaacttgctttcttggatctttttgaatttcgaatttggccatagctgaccacttgcttttgcatcaatacttcaaagggttcaaggccaggtgcggtggctcacgcctgtaatcccagcactttgggaggccgaggcgggccgatcacgaggtcaggaaatcgagactatcctggctcacatggtgaaacctgtctcgactaaaaatacaaacaattagccgggcgtggtggcgggcacctgtagtcccaactactcgagaggctggggcaggagaatggtgtgaaccgggaggcggasttgcagtgagccgagatcgcgccactgcactccagcctgggcgacagagcgagactccgtctccaaaaaaaaaaaaaaaagg

SEQ ID NO: 17432 - DNA, 427 bp, Homo sapiens
gttgtcactcgactaccaagatggcggcccccgggagctgtgctctatggagctattgcggccgtgggtggtcgcgggcgawkgcgggggctgccagctcctcgggcttcgtagctcttggcccggggacctactaagtgctcggctcttgtcccaagagaagcgggcagcggaaacgcactttgggtttgaractgtgtcsgaagraggagaarggggggcaaagtctatcaggtgtttgaaagtgtggctaagaagtatgatgtgatgaatgatatgatgagtcttggtatccatcgtgtttggaaggatttgctgctctggaagatgcacccgcttcctgggacccagctgcttgatgttgctggargcacaggtgacattgcattccggttccttaattatgttcagtcccagcatcagagaa

SEQ ID NO: 17433 - DNA, 391 bp, Homo sapiens
tattttttacattttgctttagaggcagggtcttggtctgttgcccwcactagaatgcagtggtgccatcacagctcactgcagccttgaacttctggactcaagcgatcctcctgcctcagctagctgactagctgggaccacaggtgcttagcacgtagcctggctgatttttcctggtctcattgttgctggggctggccttgaactccaaacctcaggcaatcctccwgccttggccacattttatgttgggattacaggcctgacccaccatacccagcctaatactatttttaaaaacaaaaagtaggaaatcaattttccttttaaatgaacactaaattataagaattaacttgggtaatctatgcaacattctcactttttt

SEQ ID NO: 17434 - DNA, 82 bp, Homo sapiens
acagttaactttaggaccatagccamaagatagaaacagcataaacgccaaaatamaaagwhgccaataaagataaacacaa

SEQ ID NO: 17435 - DNA, 448 bp, Homo sapiens
ttagcagttctcgctcaccgcgctastgcggcttctacgctccggcactctgagttcatcagcaaacgccctggcgtctgtcctcaccatgcctagcctttgggaccgcttctcgtcgtcgtccacctcctcttcgccctcgtccttgccccgaactcccaccccagatcggccgccgcgctcagcctgggggtcggcgaccgggaggaggggtttgaccgctccacgagcctggagagctcggactgcgagtccctggacagcagcaacagtggcttcgggccggagaagacacggcttacctggatggggtgtcgttgcccgacttcgagctgctcagtgaccctgaggatgaacacttgtgtgccaacctgatgcagctgctgcaggagagcctggcccaggcgcggctgggctctcgacgcccagcgcgcctgctgatgcctag

SEQ ID NO: 17436 - DNA, 353 bp, Homo sapiens
gttgagatttcctgggaataaaatggcttagttgggcattggacagtgtagttaagtaaaccctatcttgacaaaatgattcagatatgtgcttatattcttaggtgaccgggttattgatgtgggatctgaatggcgaactttcagcaatgacaaagcaacaaaagatccatmtcgagttggagattctcagaatcctcttctgagtgatggagatttgtctaccatgattggcaaggtaataagtccatttggcaggaaataccaattgcagagtgaccatagacctgagagtttgggaactttgcaaaagtatcagtcactgcaccagtggggaatcttgacctgtctaa

SEQ ID NO: 17437 - DNA, 497 bp, Homo sapiens
gatcggcccggaagtgctcacacgtgtgctccctgccctgctcctggccccttggccggccgggctgtttctgsccatgggtcgctcccgccggacaggcgcgcaccgagcgcactctctagcccggcagatgaaggcgaacggcggcggccggacttggatgagattcaccgcgagctgcggcctcagggatccgcacgaccccagcccgacccaaacgccgagttcgaccccgacctgccagggggcggtctgcaccgctgtctggcctgcgcgaggtacttcatcgattccaccaacctgaagacccacttccgatccaaagaccacaagaaaaggctgascagctgagcgtcgagccctacagtcaggaagaggcggagagggcagcgggtatgggatcctatgtgccccccaggcggctggcagtrcccacggaagtgtccactgaggtccctgagatggatacctctacctgacatggmctgaagatgcag

SEQ ID NO: 17438 - DNA, 507 bp, Homo sapiens
cattattatctttatgttatagtataagttttgaattatcccagctttttgaaaaagcatgtaatttactgacatactattctttattttttaaaacaacgtaagagatgggcttattatgatttttgattatgaagacgaggatgttgagacccctaggcattaagtgacttgcctaagattccctagttaattcaaattgaagtaggggtttaaataaatattaacctgaaagtatccctctcaacccatttgaaatatgtaaatcataatatttattaaacataatatttattaatataaataatatctatttcaagtgggttgagggggatagtttcaattaaatttaaggcaaatgtataaccatttgaatggcgctatgtgtaacttgattgatgccatcatctttcaaaaattataatctactcatgctacactcttgctgaaaatacacattgactccgttatctacacaataaaatctggatccacagataagagtaa

SEQ ID NO: 17439 - DNA, 447 bp, Homo sapiens
gactaccaagatggcggcccccgggagctgtgctctatggagctattgcggccgtgggtggtcgcgggcgatgcggggctgccagctcctcgggcttcgtagctcttggcccggggacctactaagtgctcggctcttgtcccaagagaagcgggcagcggaaacgcactttgggtttgagactgtgtcggaagaggagaaggggggcaaagccaggtgcgatggttcacacctgtaatcccagcactttgggaggccgaggtaggcacttgaagtcaggagttcgagaccagcctggccaacgtggtgaaacctcatctctactaaaaatacaaaaaaaattagccaagcatggtgacgcacgcctgtaatcagctaattaggaggctgaggcaggcaaatttcttgaacctgggaggtggacgttgcagtgatctgagattgtgc

SEQ ID NO: 17440 - DNA, 383 bp, Homo sapiens
caacaattccctgaggtaccgtccccattttacgaatgaggtgactgaggcacaatgaataagtaactttcccaagattgtatagctagtaagagagattcaaccaggtagtatgtcttgaaaactgctcttaccactraactgtaaatgttcaacamaaagtgaaagctggctgggcggggtggctcatgcctgtagtcccagcactttgggaggctgaggcaggtggatcacgaggccaggagtttgaggccagcctggtcaacatggtgaaacctgtctctgttaaaaatacaaaaattagttgagcatggtggtgtgcgcctgtaatcccagctacttggggggctgaggcacaagaatcgcttgaaccggggaaagcg

SEQ ID NO: 17441 - DNA, 404 bp, Homo sapiens
aagtttgtttattttgtttttagtttttggggtccccgtgctgctgcaaggcgaaacgggagggagttacccctgcgcccctcagtcccccctacgacgtcgcctccatagtctgcggagaagcggagactgcgcgcctcgcctcacagcgaaacgccgcgcactcggagccggcacggctcggcgggttgtggttttttgcactgaatgtaacctagactcatmttcacgggcttgtgttgccccakgtactgkcaaaggcagtatttttgtgtttytgcaggagttttgcacaaaatctgttcccatgcaaaccaatgagggagaagtatcggaagaaagcagttccaagatggaacaggaggattttgttatttgaagggcatggcaagactccacctcct

SEQ ID NO: 17442 - DNA, 131 bp, Homo sapiens
tatataaaggagctccgcgtgcggaggcctttcggagggtggtgagctagtctgcggacgctgtataccctcctccacttcccgctgcagccaataaaggccgttcctaccataaaaaaaaaaaaaaaaaa

SEQ ID NO: 17443 - DNA, 349 bp, Homo sapiens
cttttcggagggtggtgagctagtctgcggacgctgtataccctcctccacttcccgctgcagccaataaaggccgttcctaccatagtctgtgtccgcgttcttttttccgggactgcagagttcggggaagctgtacgccgcctttcactacgcggaatttgcagatcttcccctggacctcaggcctctccggctggagtagggtggactcttcacataagcttctctggtcgaacttacccgaatctccagatggccgcgctgcgtcgaatgctccacttgccgagcctgatgatggggacgtgccgcccctttgcgggtagggaggtgggggcagagtggagag

SEQ ID NO: 17444 - DNA, 118 bp, Homo sapiens
ctttcggagggtggtgagctagtctgcggacgctgtataccctcctccacttcccgctgcagccaataaaggccgttcctaccataaaaaaaaaaaaaaaaaaaaaaaaaaaaaaaaa

SEQ ID NO: 17445 - DNA, 471 bp, Homo sapiens
tattttaatttatagggcaaatattcaattggatacgggggaggtttcctttgagtaagccaataaatattgactcagcaatattctgctacactggtgattttgatcttgaaatttcaaagtgtttctatcagttcaccagtccttgctacattttaatttcctttttgctgatatccaggttgggttaaacccattttaagaggagtttgagccaggtgcagtggctcatgcctgtaatcccagcactttaggaggctgaggcaggtggatcacttgaggccaggagtttgagatcagcctgttcaacatggcaaaaccctatctctactaaaaatacaaaaactagctaggcatggtagcgtctgtaatcccagctacttgggaggttgaggcaggagaatctcttgaacgtgggaggcagaggttgcagtgagctgagatcgcaccactgcactccagcctgggtga

SEQ ID NO: 17446 - DNA, 141 bp, Homo sapiens
  misc_feature 75: n=a, g, c or t
cttttcggagggtggtgagctagtctgcggacgctgtataccctcctccacttcccgctgcagccaataaaggcngttcctaccataaaaaaaaaaaaaaaaaaaaaaaaaaaaaaaaaaaaaaaraaaaaaaaaaaaaaa

SEQ ID NO: 17447 - DNA, 148 bp, Homo sapiens
cttttcggagggtggtgagctagtctgcggacgctgtataccctcctccacttcccgctgcagccaataaaggccgttcctaccataaaaaaaaaaaaaaaaaaaaaaaaaaaaaaaaaaaaaaaaaaaaaaaaaaaaaaaaaaaaar

SEQ ID NO: 17448 - DNA, 159 bp, Homo sapiens
cttttcggagggtggtgagctagtctgcggacgctgtataccctcctccacttcccgctgcagccaataaaggccgttcctaccataaaaaaaraaaaaaaaaaaaaaaaaaaaaaaaaaaaaaaaaaaaaaaaaaaaaaaaaaaaaaaaaaaaaaaaa

SEQ ID NO: 17449 - DNA, 140 bp, Homo sapiens
cttttcggagggtggtgagctagtctgcggacgctgtataccctcctccacttcccgctgcagccaataaaggccgttcctaccataaaaaaaaaaaaaaaaaaaaaaaaaaaaaaaaaaaaaaaaaaaaaaaaaaaaar

SEQ ID NO: 17450 - DNA, 148 bp, Homo sapiens; identical to SEQ ID NO: 17447

SEQ ID NO: 17451 - DNA, 153 bp, Homo sapiens
cttttcggagggtggtgagctagtctgcggacgctgtataccctcctccacttcccgctgcagccaataaaggccgttcctaccataaaaaaaaaaaaaaaaaaaaaaaaaaaaaaaaaaaaaaaaaaaaaaaaaaaaaaaaaaaaaaargct

SEQ ID NO: 17452 - DNA, 144 bp, Homo sapiens
cttttcggagggtggtgagctagtctgcggacgctgtataccctcctccacttcccgctgcagccaataaaggccgttcctaccataaaaaaaaaaaaaaaaaawwaaaaaaaaaaaaaaaaaaaaaaaaaaaaaaaaaaaaad

SEQ ID NO: 17453 - DNA, 131 bp, Homo sapiens
ctttcggagggtggtgagctagtctgcggacgctgtataccctcctccacttcccgctgcagccaataaaggccgttcctaccataaaaaaaaaaaaaaaaaaaaaaaaaaaaaaaaaaaaaaaaaaaaaa

SEQ ID NO: 17454 - DNA, 129 bp, Homo sapiens
cttttcggagggtggtgagctagtctgcggacgctgtataccctcctccacttcccgctgcagccaataaaggccgttcctaccataaaaaaaaaaaaaaaaaaaaaaaaaarraaaaaaaaaaaaaaa

SEQ ID NO: 17455 - DNA, 130 bp, Homo sapiens
cttttcggagggtggtgagctagtctgcggacgctgtataccctcctccacttcccgctgcagccaataaaggccgttcctaccataaaaaaaaaaaaaaaaaaaaaaaaaaaaaaaaaaaaaaaaaaam

SEQ ID NO: 17456 - DNA, 346 bp, Homo sapiens
ataggtctcgtcaagaccagcccatgtttcttaaaaactgcagtattatgaagagttcctgtgccttgccgcgttttaacctttttagaatgcgacatctgttcatctttaaaatatcattttatctcatactgttagtagtagcttcttaactactacccattcttaactttaagaagcatagaatttagaatatagaacgaccgcttgtatggcctggatctgggcacttaaccttactaagtttatctcgtgtaaactgaccttgctaactcacgtgaggcttaaataatacaatgtggaagacttcagggcacatttttggttttttggtttttgtttgttt

SEQ ID NO: 17457 - DNA, 140 bp, Homo sapiens
tatataaaggagctccgcgtgcggaggcctttcggagggtggtgagctagtctgcggacgctgtataccctcctccacttcccgctgcagccaataaaggccgttcctaccataaaaaaaaaaaaaaaaaaaaaaaaaaa

SEQ ID NO: 17458 - DNA, 596 bp, Homo sapiens
gccattcttgagggagtaaggtggtatcatattgtggttttaatttgcatctccctaatcattagtcatgttgagtactttttcatgtttttggccatcttctagacattggcttaggcaaagatttcatgaccaagaacccaaaagcaaatgcaacaaaaacaaagataaataggtgagacttaattaaactaaagagcttttgcatggcaaaaggaatagtcagcagagtaaacagacaacccacagagtgaagaaaatcttcacaatccatacatccgtcaaaggactaatatccagaatctacaaggaacgcaaacaaattagcaagaaaaacaaacaaacaaacaaacagtaccatcaaaaaataggctaaggaaatgaatagacagttcttcctttgcatttgtatttgtctgctctcttgcgtattttgggcagcccttgctgctgactcctactgcttgatccccacactctcccctagacaactttgcagttcatacacgactccctgaaagagaacacagaaaacatttggaagtggtggagtgtgctgtaaagagtgtgagatttctgtcaaaagttctgattgt

SEQ ID NO: 17459 - DNA, 478 bp, Homo sapiens
gtcagactttcgttcggccctaggatttggtagccccgaagtgtgggctctctccagtaccagactcatttcagtaccagcctttgggaagtcgtgtgaatacctcggtctcttagccacagggatagaatggcggcctgacggagccgcggcgccggcgaagtcgctgaggcgcgactggaacccccagaccagctcaaacgggagccaaaactcgaagcttggaagaattagcaggaaatggcggatgaggcgttgtttttgcttctccataacgagatggtgtctggagtgtacaagtccgcggacagggggaggtggaaaacggacgatgtattactaagctggaaaacatggggtttcgagtgggacaaggattgatagaaaggtgagcaggttggatttgaaaattttcttgcaggtttacaaaagatactgcaagttcaaggatgagttagatatcatgaagttcatttgt

SEQ ID NO: 17460 - DNA, 466 bp, Homo sapiens
agcggccggatcgcatctcagctggttggctttggttagagctcccgtcagactttcgttcggccctaggatttggtagccccgaagtgtgggctctctccagtaccagactcatttcagtaccagcctttgggaagtcgtgtgaatacctcggtctcttagccacagggatagaatggcggcctgacggagccgcggcgccggcgaagtcgctgaggcgcgactggaacccccagaccagctcaaacgggagccaaaactcgaagcttggaagaattagcaggaaatggcggatgaggcgttgtttttgcttctccataacgagatggtgtctggagtgtacaagtccgcggacagggggaggtggaaaacggacgatgtattactaagctggaaaacatggggtttcgagtgggacaaggattgatagaaaggtttacaaaagatactgcaaggttcaagggat

SEQ ID NO: 17461 - DNA, 454 bp, Homo sapiens
aacttttgtttcttctgtgtcctccaggtgccagcaccccagatcccaactttctttacattcaaacaggccaagcaagggcttcttaaggacccgatgaaacttccgtggaaccacaatataccgtggttgtttgcacctcagagtttctcatctcggaatccagcgcccacattaattcagggcagcaaagaagctagakaygtgggaggctgtgcggttctgcgcaagtaagttttagagagcagaaacggtagggtcacagtcctttgttttkacctggaggaggaggakgagacctttcataccggcctaggggctcagcattkgaaagccacccagtttcccagactaccagggattttaaatgagtgggtcttgtttttgaatagatwttacaggagagtggtccgtgtggctccctggaagtacagagaaactacctccatgacat

SEQ ID NO: 17462 - DNA, 364 bp, Homo sapiens
tttactacttttggggtgaaaattttaaaaaatacatagtgctgggattacaggtgtgagtcaccatgctcagccagaaaaataaatcatttaaaaatcatgatttgcttctgaattgaatattgttttaagaactttttgatgattccagttgctactgctggtctccagcagtttcttagaatagtcaatggacacaagttatgttaaaatctctattaggccaggtgcagtggcacactcctgtaatcccagcactctggggcaccgaggtgggtggatcacttgagctcaggagtgttctagacaagcctgggcagaatggtgaaaccaccatctctacaaaaaaaaaaaaaaaaaagct

SEQ ID NO: 17463 - DNA, 477 bp, Homo sapiens
aacatctgactctccctccccaaagagagactccagcgagagactggggatttggaggtccaagtcatggcagaactgggttgcttgctaggacacaaggttagcatgcccctgtagcagcaatgtgagaatcagaaaaggtgactgtgcatctcaagaagccgaatcaaaaagccaagccaaccacctaaccagtgattttcaagccctccagaatacccatcatatagcccctgaggtggcatggtgatgtctccatgagggaaccccttcccactcatcctgtcacgtatatcatagtgttcttgactgggccattcatctaagatgggatttaccctgtgaaacaggaagaagacttatggaccccaagcatcatttcgagttgtagttgagtttttaaaagacatacatgcaaagttcctttgccttggaccctctgcattattaaagctgctgtattgctaacccaaaaaa

SEQ ID NO: 17464 - DNA, 874 bp, Homo sapiens
agacagaggcagggcttgcgacggaagtggcctctctgcttctgcagggctggggaagatgctgcgtccascgttaccgtggctgtaccttggcctctgcagcctcctggtgggggaggcagaggccccgagccccgtggatccgctggagcgagccggccgtacgcggtgctgcgagggcagaacctggtgttgatgggaaccattttcagcatcctgctggtgactgtcatccttatggcattttgtgtctacaagcccattcggcgtcggtgacagccagacaagttcttcaatgagtatttgggaataggataagttgtgttgcacacaggccagtggagaagttggaaccaaaactttcctacttggaaatgacctttggtctgggacagttggtaaatgctaaatgaattagaagaaaacatgtactagacattatttttttcctaacactgtagcgcaaataattggcccctgagtccgcttctcagtgtttctgactgtacttgttaaaagtaagacctgaaagctccaaaggtcagtgtaaagatggagtgttcatgagaaagaaaacatggtaaccttgtgagtgcctgtaagaaccacactgtaaagaactcatcattaatgcttgaaaatgttattaagaaggagacttaccatgcagacattccctatttaagaaccatttggttacagtgggttaagaatcacagatttttttttttaatctcacctgagttagcctagaatgcgctgtttgcaaagtggtgtcagctgtggggatcttgggccctcgttcctcacctgcatcctgccctgcactcaggtgctccccctgaagtcagggtcacactcaggtagacctgtt

SEQ ID NO: 17465 - DNA, 424 bp, Homo sapiens
  misc_feature 422: n=a, g, c or t
taacaattgatgtttgttttctgtttgattttaaacagagaaaaaataaaagggggtaatagctccttttttcttctttctttttttttttcatttcaaaattgctgccagtgttttcaatgatggacaacagagggatatgctgtagagtgttttattgcctagttgacaaagctgcttttgaatgctggtggttctatycctttgacactacgcacttttataatacatgttaatgctatatgacaaaatgctctgattcctagtgccaaaggttcaattcagtgtatataactgaacacactcatccatttgtgctttkgtttttttttatggtgcttaaagtaaagagcccatcctttgcaagtcatccatgttgtwacttaggcatttwatctkggctcaaattgttgaagaatggngg

SEQ ID NO: 17466 - DNA, 167 bp, Homo sapiens
ttatcttggctcaaattgttgaagaatggtggcttgtttcatggtttttgtatttgtgtctaatgcacgttttaacattatagacgcaatgcattgtgtagctagttttctggaaaagtcaatcttttaggaattgtttttcagatcttcaataaatgtttttcttt

SEQ ID NO: 17467 - DNA, 205 bp, Homo sapiens
tgtttggatctccgtaaacacatttttgttcttagtctatctcttgtacaaacgatgtgctttgaagatgttagtgtataacaattgatgtttgttttctgtttgattttaaacagagaaaaaataaaagggggtaatagctcctttttttcttctttctttttttttttcatttcaaaattgctgccagtgttttcaatgatgg

SEQ ID NO: 17468 - DNA, 521 bp, Homo sapiens
tatgtacaattatcagaaccaggaaagttcacattgatacaatagcaatgaccaacaataccataatctatagaccttactgaagttttgctaattgttattttggtgtggttgggttttttgtttgtttgagatagggtctcactctgtcacccaggctggagtacagtggcacagtcatagctcacttcaacctcaaactttgggcctcaagcgatcctcccgcctcagcctcccaaaggctatgattacaggcatgagccaccatgctggcctcatttcccctttccttctcaaaaggattctggctttccctactgcattcatccacgtccactacccgctccaagagagctgagtaattgtcaagccaggtttggggagctttcttgatggaggggatggaaggagggtggtgctcaggctacagcagggagagcttttctgtttttgagctaaagacataacagggtgcagaggctgagaaaaggagagttctaagcaacatgtcacgagctatg

SEQ ID NO: 17469 - DNA, 356 bp, Homo sapiens
aggcccgggagccgggaggtgcgggcggcgkcgctggacccgacgcggcgagagaggccccgagatgccgagcaagaagaagaagtacaacgcgcggttcccgccggcgcggatcaagaagatcatgcagacggacgaagagattgggaaggtggcggcggcggtgcctgtcatcatctcccgggcgctcgagctcttcctagagtcgctgttgaagaaggcctgccaggtgacccagtcgcaacgmrargaccatgaccacatcccacctgaagcagtgcatcgagctggagcagcagtttgacttcttgaaggacctggtggcatctgttcccgacatgcaggggggacgggga

SEQ ID NO: 17470 - DNA, 365 bp, Homo sapiens
  misc_feature 225: n=a, g, c or t
tttctccggggatgcccctkcctcccccagcacccccttaggacggtggcgacggggtctgaactctgctcccccacccgcagcgcgatcaagaagatcatgcagacggacgaagagattgggaaggtggcggcggcggtgcctgtcatcatctcccgggcgctcgagctcttcctagagtcgctgttgaagaaggcctgccaggtgacccagtcgcggaasvangaccatgaccacatcccacctgaagcagtgcatcgagctggagcagcagtttgacttcttgaaggacctggtggcatctgttcccgacatgcagggggacggggaagacaaccacatggatggggacaagggcgcccgca

SEQ ID NO: 17471 - DNA, 550 bp, Homo sapiens
caatctgtggaatgatattttgacactgtgacaatcctttttcccgacagtctttcacatagttgttttagtattcactgattcttacctgaatcagtaatagtatactatagtgattgtaaaaatggtgattttctatttctgtaatcccttatgtatttattatttggctttcttctctaaagaagatgtttctcttcctcctgcctccacacttactttcagatcagtgtggacttgttctgtttttaattcatatattaactcataattttatcctttatagtggtctggccgggcgcagtggctcacgcttgtaatcccagcactttgggaggccaaggcgggtagattatgaggtcaggagttcaagaccagcctggccaatatggtgaaaccccatctgtactaaaaatacaaaaattagcccagcgtggtggtacacacctgtagtgccgagagsagaaggttgcagtgagctgagatagtgccactgcactccagcctgggcaacagagccaagactctgtcccaaaaaaaaaaaaaaatg

SEQ ID NO: 17472 - DNA, 113 bp, Homo sapiens
aatacactgctgatgttcaaactgtgtccaagtaagacaaacgctgagctgagctgtaaccaatccagctatttctgtgccttactgctgatttctatcgtcactttactttt

SEQ ID NO: 17473 - DNA, 246 bp, Homo sapiens
ccagcgaggaaagctcggtgtgggcccgctctacgctccgtttggggtgacctggaacgcctcttctcccagctccctccagccatcagcagcctcttgtcaagcttctgcctcgccccagtctatccccaaccccaaatcaagaccacctttcttcacggtcactatttattctttgttcctttttctttttgtaagaaacattcacaaaaaccagtgcaaaacctaaaaaaaaaaaaaaaaaag

SEQ ID NO: 17474 - DNA, 440 bp, Homo sapiens
gtcacagtggaggttctagcagactaaccaggagatgcttcagaaggtcgaagttgagtatgaaacgctgcctgggtggaaascagacaccacaggcgccaggaggtgggaggacctgcccccacaggcccagaactacatccgctttgtggagaatcacgtgggagtcgcagtcaaatgggttggtgttggcaagtcaagagagtcgatgatccagctgttttagtcgcagactgagctgatcccaacaggccctggcagcgtctggacttgtgtaaacagcagcagtcacgttcctcggccgccacaaccaacaccaaagcaggaaaaccattttctgtacttttatatttctgttcaacctgttggtttctacaatgattttaaacattggaaagccagccttgtgtatatttttaaaaattatattcaaaatgagc

SEQ ID NO: 17475 - DNA, 460 bp, Homo sapiens
  misc_feature 445: n=a, g, c or t
aagaacataggtgacgtgtatggcgtggtgaaagcctataccacacgtgtgggcatcggggccttccccaccgagcagatcaacgagattggaggcctgctgcagacccgcggccacgagtggggagtgaccacaggcaggaagaggcgctgcggctggctcgacctgatgattctaagatatgctcacatggtcaacggattcactgcgtaasaacccatgctgccatccccactgggaccgtccctgactcccgacacctgcagaggctggccctgacgaagctggacatcctggacgtactgggtgaggttaaagtcggtgtctcatacaagctgaacgggaaaaggattccctatttcccagctaaccaggagatgcttcagaaggtcgaagttgagtatgaaacgctgcctgggtggaaagcagacaccacaggcgccangaggtgggaggacct

SEQ ID NO: 17476 - DNA, 318 bp, Homo sapiens
taaattttaaaagatcccgtgttttatgaaagtaaagaaataggttaacagtccccgtgacaagaatggaaaacattctcaggacctataccacacatatacatttaaagtatcactcagcctgggcaacatggtgagggcctgtctctacaaaaatttaaatcttagccaggcatggcggcacgtgcctgttgtcccaggttgaggcgggaggatcgcttgagcccaggaggtcaaggctgcagtgagctatgattgcgccactgcagtccagcctcggtgacagagtgagactctgtctcaaaaaaaaaaaaaaaa

SEQ ID NO: 17477 - DNA, 67 bp, Homo sapiens
ttgtcgtcagtcccttccatgcgtccatacctctggtggaagaagtacatcactcaggggcagctgc

SEQ ID NO: 17478 - DNA, 55 bp, Homo sapiens
  misc_feature 6,39: n=a, g, c or t
ttgtcngtcagtcccttccatgcgtccatacctctggtnggaagargtacatcac

SEQ ID NO: 17479 - DNA, 536 bp, Homo sapiens
agacgagggatgttattttgggcagtgcatctggacttggttcaagtggcaccagccaaatccctgccttactgacctctcccctggaggagcaggagcagtgctcaaggccgccctgggagggctgagaggcaggctctggactggggacacagggatagctgagccccagctgggggtggaagctgagccagggacagtcacagaggaacaagatcaagatgcgctttaactgagaagcccccaaggcagaggctgagaatcagaagacatttcagcagacatctacaaatctgaaggacaaaacatggttcaagcatctgggcacaggcgaacatacatatgatagttgagaaagacacatattctgatcatgaagaaataaacacaagttaaatatgactaagcagaaagatggaaggaccaggaatggtgatgctaacttggaaccacgatgcaggtctaaactcctctacaatcatcctcccttgtgagaaaaatacaacatacatatgatagttgagaagacacatatt

SEQ ID NO: 17480 - DNA, 476 bp, Homo sapiens
agagggatgttattttgggcagtgcatctggacttggttcaagtggcaccagccaaacccctgccttactgacctctcccctggaggagcaggagcagcgctcgaggccgccctgggagagctgagaggcaggctctggactggggacacagggatagctgagccccagctgggggtggaagctgagccagggacagtcacggaggaacaagatcaagatgcgctgtaactgggaagcccccaaggcggaggctgagaatcagagacatttcagcagagtcctggacagtcgcagcttaagttagcagcaagaggacttgaggttaaaggtatagcacgcaaatatgaggctggagccactgagtagaggctgagggcatctccacagtccaaagccgggctgcagacacggaagcatctacaaatctgaaagacaaaacatggttcaagcatccgggcacaggcggtccacccgt

SEQ ID NO: 17481 - DNA, 523 bp, Homo sapiens
aattattaaagggcgacgcgcgcaacgcacgttacacgcatcgcggagggagcggaggtggttgggtttctgagtttgagtctgtcgctcctggctctcccgacacaacagcggcgcccacctgcccgcaacggactcccaggagcctcgagctcctcatttccaaagctgaactgccccgtgtctgattccgatttctcttgagcgcgtttcggagccggcccagaacagagggaagccagacacaccatacccggcccaacagtggcagggcggctgygggtgctggtcaagctgggtcacccggcactgagtgacgatcagcaaatactcagtggacgaaatatttgcagtgcagtgaggtgaggggcataaccgcggastattttcgaagagatgagagagactggggattaggccaggcttgaagggaagaatggtttgagcaccgaggacaagaattaattccccaggcctgggttccagccttgtgcggctatcacgtgcttgaaacctggctatt

SEQ ID NO: 17482 - DNA, 466 bp, Homo sapiens
  misc_feature 426,434: n=a, g, c or t
aattattaaagggcgrcgcgcgcaacgcacgttacacgcatcgcggagggagcggaggtggttgggtttctgagtttgagtctgtcgctcctggctctcccgacacaacagcggcgcccacctgcccgcaacggactcccaggagcctcgagctcctcatttccaaagctgaactgccccgtgtctgattccgatttctcttgagcgcgtttcggagccggcccagaacagagggaagccagacacaccatacccggcccaacagtggcagggcggctgygggtgctggtcaagctgggtcacccggcactgagtgacgatcagcaaatactcagtggacgaaatatttgcagtgcagtgaggtgaggggcataaccgcggastatttcgaagagatgagagagactggggattaggccaggcttnaagggaanaatggtttgagcaatcgataccgtcgacctcg

SEQ ID NO: 17483 - DNA, 300 bp, Homo sapiens
  misc_feature 13: n=a, g, c or t
acacgcatcgcgnagggagcggaggtggttgggtttctgattccgatttctcttgagcgcgtttcggagccggcccagaacagagggaagccagacacaccatacccggcccaacagtggcagggcggctgcgggtgctggtcaagctgggtcacccggcactgagtgacgatcagcaaatactcagtggacgaaatatttgcagtgcagtgaggtgaggggcataaccgcggagtawttcgaagagatgagagagactggggattaggccaggcttgaagggaagaatggtttgaccac

SEQ ID NO: 17484 - DNA, 491 bp, Homo sapiens
taagttagcattctttaagaatacttgctcagtagtattcagagtatttactatctcaccttgaaaataaaacctcagttaaaatactataattagccaggtgcggtggctcatgccaataatcccagaactttgggaggctgaggcaggtggatcacttgaggccgggagtttaacaccagcctgggcaacatggcaggaccccatctgtactaaaaatacaaaaacttagccgggcatggtggcgcatgctggaatcccagctactcaggtggctgaggcatgagaattgcttgagcctgggaggcagaagttccagtgagctgagatcacaccactgcactccagcctgggtggcagagtgagactctgtctcaaaraaaacaaacaaacaaaaaaaactactatagataaaaatattggaaaataaggcggggtgtgctggcttatgcctgtaatccgagcactttgggaggctaaggtgggtggac

SEQ ID NO: 17485 - DNA, 470 bp, Homo sapiens
gctatgtgaagagatccttatgaaatacctcagaacccagcactcaagtgatgtggaccttctgcctgcatgctgctctcatgttccactgtgacatattcctagggcagcatctaggtgatattactctccacatctgcctgagccctgactacttgggacaccttgcaatatctctgagcccttgacctaagtgatgtggctcttttgttgcctgggccttcacgataggtggattttggcatattgctaagcccagcactcaaaacatgtaactctcctatttttcctgaattatacccacaaagaaaattttgacctactgaatggctcaacaccaaggttattatgatggttgtaatgaagatcatattagtataacggagctctatgtttctgaatactgaacaactatttataaaattttatcctactttttctctattaaaggtatgactgctctstctgat

SEQ ID NO: 17486 - DNA, 490 bp, Homo sapiens
gctatgtgaagagatccttatgaaatacctcagaacccagcactcaagtgatgtggaccttctgcctgcatgctgctctcatgttccactgtgacatattcctagggcagcatctaggtgatattactctccacatctgcctgagccctgactacttgggacaccttgcaatatctctgagcccttgacctaagtgatgtggctcttttgttgcctgggccttcacgataggtggattttggcatattgctaagcccagcactcaaaacatgtaactctcctatttttcctgaattatacccacaaagaaaattttgacctactgaatggctcaacaccaaggttattatgatggttgtaatgaagatcatattagtataacggagctctatgtttctgaatactgaacaactatttataaaattttatcctactttttctctattaaaggtatgactgctctgctctgataaacgaaaaaaaaaaaaaa

SEQ ID NO: 17487 - DNA, 415 bp, Homo sapiens
ctaagaattgggcaccaacaaatttgcactctaagaaatgttaaaggaggttcttcaggctagaagaaaataataccagatagaaacgttaaatgtccgctttaaaaacgaggagcatggccgggcacggtggcttacacctctaatcccagcactttgggaggctgaggcaggcagatcacctgaggtggggagtttgagactagcctgaccaacatggagaaaccccgtctctactaaaaatacaaaaaattagctgagagtggtggcgcatgctgtggtcccagctactctggaggctgaggcaggagaatcgcttgaacctgggaggtggaggttgtggtgagctgaggtcacgccactgcactccagcctgggcaacaagagtgaaactctgtcaaaaaaaaaaaaaaaa

SEQ ID NO: 17488 - DNA, 612 bp, Homo sapiens
aaaaagacgaaggggagcgcccaaggatgaggaacgttccaagacactgagtgatttgctgaaaatcacacatctagatgcaaagccagaatgtgagcagtgaccaccacacttgacaaatccgttgttgcacacatttgtactcttcaatcaacaaaacctgatgcaaaaaacagaaaagggggagatgtacatgcattttccctcactgcaaaaaaaacacaacttgtttaactacaggtgtgttcctggtggtctttgaatgaagacattgacagaaagtaacatagcatgctggttaaagactgtttttattcgaatcctggctttgcaatcaacagctgcataaattaaactctcgacctcagctcccttatttgtaaaacaagaataacaaaaagacatttttataaggttgggttgaaggttaaatgaaataacagaagattatctcttcactaattttagctgtagaaaacagaagccaatcgaaagagctcccagtccaaagctggaacaacttgaacaacaaaataaataatgtagcattggattacaaaccaaccataaaacaaatatccatgagtctatattgatgtcaataaatgaata

SEQ ID NO: 17489 - DNA, 432 bp, Homo sapiens
attatcgcagtattactgcaattatacagataccacaatttcagatattgatcagcgtgttcagttggtttctaaggaggtttacttacctcatggtacacctagtttgcatagtttgattatatttaactcttatgctaattgkgggaagtcattgatttattggacagatgcacctgtggtcttccctgagcacatcctggccaaggatgctgcccccaggagatttgagaagtcctgtaagatcatatcagtattttcaaatacttataaaaagccagagggattgacccagaattaccaatataagcttgaccctgagataacaatgccattttatgtttgcatgcataaaaccaatgcaagaggctgatgactccagatcccttatataagccaataaaaagtagtttcattttttatttcatttaa

SEQ ID NO: 17490 - DNA, 317 bp, Homo sapiens
agggacccgcagctcagctacagcacagatcagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggcttcagcaggagccctggactcatcatcaataaacactgttacagctaaaaaaaaaaaaaaaaaag

SEQ ID NO: 17491 - DNA, 362 bp, Homo sapiens
agtgagcgactaacgctagaaacagtgatgttctgaataccgcgtcatcgtggatgccaacaacctgaccgtggagatcgaaaacgagctgaacatcatccataagttcatccgggataagtactcaaagagattccctgaactggagtccttggtccccaatgcactggattacatccgcacggtcaaggagctgggcaacagcctggacaagtgcaagaacaatgagaacctgcagcagatcctcaccaatgccaccatcatggtcgtcagcgtcaccgsctycaccacccaggggcagcagctgtcggaggaggagctggagcggctggaggaggcctgcgacatggcgctggagctga

SEQ ID NO: 17492 - DNA, 379 bp, Homo sapiens
tttatgttgggtggatgaatttatgagggaatttttaacatgtgtgtatgtcttcaatctggtgacatctgatgtctccccaagtggttttttgaagtttttgagaattatttcgtaaatgacaatttcatgaaagattaaacactcaatttatgaaataaaatgaaatgtcttaaatctgtttttaaaaggcaatagtttttaactgttgtaagtggttgattttaactgaatatatggatttttcaacagaacaagacttaaagctgacatcagaggaagagtcacaaaggcttaaaggaagtgaaaatagccagccagaggcatggaaactcttaaatttaaacttttggtttaacgttttttttttttttttttt

SEQ ID NO: 17493 - DNA, 382 bp, Homo sapiens
  misc_feature 265..266: n=a, g, c or t
aataatatttgtgcttttaatctttttactgtagtacagctttatattctgtcctttaaaagtccttctactggctggtctgargggtagtgagttatctcagttgatcattcacagccagttacagattgaactccttgttctctactctttcccccttttcactactgtacttggctagtcttaaatttttttcttaataataaatacatttttgaaaagtctttttacttactctttatatttagtgtttaatgcactabmnnttgactattactgtttatctatatagcatcaaatagtaaatatagatcttatgctggaaatgtcaacctccctggcagctgtaacgcccatcattgaaagggaaagcggaggacac

SEQ ID NO: 17494 - DNA, 467 bp, Homo sapiens
acatgttgtgaatttggttggagtaaagatctaagggtccatactgggctataaaaatagtgtagtacttgagcagtactgtaaaaatggcaattataaataattatgagtgttgaggaggtaatatgaacactcaagttcaaagcagtaaaataaaaattaaaaaaaaaagacagacttaggtaagccatctatcaactcggagaatgctgatgctttgttgaaagagagctttgtcttacaaattaggcacttataaaaactcatcactcactgcagatgttactttaagacattctggagcagcgtcatgtgcaggaacaataaggaagtgagtgcttttgtaattcctgaacaactgtgtcttacacttactaagggattcatgggcaatatgactgaataggaacagctccagtctgaagctcccagtgagaccaacatagaaggcaatctgggtgttatga

SEQ ID NO: 17495 - DNA, 407 bp, Homo sapiens
agctggttttgaggaagtgagctgccatgtactaggccacgtggcaagggcctggttggggacctccaggggttgagagcatcctctggacaacatggaaaaagraratgaaaatggtgacctcagccctatagctagdrggaattgaatcctgtcaacaacgatactcatcactcactgcagatgttactttaagacattctggagcagcgtcatgtgcaggcagaaaatagtatcatctcagccttctatgaaatcaaggcaatattcatgtgaaagtatattccaaacccagaacctgagcacagattgggactgagaaacacttgtctagattgtcaggcaatctgtaacatcagcagtggatggaaagaaggagaaagawgagttttatggactctaaccca

SEQ ID NO: 17496 - DNA, 483 bp, Homo sapiens
ttctaaatgttttgtttatttgacctacctccccagctagttatttctgtggggaagcaccctcagttttggccgctgggcttctagacaggcccacagctaattgccctgtagagtagctgggtactgtgcttgtacagtgaaagatgacaatgcttttacaaataggtaatcagaaatggattctgttgaatgtatttgcatatatgatagtttaaaaggggatgaagagatgaggtcttagctcctaagaatcattctgtagggaaaggttggacaagggatcaatggaaagggaaataaagtaagggaaaagtgcggtcgggtattctggggttcagatccaatgtgagtcatttggagttggatgtgggtgactgggagaggagggaccaggcgtcccaaatagagcaagacttggggctgtgatagatttggctgcagcttagggatagcatagaatcagtaatagttgaaaaattt

SEQ ID NO: 17497 - DNA, 281 bp, Homo sapiens
aaggacacgggtcgctggcgggttaggtggctgcgtggccgcctcacttcgcgcacgsccgctagstggggggagttgatttgcactgctccgggtgtcggctccggcgggacgggcggttctgcgtacccctctccagtgtcacctggggctgaatcttcaacctgtcaaagccttcttaattatgtctgagaaaaggatcctgattgagtcaatgctttgcattctcagtcctctgcataaagctgagagatgcctacagctgagagtgaagcaaaagt

SEQ ID NO: 17498 - DNA, 521 bp, Homo sapiens
tgcccacctccccagtgagtgaccaatgtctcattgttaatgcatctgatgcacagagtttagtggtctgagggaggtcagtcgccaagcggagattgaaatcacatttgtatttacattattacttttctacagtttggtttgttgcaggctttcacactactaatctgggctgaatccttgaattactttgtctaccaagggtttcaaagaacttgataaacttgttctaattagccaacatattcatccatgttgtccgtataccaggtgtaaaaataaaacgtttcttaatgcacacaggacatggaaggcaatctacacattttcaggtgtagactttgcttgtgactcttttgtgaggaatagtcattgttactttaggaaaaccctgagtttatccaactcttgttagaattggataagtgtaaaaacctacaatagaatgcaagtgtgagagccaattcctctggtwaaataaactcatattattattcaaaaaaaaaaaaaaaaargcttta

SEQ ID NO: 17499 - DNA, 403 bp, Homo sapiens
  misc_feature 93: n=a, g, c or t
ggcacagagccgcagcttgctttcaggacacgggtcgctggcgggttaggtggctgcgtggccgcctcacttcgcgcacssccgctaggtggngggagttgatttgcactgctccgggtgtcggctccggcgggacgggcggttctgcgtacccctctcctggcagatacataactataagagagcattggcttggtcctccaaagctagcagtttggtgggagttacagaacattttaccagggtgaaaattcaaggttgaggtagagggagctacaaagattaaggcaccctggaagcacagaagagaagttcttaaatgcccttcaaggatctgattgagtcaatgctttgcattctcagtctctgcataaagctgagagatgcctacagctgagagtga

SEQ ID NO: 17500 - DNA, 92 bp, Homo sapiens
aatcagttcccaagttctaggcggaagaggcccaagagacaccactttctcgctttcagacgtgtctacataagaccacaaaagaaaccgag

SEQ ID NO: 17501 - DNA, 103 bp, Homo sapiens
aatcagttcccaagttctaggcggaagaggcccaagagacaccactttctcgctttcagacgtgtctacataagaccacaaaagaaaccgaggcaaaaacaaa

SEQ ID NO: 17502 - DNA, 137 bp, Homo sapiens
aatcagttcccaagttctaggcggaagaggcccaagagacaccactttctcgctttcagacgtgtctacataagaccacaaaagaaaccgaggcaaaaacaaaaaaaaaaaaaaaaaaaaaaaaaaaaaaaaaaaaa

SEQ ID NO: 17503 - DNA, 126 bp, Homo sapiens
aatcagttcccaagttctaggcggaagaggcccaagagacaccactttctcgctttcagacgtgtctacataagaccacaaaagaaaccgaggcaaaaacaaaaaaaaaaaaaaaaaaaaaaaaar

SEQ ID NO: 17504 - DNA, 492 bp, Homo sapiens
tgaaaatagacctttgaactaacattttcataataaaatgtctttcactttgacttttaaatggcagtgtatattatttctaaactaaaagtttaatattttcccatgtggcactttaaggtcttattatctatcttttggtaggtagctatgtggattcattttctgcataggmagaatcctaagtctaggtaagagtcagataaatttagaagctggctgacattcttagtaagctgccttgtatttttcaaacttgtcccatactcttctgagattaagaaaagttgcatacatccaatttgtttcaggcagaacttgagatgaggataaaaggggattgaatggttacttcccaccattcctgactaggcacaccctcctccatgtagaactgtctctaactttgagctttgagagaagaggtaggcaagtgagcagtgtttctcaattttacatattccggaataggaggaatggattaaagtcacc

SEQ ID NO: 17505 - DNA, 63 bp, Homo sapiens
ttgtgacaagatcttcccagctacagagaagcagatctttgaagaccacgtgttctgccactc

SEQ ID NO: 17506 - DNA, 92 bp, Homo sapiens
ggaagttgtgctcttggtgaagggggttcttccttttttatttaccggtggctgtgcttccaatttaggaagaccccggcgacctgttcctc

SEQ ID NO: 17507 - DNA, 530 bp, Homo sapiens
atttgtcttgacggatagtaaaaagaacaaacttgttttatacaaaatcagatgctccaaatggtcagttgatgatgataccaatcaaagaaaactaaggaggaagaaaaagaaaacaggaaagagaggaggcaacaggaaaatcggccttcktccttcagtctacgcttgaaattgccagggatggataaatctgaagatgaatgaaaaaaagaaactactgggaacggaacagaaacaaaaaaaaggatgggaaatctgaagctgctatttcttattctgatcttaatagcaggatacagttgaataataacattatctattggagatcactgaaatgtagggagggaattccattttgaaaactttaatatgtagagagtcagtacatcattttcacaagcaatatccttagaagaaaggattttttttagaactatcatgctacagaaaactgcatttttatagtaactgaaagatgcaaagttactgaaaaaataaaactgccattttattgtaaaaaaaaaaaa

SEQ ID NO: 17508 - DNA, 446 bp, Homo sapiens
gtcggaaggtggcgagcctgaggcgaacaatggcggastgggcgaasgatgaagcggagttgcagcgcctggtggccgccgagcagcagaaggcgcagtttactgcacaggtgcatcacttcatggagttatgttgggataaatgtgtggagaagccagggaatcgcctagactctcgcactgaaaattgtctctccagctgtgtagaccgcttcattgacaccactcttgccatcaccagtcggtttgcccagattgtacagaaaggagggcagtaggccatcccccaggagaatgacagaagcaaaggacttgttactaagcagatttaagggtcagtgggggaaggctatcaacccattgtcagatcagcatcaggctgttatcaagtctgttggtgctaaaaagtaaaagatgaaatgtccaaaaaaaaaaaaaaaaaagct

SEQ ID NO: 17509 - DNA, 514 bp, Homo sapiens
ccacagatacacacacatttaccacacttggctcttatagactggaaggacagatgctcttcctgagcaaaggggccgacctgcagaaagcttccctctcaaagctgattgacaccacccaagctcctctcctaggccttccccactgagggctttggggctgcagggccctgtccacgagacaaagtctcactctgctgtccaggctggagtgcagtggcgcgatctcggctcactgcaacctctgcctcccaggttcaagcgattctcctgcctcagcctctcaagtagctgggactacagtatcctgcataaaactgcattaaaaaccagtaacatcagacccgggatggggacggaaggtccaaatcagaacctccatggaatgcatctctacatattttcacatctgttttcaagcaaggagcaagagcagcaagaaagtgaggacttcctctgatgcacaaacctgggatgtgctgtgcaaatcagctacctgggcttcccacctgtg

SEQ ID NO: 17510 - DNA, 120 bp, Homo sapiens
aacacacacatttaccacacttggctcttatagactggaaggacagatgctcttcctgagcaaaggggccgacctgcagaaaggtaacaaagcaccacattagatactgaagatagaaat

SEQ ID NO: 17511 - DNA, 522 bp, Homo sapiens
  misc_feature 459: n=a, g, c or t
agagaagccagctacacctacattagaaagagtggaacagatcacgggtcacaggattaaggctagatggggtttgagatgtgggaagacttgaggtcattttgagttttgagaaaaggagagacatgaagaggcagaaaacatgtttactggacccagctactttgcagtgattagtgggaccttcagaacataaatagatcctaaggagtgaatgcttgtaccccttccaaaatttatatgctgaagcctttatatggttgtatgtaaagacagacccactaatgaagtaattaaggttaaatggagtcataagagagaggccctaattccataagattagtgtccttataagaagagactccagagaactcactttctcactctctccctccctttccttgcatacaaaccaagggaaaatcatatgagaacatagcaagaaggtagctgtctganagccaggaagagaggcctcagcaggaaatgaatcagcaagaaccttgatcttggacttctagc

SEQ ID NO: 17512 - DNA, 546 bp, Homo sapiens
acttatagtggtatctgtctgtacagctactggtgcctggaactggttaatagaccctgagacacaaaaggtgtccttcttcacatcattatggaatcacccatttttcaccattagctgtatcactctaataggcttgttctttgctggaatacacaagagagtagttgcaccatcaattatagctgctcgatgtcgaacggtattagcagaatacaatatgtcttgtgatgatacaggaaaactaattttgaaacctaggcctcatgttcaatgacaatcttcactcattgttatgggacttaaaatagcctttcttcgaataagtgatacagcaaaaagccataaaggattccttttgcggttggatatgtaaaggtcatagcagcaactgamcagaagtgtgcaatatttacctggattatcttgatgatggtgactcattatcagtgctttggtacttttgattacctgtgtttcagtattagtgtcactttagtacttcagatcctgcaaatatttttgcagatgaagtatgtatgtatg

SEQ ID NO: 17513 - DNA, 483 bp, Homo sapiens
aatttcttaaatcatggtctgtcactgaatctggttataaaaccttatcttgcactagaaggatctgtagcttttccagctgagaatggggttcaggataccgaatcaacacaagaaaagagagaaactggggatgaagaaaactcagctaaatttcctgtaggaaggagagattttgacatattctcagaccacttctaccaaaacataaatctgtgattgtgatctctgaaagtcagtccttttatctactcaataccttgcacagtaccttgaactttgtaaatacttcaaaaataaaacttgcttcaaatttcatctaatttaatacagaggcattatcctttgaaagcgataggtggctctggcctcccgctcctcttggatccatcagtactagccttaagctattgtgccctctcaaagactcaagccacatccaagcaatactccttccagagatggctgattactaactctgca

SEQ ID NO: 17514 - DNA, 415 bp, Homo sapiens
attgcctcgctgctttcttttcttcaagacgggctgaggattgtacagctctaggcggagttggggctcttcggatcgcttagattctcctctttgctgcatttccccccacgtcctcgttctcccgcgtctgcctgcggacccggagaagggagaatggagagggggctgcgctcctctgcgccgtgctcgssytcgtcctcgccccggccggcgcttttcgcaacgataaatgtggcgatactataaaaattgaaagccccgggtaccttacaactcctggttatcctcattcttatcacccaagtgaaaaatgcgaatggctgataaggctccggacccataccagagaattatgatcaacttcaaccctcamttcgatttggaggacagagactgcaagtatgactacgtg

SEQ ID NO: 17515 - DNA, 490 bp, Homo sapiens
ttttattacaaattttcactgctgctcctctttcccctcctttgtcttttttttcatccttttttctcttctgtccatcagtgcatgacgtttaaggccacgtatagtcctagctgacgccaataataaaaaacaagaaaccaagtgggctggtattctctctatgcaaaatgtctgttttagttggaatgactgaaagaagaacagctgttcctgtgttcttcgtatatacacacaaaaaggagcgggcagggccgctcgatgcctttgctgtttagcttcctccagaggaggggacttgtaggaatctgccttccagcccagacccccagtgtattttgtccaagttcacagtagagtagggtagaaggaaagcatgtctctgcttccatggcttcctgagaaagcccacctgggctgggcgcggtggctcacgcctgtaatcccagcactttgggaggccaaggtgggcggatcacaaggtcaggag

SEQ ID NO: 17516 - DNA, 444 bp, Homo sapiens
  misc_feature 115..117: n=a, g, c or t
aaaaaacagcagacgctgagccctggcctggccgcccgttctcctcgttctagccatctcttagggacggggctgcagcataggagtctcagctgcttacatccaggtccaggannntgtctgctaacagacgctggtgggtaccacctgacgacgaagactgtgtgtctgagaagctcctgaggaagactcgggaatctccactggtgcctataggcttaggaggctgcttggtggtascagcatacaggatttaccggctgaggtctcgtggttccaccaagatgtccatacacctgattcacacccgagtggcagcgcaggcctgtgcagtgggtgcaatcatgctaggtgctgtgtacacaatgtacagcgattacgtcaagaggatggcacaggatgctggagagaagtaggactcctataggagccggggctgtccaa

SEQ ID NO: 17517 - DNA, 492 bp, Homo sapiens
ctaaagagttgtaatgtacaatcaggagaagatacatactatgcttaagtatggtatattcttratagcatgggtagttgagggagagatagtaaaaataaaatgaccagctaaaacttagatcttatttatgtacatatttaaatacacatttcacaaagcatataaatttcaaaatggaggtgaagatgaggagatattaatgacaatataaatagttggtgtgggaagcctgattaaaattaaccagaaaatcaaaaggtattaagactagaagggctgtcatttgaagacaagaaggagctattttgaaaatgtagggtcagctgggtgcagtggctcacacctgtaatcccagcactttgtggggccgaggcaggcggatcacttgagatgaggagttcgagaccagcttggcgaacatggcaaagcccatctctactaaaaatttaaaaattagctgggcacagctgggcaacagagcaagactcc

SEQ ID NO: 17518 - DNA, 578 bp, Homo sapiens
tcacagagctaaagaaatgatgtcaaattagtcacattaagctatagtagaaggaattggacacttctccagatatttggcttcaaaggagtacctttacttacatgtgctttatggtaagtacattgaattttactttaaatgcattttactacaaagcacaattcatttgtaatgcatatccatcttggattcaatccaaggtgctttagctatcagtagtaccaaaggatctttttacaaggcttcctgtggtattgactctgagaataacacatagtgaagatctgtgggcttttaaaattgttcacagccaatttaagaagacccctcatgaagtctcagttttcagtacagtacatcattcctcctcactaggagcactttgatgtaaccagaatagctttaaaaagacaaaaaggatcgtagatctgatttttaaatggttggttgctctgacagatctgaacactttgcttcatgactatttcgtcataaaggtatatgtttaaaatctgaatggcagtactagctctatacttttaatactgctttgtattttatatgtaaagtagtat

SEQ ID NO: 17519 - DNA, 512 bp, Homo sapiens
  misc_feature 59..60: n=a, g, c or t
gtgctttcgcttcatcctagaggctaaatgggctcccctggactcgcctggcagaactnnccacctagaagaacgttattgtaagggggaaatgcaaacagggtgaagacaagaggcataggtgatggacactaaaacaaagaccctgtggaccccaaagtcatttccattgccaaccgagtagctgaaattgtttattcctggccaccaccacaagcgacccaggcaggaggcttcaagtccaaagagatttttgactgagggtctctccttccagctccaaggccacgtgcctgtagcttcaagttctaagaaagatgaagaagaacaaatactaaccaaaattgttgagctgctgaaatattcaggagatcagttggaaagaaaggaaaaagaatgggaggagtcagcaaagaccaagataaaaatggcacttctctggaggagcattggtggtggacccagagttctgagtatacctgaggcatttatgaagaacagcttcactctca

SEQ ID NO: 17520 - DNA, 394 bp, Homo sapiens
cccacccaggctcggagcgcgaggtccccaggtgggccccaaccgccggatcctgcccttctgcactggggcccagccgcctcccggcctttcctccctcccccaggagatgagacgtatcttgacatcttccgcgacttctccctcatggcgtcagacgacccggagaagctgagccgtcgcagtcatgacctccacacgctgtgacccgaggcccacggggccgcgcctgcctcccttccccgccaccgggccctctgccattaaagcctccgtgcttctggcggccccttgatagttcacaagagaagtcgtttcattcaagttggtgtaatcagctggggagtagaggatgtctgcaaaaaccagaagcggcaaaagcaggtacctgstc

SEQ ID NO: 17521 - DNA, 567 bp, Homo sapiens
gactattatgatctgtaccccaccccgacgcacgccaagcggctttttccccatttgtggccaaatttcccggcatggggaaggagccttaggggaagcacccgggacctccttggcttcttctgggagtctagtttcacctatttcgtttcgccaacaggsagacgggcaagacttcgggctcagctgccaccatcagtactgacctgtccatggctaaagccttttccacacacaaccaaagttggctgcagtttagctaccgcgttttagccttcccgctctccggaagcaagcccttcgacccggaagcagtctgtccctaaaacagacccacagaaaaggggtaggggagaagaaacaacgttcccatctagcgcatgcgcgacttcagcctacaggtgcacgcccggtgggcwaggcgcaaaagtttgccaatgtgttcctggttgcgtttasccagacgccctgcggccgctttgcctgaccaaagtctgtgggcgtggaacaggccctgggttctcctactgggaagaatgaagttcaggtactccatgtgatatatgg

SEQ ID NO: 17522 - DNA, 561 bp, Homo sapiens
gactattatgatctgtaccccaccccgacgcacgccaagcggctttttccccatttgtggccaaatttcccggcatggggaaggagccttaggggaagcacccgggacctccttggcttcttctgggagtctagtttcacctatttcgtttcgccaacaggsagacgggcaagacttcgggctcagctgccaccatcagtactgacctgtccatggctaaagccttttccacacacaaccaaagttggctgcagtttagctaccgcgttttagccttcccgctctccggaagcaagcccttcgacccggaagcagtctgtccctaaaacagacccacagaaaaggggtaggggagaagaaacaacgttcccatctagcgcatgcgcgacttcagcctacaggtgcacgcccggtgggscaggcgcaaaagtttgccaatgtgttcctggttgcgtttagcccagacgccctgcggccgctttgcctgaccaaagtctgtgggcgtggaacaggccctgggttctcctactgggaagaatgaagtatgttgatagtctggaa

SEQ ID NO: 17523 - DNA, 415 bp, Homo sapiens
ctctagtcatcgccctcgcagcggcggccaacatcaccgccactgccacccctcccagactgtggacgggaggatggagtcgatggccgtcgctaccgacgggggagagkccgggggtcccagcggctcaggtctgtcggcttcccagcgtcgggcggastgcgtcggagaaagctgctcatgaactcggaacagcgcatcaaccggatcatgggctttcacaggcccgggagcggcgcgtaagaagaaagtcaaacaaaatcaaagcagcaggacagtgataaactgaactccctcagcgttccttccgtttcaaagcgagtagtgctgggtgattcagtcagtacaggaacaactgaccagcagggtggtgtggccgaggtaaaggggcccaactgggagacaaattggactc

SEQ ID NO: 17524 - DNA, 458 bp, Homo sapiens
  misc_feature 241: n=a, g, c or t
ctctagtcatcgccctcgcagcggcggccaacatcaccgccactgccacccctcccagactgtggacgggaggatggagtcgatggccgtcgctaccgacgggggagaggccgggggtcccagcggctcaggtctgtcggcttcccagcgtcgggcggastgcgtcggagaaagctgctcatgaactcggaacagcgcatcaaccggatcatgggctttcacaggcccgggagcggcgcgntccatatttgctccatttcttactttacaacttgcgtacatgggattatacaaatattttcccaagagtgaaaagaagataaagacaacagtactaacagctgcacttctattgtcgggaattcctgccgaagtgataaatcgatcaatggatacctatagcaaaatgggcgaagtcttcacagatctctgtggtctactttttcacttttatcttt

SEQ ID NO: 17525 - DNA, 580 bp, Homo sapiens
aaaaaaatttagatttccgtctgtttgtttattcagggatctaaactagagtgcaggaacaatgaggaattccactgttaccacacatctaagccatgttctccatgctgttaccttctcatactcatagtttgatctctttctgcctagctctcatgtctgtctctggattgtttcaaatcctaagagaaaaggaatatcatttattgcctcttgcaaagtaaatactcctctatttaactgacgggatgaaccaatgatgtcatttaacagtttgtttgttggtgatctctactgctgaaatctcattaacatacacatttactcctttgatcttcacgataatcccatggaattggcaagtaaaaggcattattgacattttacagctttttcaggagttaagctgccttcgcaatgaggatcaaacctgcagcttacagcttatagactcgatgtatgtaagcaaaatggggaattgccaagtctaccttaaaatggccatttgccatacagttacttgatagacccattaaattccagtaaattcaaaatgttccaatgtggctaattattccag

SEQ ID NO: 17526 - DNA, 514 bp, Homo sapiens
atctaagccatgttctccatgctgttaccttctyatactcatagtttgatctctttctgcctagctctcatgtctgtctctggattgtttcaaatcgtaagagaaaaggaatatcatttattgcctcttgcaaagtaaatactcctctatttaactgacgggatgaaccaatgatgtcatttaacagtttgtttgttggtgatctctactgctgaaatctcattaacatacacatttactcctttgatcttcacgataatcccatggaattggcaagtaaaaggcattattgacattttacagactgtgaacaagatgccacccccaaatgatgtagtcaatggtgctaccaaaatctactgcaaataacctaataattgtacacagacatcttgacataggccagttctcaacaacagtaaaattttgagcctggagtatgagagctgtagaaaggacagcagaaaagaagcattgaaaataaataaaaactggtcaggggaaatttgacagt

SEQ ID NO: 17527 - DNA, 487 bp, Homo sapiens
atctaagccatgttctccatgctgttaccttctcatactcatagtttgatctctttctgcctagctctcatgtctgtctctggattgtttcaaatcctaagagaaaaggaatatcatttattgcctcttgcaaagtaaatactcctctatttaactgacgggatgaaccaatgatgtcatttaacagtttgtttgttggtgatctctactgctgaaatctcattaacatacacatttactcctttgatcttcacgataatcccatggaattggcaagtaaaaggcattattgacattttacaggaattccttctgtcctgttaagcagtccttcgctttctgcttttggatacttaagtgaccacctcacttttttgtgatgcagcttgttcaatttttggatagttctcgtggacacatggaaatgctgagtagaactatgatacaaatcagctcaccataaagtacaatctccagtggccagaga

SEQ ID NO: 17528 - DNA, 209 bp, Homo sapiens
  misc_feature 174: n=a, g, c or t
gactggatgcatccgctagtactgatttacgaagagaatgatcatgaagggcaaatggcagtgaagcaagaagagctggcttcaggctcagaagagaatgctgtgcctctttttcgcatttttttttttttttwttgatcacatcaaacattttcattgagaaattgacacggncactaatgaggtttatcatggatggtctcagaagc

SEQ ID NO: 17529 - DNA, 381 bp, Homo sapiens
  misc_feature 136,170,172: n=a, g, c or t
acaagaccgttgaggctgccaggcgagtcaggcctttctggacctcgcctgactcggctgggctgtgctgaaattgacccagctctatcagggattatgaaaaaacaaggagtaagcccgaagccgctgcaatctncccrccccagccagtctaagcggcggtgcgggcntncccccttsccccccgcctccgccccggagccggagtagaggaggtggaaaagtcggccctaggcggcgggaggtccttccggcggaggatccgaaatgtggaaaatcgaaaaggcttggagctaaaggtggtggscaagacccttcttstcggccccttcctgttggtssgtaattccctggcgsatccggraagaggtgcacgaactg

SEQ ID NO: 17530 - DNA, 425 bp, Homo sapiens
acatctgcattccgatagaaagggaaacagcagaaacacaatacccatctgagagctacgcttagagaggactctgggcttttatttatttttttacttcagtcttgtgaccagtaattttaagggaaagccaataataatgtttttaaaaagcctcacgccacccctggcggcatctcctcggtgtactttgctgttcagatccgcctgccttctgtgccagcctaacagcgcccggcctcagcccccattgtccctggagctggcgaggtgtccggttgcggascggcggcgtcctctggaaatgcatcctgcatccccgcatggataacagctgcagctatgtcagaattgcacaaagaggggagagtgtcattgtgtgccttttgacacatacattaagaccaaaaaaaaaaaaaaaaaag

SEQ ID NO: 17531 - DNA, 449 bp, Homo sapiens
  misc_feature 396: n=a, g, c or t
agccccaagggggattttgtgggaccgctgcccacagatccaggtgttggaagggcagcgggtaaggttcccaagccagccccaacacccttcccacttggcacccagaggggctgtgggtggaggcctgactccaggctctcctgcccacaccctctggactgagttccttctttcccttggacgcccagtgctggccttggaggacggtcagctggaggatggcggtgggggaggctgtctttgtaccactgcagcatcccccacttctccacggaagccccatcccaaagctgctgcctggccccttgctgtaaagtgtgaagggggcggctgagttctcttaggacccagagccagggccctcaacttccatcctgcgggaggccttggcgngcactgccagtgtcttccagagccacacccagggaccacgggaggatcctgac

SEQ ID NO: 17532 - DNA, 236 bp, Homo sapiens
acagagtgtgtgtgggaacaarsggccttctcagtgttcatagggaagcccggttcacccatgggtgggccgcaatttgggtgccacagtgagcccctagagaccagctctcccagcttccaggacagggactaggggaggcaagagaggctcttccttaaattgtgcacccaaggtsctcagctgccttactctagactggccccgttaactccccaaaaaaaaaaaaaaaaaag

SEQ ID NO: 17533 - DNA, 517 bp, Homo sapiens
tatacagacagggtctcgttatgttgacaaggctggtcttgaattcctggcctcaagtaatcctcccacttcagcctcccaatatgctgggattacaggcatgaggcgccaagcctggcactggttttgtttttgttcttgtttgtatccctcaatggacatgtgtatcacagaaatagaacttgataaatacttgttaaataatgaactaaattaatgttttaattatggaatattattctaaagatgtttaggaaaagaataagtggtcagttttagtaactttgtaagttaaatttttgttacattgctgtcatacctgtttcaatatttgatattcttaattgcagagttgaagtaagcagtaaaattcagtatcgtaaagaacaacagcaacaacaaatgtggaattcagccaggactcccaatcttgtaaaacattctccatctgaagataagatgtccccagcatctcbaatagatgatatcgaaagaggtaaaatctaagtatatgtaa

SEQ ID NO: 17534 - DNA, 485 bp, Homo sapiens
aattatcctgcctcagcctcccaagtagctgggactacaggctcacgctgccacgcccggctaatttcttctgtattttagtagggacggggtttcaccctgttgcccaggcttgtctcgaactcctgaactcaggcaatccttccgccttggcctcccaaagtactgggattacaggcgtgacactgcgccccgccatttttaaagtacagactctgattcagtaggtctggggtgggacctgaaatttacatttctaacaacctcttagaagatcctgatgctgcagggctgatgtttatattgagcatgacaaaatttaaagggaacatttgggaaacaccccacagtatatatcactgttgatgtttatttaaagggaatatttaaaaaaaaatctgctttcttaggaaaactgtagtaaaaggaatcccatgaagttacaaaarggaaatgattagctgcagataaatgatcattgaaat

SEQ ID NO: 17535 - DNA, 243 bp, Homo sapiens
agaatgtcgtactctcaggaggctccaccatgttcagggatttcggacgccgactgcagagggatttgaagagagtggtggatgctaggctgaggctcagcgaggagctcagcgcgggaggatcaagccgaagcctgtggaggtccaggtggtcacgcatcacatgcagcgctacgccgtgtggttcggaggctccatgctggcctcgactcccgagtttctttcaggtctgccacaccaaga

SEQ ID NO: 17536 - DNA, 352 bp, Homo sapiens
  misc_feature 289,338: n=a, g, c or t
cccatactcaaaatacccagtttagcaagcaactgagatttaagtctctctggccctaagaggtttttcctctttgctccctccaatcttgagattgggttttgctttagagtgcaagtatcataattccgtatgatagatggggcctggacacccatctcaacagggtcacttggtaattaacaatagccatataaatgcggatacaggttactaccctcaccctttaccttcctcaggtaacagtcgtagataccagctttttttttttttttttwaawttggyttnggcacagtagctaaagtgcaagastgawttaatgagaagatatattarntgtagtmatagggg

SEQ ID NO: 17537 - DNA, 589 bp, Homo sapiens
tacataatgtctaaatctgctggtgtagaagttaataaagtgtagaactgaataaatattaaatattagatcaagtttctcatgtttatcttaacgtataacgatttatcttaaagcactgattttcacaaaataacatcagtgtgaaattggaaaagaagccaaatattttatttcacagtatctgggaaatgaggtgctttagtcaactgaatctgcccaaaactaaaaagcattaattaaaaagtacttaactcagaaattataaaaataggagacatcaataaaatacattctacacagaatacgccaaccatacactactcttttttgataataaaaaatgtatttactgagccagttgtggtggctcacgcctataatcccagcaccttggaaggccaatgagagtggatcagttgaggccaggagtttgagaccagcctggccaacatggtgaaatgccgtctctactaagaatacaaaaatgagccgggcacggtggcacgcaccttgtaatcccaggtactccgaagatgaggcaggataattgtttgaactcaggaggtggagggttgcagtgagccaa

SEQ ID NO: 17538 - DNA, 483 bp, Homo sapiens
tacataatgtctaaatctgctggtgtagaagttaataaagtgtagaactgaataaatattaaatattagatcaagtttctcatgtttatcttaacgtataacgatttatcttaaagcactgattttcacaaaataacatcagtgtgaaattggaaaagaagccaaatattttatttcacgtatctgggaaatgaggtgctttagtcaactgaatctgcccaaaactaaaaagcattaattaaaaagtacttaactcagaaattataaaaataggagacatcaataaaatacattctacacagaatacgccaaccatacactactcttttttgataataaaaaatgtatttactgagccagttgtggtggctcacgcctataatcccagcaccttggaaggccaatgagagtggatcagttgaggccaggagtttgagaccagcctggccaacatggtgaaatgccgtctctactaaagaatac

SEQ ID NO: 17539 - DNA, 544 bp, Homo sapiens
tgttcctgcagcacctaatgtaaagtgccttgcmagggtaggtgctcatgacgtgtagaatgagtgagtaacttcctgcctcataaggatgaaatgtggttcacttcccctgtgttcaacactacaaagctactcctgccagaagagggcagagttctttcttgggtttgaactggcttttttgggttgaaccagatcatcccacatccttagcactacttaaccttcttttcctgaagattacatatcagtgtcctgcgtttttatctaatattagagctgaggttcctaggaaaattttgaagtggggaagattatggagaaaatgaaatcgcaaatttggggagggtggtttgtcagtataaggccctgtggggtaatcatattttagttattacttgttaaaagggtaacagaacctctgtttctttaccaagtcgctggttggccatttctccaattgatgaactaccattggttttagctctttctcatttgggattccctcaatttgcttacatgattctggtacttagagtctaat

SEQ ID NO: 17540 - DNA, 394 bp, Homo sapiens
tgccacaactgcttctaaggcctcctccttctcctcctcctcttcctcttcctccttttccttctcctcctcctctcttcccagtgacagcatcatcgtgctgtttgcctgtattggctatgcttctaactccaaccagtcacttgagaatattctttcaagattctgggccccgattcttttctgtttaaatccctaaagcaaagatctaattctcaagcaatgtctgtagttcagtgggggtgaacaatgaatatattcatgctaggaatttgtgtctgttgttgtactcacagcagcaacatgagtgtaaacagtagacaataaacttttatttaagaaaactgattcagttgtgttggaaaaaataaagaaatctgatactaaaaaaaaa

SEQ ID NO: 17541 - DNA, 424 bp, Homo sapiens
atcatttggtccaggacaggcagtaggcgtcagggggcgccctaaggctccacggcatgtgcctgtattgctgggacatcgagccttcccaagtcaaccctgaaggaccaagacaacatcatccttcagaggtcactgagcggcasttgcaaataaacgtattcagaatatgcaacacctaaagaaagagaagaggagactgaataaaaggttttcaaggccttctcctattccagaaccaggactcctatggtcatcttgataaagcaggagtctatttgaaggaaaccatgctccagacagaaatatgtggattgtgaacatcaagtgacatatcatgaattgatcatccacaaaataaatgcaatactccaccatttcggaaaaataaacacagtgcaagtatttaaaaaaaaaaaaaaaa

SEQ ID NO: 17542 - DNA, 481 bp, Homo sapiens
agaatcttcgtgagagaagcgtctcagttcattggaacgagtagatataagcctcgaccggtttgagaaataaagggacagagtacaaaagagagaaattttaaagctgggcatccgggggtgacatcacatgtcggtaggttccatgatgccccacaagccgcaaaaccagatgatgttctamaracttcgagaatctagtggcatctaatatggaatgattcttccaggaagacgtttgtaatgctcactcaggaaatatcagtgaatacttcagaaagcttaatttctttacaacagaagctcgtatataaaatttaatttttaataaaaccttttctcagtatgttggcctttttgtcccctgcgatcccaaagacaatggaatgccccctgggatcccaaagacaatggaatgcaaatactakwaacttttcacaacttagatctactgtagcttttttcccaacacaattgtgaa

SEQ ID NO: 17543 - DNA, 400 bp, Homo sapiens
catgattatgttagattgtggatatttagaaagaatatcacgcaagggaagtgcttttcttaccatatcaagaaaagggtatgatattaacattatttattaccagtgatttgaactttgatcacttgggtaaggtggtgtctgccaggtttctccactgtaaagttactatttttacttttccatcatggatctgttagaagcccagctcacccttagggtagggragctaagctctgccttcttgagagagaagtaccaaataatttgcaggcatgtttaaaccaccatatagatattttcggggagatactttgatactatttctccttaaaggtttgactagtaattttagcattcatatgtatttttttttttycctgtaggatcagttgycttt

SEQ ID NO: 17544 - DNA, 468 bp, Homo sapiens
tgaacatgtcatcattccccggattgaacgtactcttgcttatatcatcacagagctggatgagagagagcgagaagagttctataggttaaagaaaatacaagagaagaaaaagattctaaaggaaaaatctgagaaggacttggagcaaaggagagcagctggagaggtgttggagcctgctaatcttctggctgaagagaaggacgaggatcttctatttgaataatctttcctgttctggttctttgagaaaccctaacactggcttcattttaattcacagtgtttaggtttgatttgtgtggctatttattttttggcctaagaatttcactggttgtaaaatttacctagatgtctatttatgggattacttttgcagaatcataatttagcaaccatttatcatggatgaaagagatctgtaaaacctgcccaggaacttacmgaatttactttgcagaa

SEQ ID NO: 17545 - DNA, 257 bp, Homo sapiens
agagacgtgaackgtcgttgcagagattgcgggcggctgagacgcgcctgcctggcacctaggagcgcgckragccccgacaccgccgccgccgccatrgagtccgagaccgaacccgagcccgtcacgctcctggtgaagagccccaaccagcgccaccgcgacttggagctgagtggcgaccgcggctggagtgtgggccacctcaaggcccacctgagccgygtctaccccsagcgtccgcgtccagaggacca

SEQ ID NO: 17546 - DNA, 502 bp, Homo sapiens
aaactgaccctaatcttggacattagtaataaaaggcacatattaataaaagacacattgacctagattatgtttaacaaaactttaagttatttaaattatgctaacacagcatatgtagcacattttagaaattcatagatcttttatttttctagtgttaaacaattacttcaaattgatttgtattgctacataaggcaaaaaacaattcctgaactttgcagaatggaaaaatatttcaactgccacatttactcttttaaaactgagagctttaaagcaggagctcccaatccccggtacccatccctggcctgttagaaactggacatagcaggaggtgagtggcacgcaagccagagaagctttatcagtatttacagctgctcccaatggcttgtatggccacctgagctccgcatcctatcagatcattggcagcattaaattctcataggagcatgaaccctattgtgaactgtgcaagccagggatctag

SEQ ID NO: 17547 - DNA, 293 bp, Homo sapiens
agttttgaactttataaaagggtcctgtcacccaaagagctgggggactctaagtttctgagctggtccttagcagttctttctgctcctctccccaacaacttgaggcccatgggcttcttggtccccctccagggcagggtgtctggcagatgcagtctttcatgtctaggtggggctggagctgggacgctagcagctctcctgtaccttctggacctgctgtctccaggccgacatccagccacttggcctcctttccttgcagaaatacacgcttttgagaagagtwa

SEQ ID NO: 17548 - DNA, 437 bp, Homo sapiens
atcatttggtccaggacaggcagtaggcgtcagggggcgccctaaggctccacggcatgtgcctgtattgctgggacatcgagccttcccaagtcaaccctgaaggaccaagacaacatcatccttcagaggtcactgagcggcagttgcaaataaacgtattcagaatatgcaacacctaaagaaagagaagaggagactgaataaaaggttttcaaggccttctcctattccagaaccaggactcctatggtcatcttgataaagcaggagtctatttgaaggaaaccatgctccagacagaaatatgtggattgtgaacatcaagtgacatatcatgaattgatcatccacaaaataaatgcaatactccaccatttcggaaaaataaacacagtgcaagtatttaaaaaaaaaaaaaaaaaaaaaaaaaaaar

SEQ ID NO: 17549 - DNA, 405 bp, Homo sapiens
  misc_feature 212: n=a, g, c or t
tttggaaaccgcggagtttcctttgggaggctgcggcagccgggctgacttgttatgttgggctccggagccgttaagagccgagagagacatgaggtgtctctgaagcccggtcgcctgggccatgaagaagatttttagtaagaagggcgagtcgcctttggggctccttcgcgcggcggcggaggagcagctcgggaggcgggggcganccgggggagggcgcctactcgcagcccggctaccacgtccgagaccgagatctcggcaagatccacaaagctgccagcgcgggtaatgtggcgaaagtggcagcagatccttttgctcaggaagaatggcttgaacgatagagacaagatgaacaggacggctctacatttggcctgtkccaatggtcatcca

SEQ ID NO: 17550 - DNA, 460 bp, Homo sapiens
atttggcctgtgcattttgatcgcggttaaatgcagtttctgttaggctctttgaaatattgaaaatagctcacaaactctcattactgcctttgaagagccacaggggtctgggaaccccaggcagggaatgccgttcttgtccaatttctcctctacaccctcaacaccccctcccttacttcccctctcaagtttggaatgaactgcctaaaaaacacaagaggagtcacatggagagatcaaaatgtcagcttcattaccttaccgataacgctgattggaagacgtggctttggatatgtggcaaaattgtcttgttaatacatcactcttgaattgaagaagttacccactcattcaccagcaaaggaaacagcctcaggcttccctcacaggagcaaggcttgctgggtaagttaagggggtgcaargtgggttggggctgagctaagtatgc

SEQ ID NO: 17551 - DNA, 393 bp, Homo sapiens
tattcatcatttcccaacaagaaataggtttatggtctctaataagtaatatcttattgaacataaaacattgattataggatatactgtgactgtatatactcctatggaaagaaaaaaragggctcccaattaaactatgacacaaagctttcttatcacttaggatttttagtttttatttactgaaatagttctttgagacttttaaaaataaatttgtcttatctaatactttgcataaataaaaaagaaaatacaggcagaattacttttggtattcttaaatttacgkatccctcattttccctacattcggagtctgtctcttctgaatgacttttttcaaattatttttattatagammtttgtaaatgtataaaacaagagag

SEQ ID NO: 17552 - DNA, 165 bp, Homo sapiens
acgctttggtttccgggtcggttctggcaggtctgagcgctccgacttccagaggagcgctgtgcacgtggagaagagcggggactcggcgaccctgccctcccgaccctcatgttcgaagagcctgagtgggccgaggcrgccccagtagccgcgggccttggg

SEQ ID NO: 17553 - DNA, 432 bp, Homo sapiens
aattttttctcacaaggactgggtgaagagttctgcagccttacagagactggaaaagaagcccaaaccaaggcccccagagaggtcccccaggcccctttgggtccctgagcctcagctggagatccggcgcaggagaccaacgcctgccatgctgttccggctctcagagcactcctcaccagaggaggaagcctccccccaccagagagcctcaggagaggggcaccatctcaagtcgaagagacccaacccctgtgcctacacaccaccttcgctgaaastgtgcagcgcattgctgagtctcacctgcagtctatcagcaatttgaatgagaaccaggcctcagaggaggaggatgagctgggggagcttcgggagctgggttatccaagagaggaagatgaggaggaagaggaggatgatgaagaa

SEQ ID NO: 17554 - DNA, 429 bp, Homo sapiens
  misc_feature 35: n=a, g, c or t
atcatttggtccaggacaggcagtaggcgtcaggnggcgccctaaggctccacggcatgtgcctgtattgctgggacatcgagccttcccaagtcaaccctgaaggaccaagacaacatcatccttcagaggtcactgagcggcasttgcaaataaacgtattcagaatatgcaacacctaaagaaagagaagaggagactgaataaaaggttttcaaggccttctcctattccagaaccaggactcctatggtcatcttgataaagcaggagtctatttgaaggaaaccatgctccagacagaaatatgtggattgtgaacatcaagtgacatatcatgaattgatcatccacaaaataaatgcaatactccaccatttcggaaaaataaacacagtgcaagtatttaaaaaaaaaaaaracgagsgg

SEQ ID NO: 17555 - DNA, 378 bp, Homo sapiens
ttttctcacaaggactgggtgaagagttctgcagccttacagagactggaaaagaagcccaaaccaaggcccccagagaggtcccccaggcccctttgggtccctgagcctcagctggaggtggggggtgcctgcagtgcgctggctcagtctccttctgaaaagctggatccagcttgtttgaagcccttgagctgatcttagatccggcgcaggagaccaacgcctgccatgctgttccggctctcagagcactcctcaccagaggaggaagcctccccccaccagagagcctcaggagaggggcaccatctcaagtcgaagagacccaacccctgtgsctacacaccaccttcgctgaaagctgtgcagcgcatt

SEQ ID NO: 17556 - DNA, 300 bp, Homo sapiens
atagcgcgtaacgagagactgcttgctgcggcagagacgccaggggtgcagctccagcagcaatggcagtgacggcgttggcggcgcggacgtggcttggcgtgtggggcgtgaggaccatgcaagcccgaggcttcggctcggatcagtccgagaatgtcgaccggggcgcgggcttgcatggtgctcaccccctcacccctccaagctcactccccaacccccaactccgtgtggtaagcaacatggctttgatgataaacgactttactctaaaaaaaaaaaaaaaaaaaaaaaaaa

SEQ ID NO: 17557 - DNA, 416 bp, Homo sapiens
aaggggtgcagctccagcagcaatggcagtgacggcgttggcggcgcggacgtggcttggcgtgtggggcgtgaggaccatgcaagcccgaggcttcggctcggatcagtccgaggatgtcgaccggggcgcgggctccatccgggaagccggtggggccttcggaaagagagagcaggctgaagaggaacgatatttccgagcacagagtagagaacaactggcagctttgaaaaaacaccatgaagaagaaatcgttcatcataagaaggagattgagcgtctgcagaaagaaattgagcgccataagcagaagatcaaaatgctaaaacatgatgattaagtgcacaccgtgtgccatagaatggcacatgtcattgcccacttctgtgtagacatggttctggttttaacta

SEQ ID NO: 17558 - DNA, 369 bp, Homo sapiens
agcgcgdacgagagactgcttgctgcggcagagacgccagaggtgcagctccagcagcaatggcagtgacggcgttggcggcgcggacgtggcttggcgtgtggggcgtgagggacattccaagccccgaggcttsggctcggatcagtccgagaatgtykaccggggcgcgggctccatccgggaagccggtggggccttcggaaagagagagcaggctgaagaggaacgatatttccgagcacagagtwgakaacaactggcagctttgaaaaaacaccatgaagaagaaatygktcatcataagaaggagrattgagcgtytgcagaaagaaattgagcgccatwargchgaaggatcaaaatgct

SEQ ID NO: 17559 - DNA, 496 bp, Homo sapiens
cacatctctctggagttttctattttaaagaggaatctgaaagcaataagctctttggtcttcttaagatggctacacctcaatttaagatggggtattctttcactagttgaggagtagaagaggatgaccagctagactcccatggaattggaactsctattccttgcttagacattacaggttatgctttgagatctctttggggtgaaggattgaaattaaaccctgagccaccgtgtccttgtagagcacagagtagagaacaactggcagctttgaaaaaacaccatgaagaagaaatcgttcatcataagaaggagattgagcgtctgcagaaagaaattgagcgccataagcagaagatcaaaatgctaaaacatgatgattaagtgcacaccgtgtgccatagaatggcacatgtcattgcccacttctgtgtagacatggttctggtttaactaatatttgtctgtgtgctactaacagattataa

SEQ ID NO: 17560 - DNA, 822 bp, Homo sapiens
cttcttgtagtcatggttccagtgattatcacacccgctttgctactgttaacattcttcctgaggtagaaaatgaccgtctggaaaattccccacatcagtgtagcatttctgtggttacccaaactgcttcctgttcagaagtttcacagttgaatcatattgctgaagaacatggtaacaatggaataaaacctaatgttgatttatattttggcgatgcactaaaagaaacaaataacaaccactcacatcagacaatggaattaaaagttgcaattcagactgaaatttaggcccataaatgctgcagaataattaccactgtacaaccgtgtttggagctggttgaactacatgtgactacttaagtttcaggttaccagcaaaagccgggtttcattatcataatgcagatacattttctgtgttcagcaaggcattgtgtgtcatgtggatcttagttaccaaactatgaagtgaaggctttaaaagtgcattattttaaggataataaatttgaagagcaaagcatgttttgtgtgtttgccacaaaacattgcttgaagcacatacttagatagaaattggtcttaatttatataatcaatataaaatactaatgcaattctacagcattcaaatgaagaaaacttgaggctttagggataagtggttagtgatattttattgaaaccactaaagagataagtttaaaagaattgcataggttactctcagtatatgatactctgtaacatttctatttatatcggcataaatttcattttttttcttcatatgcaatgtggttatataaag

SEQ ID NO: 17561 - DNA, 424 bp, Homo sapiens
tgttagaagagcgtctaaggttagccactctcaaggggaggggaattgggctacatctcttagtgggagaagtatcaaagaatctgtgggcatattttaaagccatcacactcattatggttttatttaattaattaatttatttttttgtagagtcagggtttcgctatgttgcccaggctggtcttgaactgctgagctcaagcagtccacccgccttggcctcccaaagtgctgggatcacaggcatgagccaccatgcccggctctcattatggtcttagtttatttttttaatttgagacggagtttcattcttgtcccccatgctgaagtgcaatggtgccatctcagctcattgcaacctccacttcccgggtttaagcgattctcatgcctcagcctcccgagtagctgggattac

SEQ ID NO: 17562 - DNA, 433 bp, Homo sapiens
cataatttcatgtgttatacagtttaaaaagcctgcaaaagtgactttgcttgtttactttctgcctcagattgactattttaaccaatattgtcacgactagatcatagctcctagtgaataacatgaggtgttttaaagttaggtctattacagaattaacataagcacaattttaattttatgatatctgatatgcctatctaatacatcttaatgcattaaatgctgcagataagaatcttgcttttttcaagtagacaacattagaaagttgaatcatgaactcattcaattcatcaagtcaaaagcactgagtgttttgctagtctagtgacatgggttattgtatttccgagaagtgcctctcatttctggggagttgtttacatataccctgcatttaaaccaattaaaacaatccaagtttctt

SEQ ID NO: 17563 - DNA, 260 bp, Homo sapiens
agacgaacggaagatggcggcggcggcggcggcggagtgtaggaagaggcactgctgagggggcgcgaggggaacggaggccagagctgcgaggttagctgggcatggtggcatgtgcccgtaatcccagttgcttgggaggctgaggcgggagaatcacttgggcctgggaggcggaggttgcagtgagctgggatcgcaccaccacactccaacctgggtgacagagcaagacttcatctcaaaaaaaaaaaaaaaaa

SEQ ID NO: 17564 - DNA, 435 bp, Homo sapiens
aggccagcggggggtcgctgccgttgagsttcccgccactgctgctggcggatttgtggggcaaaatttctcgctggctagccttcttttccctcccgcactttggtggggagggggtggatcctygtttcggtgcccaagttcacgatgacccgagagaactcgaggaagttgtcgccgcggccatttcccccagtgccgcaacttgctggccttggagggggaggagcgccgaggcagtgactgcgacgcaaacatcaaaccagatgcaaacagattcattatctccatcccctaatcctgtgtcacctgtgcctttgaataacccaacaagtgccccaagatatggaacagtgatccctaatcgcatctttgtaggaggaattgattttaagacaaacgaaagtgagtttaagaaaatttttttcccagtat

SEQ ID NO: 17565 - DNA, 284 bp, Homo sapiens
gacaagaggcatcctaggaaagggagcagaggaagaggacagagacattttctttcttttctttttgtggacgcaacggcatgtgcctgtagtcccagctacttgggaggccaaagcaggaggatcattcgaagtcagaagtttgaggctgcagtactttatgatcacacctgtgagtagtcactgcactccagcacaggcaacacagcaagaccctgttctttaaaaaaaaaaacaaaaaacaaaaaaaaaaamcccaaccamccaaaaaaaaaaaaaaatgc

SEQ ID NO: 17566 - DNA, 390 bp, Homo sapiens
cagcttaatgaaaataatttcagtaaaatgaaaatggaagaaatggagttggtttaactgtgacttgtggtcattattattattttgactttgsamcaycckggaatgcdatatgagcattctgtgttcatgtagctctttctcattctttttaatgactattatttcattgcaagaatctacagtaatttattccaacttaaaaaaaactgttctgttttccagaatatgcttttaaggctattaaccagggtggccttacatcagtagctgtcagagggaaagactgtgcagtaattgtcacacagaagaaagtacctgtaagtaatactgcccaaatagttaataattgcagaatataagaatttttcagccaagtgcagtggctca

SEQ ID NO: 17567 - DNA, 325 bp, Homo sapiens
aagagtgtcctagagcccagaaataatcaggctggaaatgctcctaggcttggagaagactcattcaggggcaaagctgtaactcctatcgacacagggcagggcccaggatgaatgtcataaggacagctgaactgtgagccctgggatgaagtcacctacagccctaagacctgaaatgcacatctcagcagaagcctgactgcagccgttatccttgctgtggagatgaaccaaaggcccaagcgtgagtgacttcaagatgaaactcaggagctgaggctcagtgtggacattaaatttccgatgccagataagaaaaaaa

SEQ ID NO: 17568 - DNA, 442 bp, Homo sapiens
aggagtcactgacttagaggtggtagtttcaagtgacgtgatggttaagttcaccaagagaaaaagtttagaaagaaaaagagctgagccttctgccctattttttagaagagggtttctgagagcctgggtattcaaatgataagatgggtgtgtggtgcagggacaagacttcagtcagaggacccagggtctctgctttasaccatcttgctgtgtgacgttgggcagctgaccttactatcagtgcctcagtttcctcccctgtaaccagggacaataatgccagccctctctccctcccaaaattattgcatggatcaaaagggagaatgcacaagaaagtgctttgtaaaccactcaaaagactcatcaaatgtaagggattattataattgcagtgggagatgcaggaggccaataaaatggatttggttgcagt

SEQ ID NO: 17569 - DNA, 628 bp, Homo sapiens
actctgtaagtgtagctcaaataggtcatcatgaaaggttaaaaaagcgaggtggccatgttatgctggtggttaaggccagggcctctccaaccactgtgccactgacttgctgtgtgaccctgggcaagtcacttaactataaggtgcctcagttttccttctgttaaaatggggataataatactgacctacctcaaagggcagttttgaggcatgactaatgctttttagaaagcattttgggatccttcagcacaggaattctcaagacctgagtattttttataataggaatgtccaccatgaacttgatacgtccgtgtgtcccagatgctgtcattagtctatatggttctccaagaaactgaatgaatccattggagaagcggtggataactagccagacaaaatttgagaatacataaacaacgcattgccacggaaacatacagaggatgccttttctgtgattgggtgggattttttycctttttatgtgkgatatagtagttacttgtgacaagaataattttggaataatttctattaatatcaactctgaagctaattgtactaatctgagattgtgtttgttcataataaaagtgaagtgaatctsaaaaaa

SEQ ID NO: 17570 - DNA, 411 bp, Homo sapiens
agaatgggaagaggtatgtcttgagagaagctcacggtttacttccacaattataaaatgacagcaggccgggcatggtggcgcatgctgtaatcccagcactttgggaggccaaggtaggtggatcacctgaggtcaggatttcatgaccagcctgactamcatggkkraaccccgtctctactaaatacaaaaaaattagccaggcttggtggcgcatcactgtaatcccagctacttggaagactgagacaggagaatcacttgtgtctgagaggtgctcgacgtgtcccttctcttcctccgggtcatcagcgcctgtgcagatggcaagatccgaatttacaatttcttcaatgggaactgtatgaaggtgataaaagccaatggcagaggcgaaaaaaaaaaaaa

SEQ ID NO: 17571 - DNA, 547 bp, Homo sapiens
agcaggtaagtggtttcccgcactgccggtatccgccgccatccggactcccgggtcctctgtgcaggttggaggatggttggttgtggcgagcgaggctgaaggagccgggacgcggggctctgggcctcgggaactgagccggtactcacctccgccccttctccccgtcgctgtccgcagccatggccctacgctaccctatggccgtgggctcaacaagggccacaaagtgaccaagaacgtgagcaagcccaggcacagccgacgccgcgggcgtcttgaccaaacacaccaagttcgtgcgggacatgattcgggaggtgtgtggctttgcccgtacgagcggcgcgccatggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagcccctcccctgccctctccctgaaataaagaacagcttgacaaa

SEQ ID NO: 17572 - DNA, 443 bp, Homo sapiens
gtagatatcccggagttccgcgcggcgccacccttccgccacggccgtctctggagagcagcagccatggccctacgctaccctatggccgtgggctcaacaagggccacaaagtgaccaagaacgtgagcaagcccaggcacagccgacgccgcgggctctkgaccaaacacaccaagttcgtgcgggacatgattcgggaggtgtgtggctttgcccgtacgagcggcgcgccatggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagcccctcccctgccctctccctgaaataaagaacagcttgacaaaaaaaaaaaaaaaaaaa

SEQ ID NO: 17573 - DNA, 70 bp, Homo sapiens
cttccgccacggccgtctctggagagcagcagccatggccctacgctaccctatggccgtgggcctcaac

SEQ ID NO: 17574 - DNA, 1157 bp, Homo sapiens
ttttaaaagatatcgatacctgtttggtcactctttctaattttggcttctgctcctccgtttctttacttagttgaaatgaataagcctgcttctctgataacttttctttaacattatttgccaaatgttctataacatctaatgtattttccatgctctgtagaaaaaatattaacatgtattttttagaatcagaaattgacttttataacttgtcatttatcaagtattcatttaattttaattcatttatttttgtacataatatacattatttctgttgatgtacctcttaatgacatctcggtcaatgatggactgtatatatgatggtggtcccataggattataatggagctgaaaaattcctgttacctagcgacattgtaatgtggcacaatacattagtcatgagtttgtggtgatggctggtgtaaacaaacctgcattgccagtcatataaaagtctagcacatacaattatgtacagtgcataatacttgatagtgataataaaagatattactgatttatgtatttactatacaatatacttttattattttacagtgtactcctatttatttaaaaagttaactataaaacagcctcaggcaggtccttcaggagatattccagaagagggcattgttatcatagatgacagctccattcatgttactgaccctgaagaccttcaagtgggacaagatatggaggtggaagacagtggtattgatgatcctgaccacgggtaggcttaggtttatgtgtgtgtatgtgtcttagtttttaacaaaaaaattaaaaagtaaaaaaactaaaaatagaaaaatgcttagagaataaggatataaagaatatttttgtgcagttgaacaatgagtgcttaagctaaatgtcatcacaaaagagtaaaaaaattttacaaaattaaaaatgtttaaagttaaaaagctctaggaagctaaggtcaatttattattggagaaataaaattatttttatgaatttactgtagcctaggtgtacattatttatcatgtctacagtagtgttcagcaattaggccttcacattctctcaccactcactcactcagtcactcacccagagcagcttccagtcccgcaagctccatttatggtaagtgc

SEQ ID NO: 17575 - DNA, 228 bp, Homo sapiens
tatttcttgctctgttatcttttgccctcttagaatgtccctctcttgggacttgcttagatgatgggatatgaatattattagacagtaattttgctttccatccagtatgctagttcttattcgagaactatggtcagagcgtatttggatatgagtatcctttgcttatctttgtagtactgaaaatttgccgaagtaactggctgtgcagaatgtaatagaagc

SEQ ID NO: 17576 - DNA, 421 bp, Homo sapiens
gttagtgacattggaatctaggcagttgcacaacccttttaatgtcagtcttggaatgaagactttatgcatcactagctgtgtgcatgtatggtgaggtcgtgccagcaaatccgtgtgaatgccactggattaaaagaaggaagtttagttgaatggttactaccctcattcacaggagcagttatcggcacttccattgaggcaatggcagtgggaaaaggaaggcaaatatttattcacccatcaataaactcataaaagagtgagctgatgaactgaacacaagttttggtgtaatcaacaagctgcctggaatatgcatgaactgccctaattttacagatgcctttacttctgaaagcatcttctgggagagcttagccttttccctaagtttggatttgaaagcaagcagaat

SEQ ID NO: 17577 - DNA, 554 bp, Homo sapiens
ttttcacttgcctcatatgtgaggcattgagtccttttgtcttctcagtatgaaaaagccttttaataagtgttactagttttaagaaaatactgacttacccagaagaattgcaaataagaattgctgaatatacatgaaaatcaacatttttaaagcagagatttgtgatgagtggaagacggaatctagattaaaagtatctcagcttctaaagaattgtcctttttaactgtgcagcagacttagcatatctttatgataaaattgattgtacgcaacttgagcatagctttctcttctggggtaatgtgaagtaattttcaattaggggtggatcacctgaggtcaggagttcaagaccagcctgacgaacatcatgaaaccccttctctactaaaaatacaaaaattagccaggcgtggtgacctgtgcctataattccagctactggggaggcagacataggagaatcacttgaacctgggaggcggaggttgcagtgagccgagatcgcaccactgcactctagccttagcgacagagcgagactc

SEQ ID NO: 17578 - DNA, 183 bp, Homo sapiens
accgtccggcgcgatggcggggagtagctcgctggaggcggtgcgcaggaagatccggagcctgcaggagcaggggacgcgctgaggagcgcgcgggcaccctgcagcgcgactggaccacgagaggaagaaagaagaaaaaaagaatagaaaagagsaaraaaraaaaraaaataagaaaaa

SEQ ID NO: 17579 - DNA, 253 bp, Homo sapiens
aaaagcgatctcttctgaggatccggcaagatggcagaagtagagcagaagaagaagcggaccttccgcaagttcacctaccgcggcgtggacctcgaccagctggcarsatggtgggsgtctacaacggcaagaccttcaaccaggtggagatcaagcccgagatgatcggccastacctgggcgagttctscatcacctacaagyscgtaaagcatggscggsccggcatcggggccacccactcctcccg

SEQ ID NO: 17580 - DNA, 368 bp, Homo sapiens
agtctcgcgataactgcgcaggcgcggaccaaagcgatctcttctgaggatccggccaaratggcagaagtagagcagaagaagaagcggaccttccgcaagttcacctacctcggasgtggacctcgaccagactgctggacatgtcctacgagcagctgatgcagctgtacagtgcgcgccagcggcggcgggctgaaccggggcctgcggcgggaagcagcactccctgctgaagcgcctgcgcaaggccaagaaggaggcgccgccaatgggagaagccggaagaggkgaagacgcacctgcgggacatgatcatcctacccgagatggtggggcagcatggtgggcgtctacaacggcaagac

SEQ ID NO: 17581 - DNA, 556 bp, Homo sapiens
ttttaaaagatatcgatacctgtttggtcactctttctaattttggcttctgctcctccgtttctttacttagttgaaatgaataagcctgcttctctgataacttttctttaacattatttgccaaatgttctataacatctaatgtattttccatgctctgtagaaaaaatattaacatgtattttttagaatcagaaattgacttttataacttgtcatttatcaagtattcatttaattttaattcatttatttttgtacataatatacattatttctgttgatgtacctcttaatgacatctcggtcaatgatggactgtatatatgatggtggtcccataggattataatggagctgaaaaattcctgttacctagcgacattgtaatgtggcacaatacattagtcatgagtttgtggtgatggctggtgtaaacaaacctgcattgccagtcatataaaagtctagcacatacaattatgtacagtgcataatacttgatagtgatataaaagatattactgattatgtattwctatacatatcttta

SEQ ID NO: 17582 - DNA, 311 bp, Homo sapiens
  misc_feature 145: n=a, g, c or t
ctggttattttgcccattagttgatgcagtttcttcatagtgtcaatggtctttacaatttggtatgtttttgcagtggctggtactggtttttcctttttatgttttatgcttcgttcagaagctcttgtacagtgcgcgccangcggcggctgaaccggggcctgcggcggaasagcactccctgctgaagcgcctgcgcaaggccaagaaggaggcgccgccatggagaagccggaagtggtgaagacgcacctgcgggacatgatcatcctacccgagatggtgggcagcatggtgggcgtctacaa

SEQ ID NO: 17583 - DNA, 341 bp, Homo sapiens
ctcttctgaggatccggcaagatggcagaagtagagcagaagaagaagcggaccttccgcaagttcacctaccgcggcgtggacctcgaccagctgctggacatgtcctacgagcagctgatgcagctgtacagtgcgcgccasscggcggctgaaccggggsctgcggcggaagcagaaactccctgctgaagcgcctgcgsaaggccaagaaggaggcgccgccatggagaagccggaagtggtgaagacgcacctgcgggacatgatcatcctacccgagatggtgggmagcatggtgggcgtytaaaacggcaagaccttcaaccaggtgggagatc

SEQ ID NO: 17584 - DNA, 422 bp, Homo sapiens
atcacaccttcctcctgccctgacttctcatatcttgcctaggaactccaggcttgtcttgagttcctaggcaagatggcagaagtagagcagaagaagaagcggaccttccgcaagttcacctaccgcggcgtggacctcgaccagctgctggacatgtcctacgagcagctgatgcagctgtacagtgcgcgccasgcggcggctgaaccggggcctgcggcggaagcagcactccctgctgaagcctgcgcaaggccaagaaggaggcgccgccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcg

SEQ ID NO: 17585 - DNA, 239 bp, Homo sapiens
  misc_feature 148,152,237: n=a, g, c or t
ctcttctgaggatccggcaagatggcagaagtagagcagaagaagaagcggaccttccgcaagttcacctaccgcggcgtggacctcgaccagctgctggacatgtcctacgagcagctgatgcagctgtacagtgcgcgccaggsgncggnctgaaccggggcctgcggcggaagcagcactccctgctgaagcgcctgcgcaaggccaagaaggaggcgccgccatggagaagcngg

SEQ ID NO: 17586 - DNA, 379 bp, Homo sapiens
ctttaattccttagtctcccttagccatcaccaagatctttgttttactaattatattttacttcttcccatagctactatcattactctaattcaggccaccttattattgccgcagcttcctgttcttctcctttgttttatttaattaaaaattttgaaaccatcctgggcaacatggtaaaaccccatctctactaaaataccaaaaaattagccgggcatggtggtgcgcacctgtaatcaaagctactcgggaggctgaggtgggagaatcgcttgggcccgggaggtggaggttgtagtgacccaagatagtgccactgtactccagcttgcgtgacagagtgagactctgcctcaaaaaaaaaaaaaaaaa

SEQ ID NO: 17587 - DNA, 472 bp, Homo sapiens
ttggtggtttccctaaataaagcttgccctatagttcgttagcaagcgccattgaatcatttttttctttaacgagcgctccatgactgctgtcaggatcctctgtcacagcagggaccacttctttccaaagaccatgtgatagacctctttgagacaggagaactggagttcattaaaaagcatgccttggccaggcgcagtggctcacaactgtaatcctagcactttgggagaccaaggaaggcagatcacgaggtcaggagattgagactatcctggctaccatggtgaaacctatctctactaaaaatacaaaaaattagccgggtgtggtggcacgcacttgtggtctcagctactcaggaggctgaggcaggagaatcgcttgaacccgggaggcagaggttgcggtgacccgagatcgcaccattgcactctagcctgggccacagagtgacactccgtctca

SEQ ID NO: 17588 - DNA, 480 bp, Homo sapiens
  misc_feature 338: n=a, g, c or t
attcatcttgttttaaatgtggtggtccccatggagtctggatgtggcgtgcatgacctcccatggtcctgtaataagatctggcatgctaacaacattggctacagatctgtcatctataggtctgtctgtccctccccctccctcatctccttatctaaggttgaagaataaatgagcaattgaagcacatgggacctctagatgaaattgggtaaatatgtaagcaaagtggagggtgtgcttttgtgttgctaggacatatattatggtctctccttcccactttcactacacacatatgtggtcagtatggtaaaggaaagctgtttccttanttgcttttattgagggaatgtggcttgtaatcatccctgatgagtgctgggaagtgagagctcagtgcagagctggcaagcaaagtagaacttcagaatcactcctggtggggctgggggtagggtggtggagaaaaaaaag

SEQ ID NO: 17589 - DNA, 194 bp, Homo sapiens
agaagggcctatacttctaaaggttgaaagattctttttcaaaagatgatctaagaaatgtaggaccagtagatgctcaagtatatcttgaagaaatgtcttggaatgaaggttggattttttttttctcttgacaacatttaaaaaaaaaaarggawtttyctataagaaaaaaaamcysatgggatattggg

SEQ ID NO: 17590 - DNA, 364 bp, Homo sapiens
ccggagttctggccgacagcaggcgaggagtgggtagcagcgcctatgtgaagttagctaatctgagaaggcccacttctggttccatggatgatggcggttgagcagatgccaaaaaaggattggtacagcatcctgggagcagacccatctgcaaatatatcagacctaaaacaaaaatatcaaaaactcatattaatgtatcatccagataaacaaagtacagatgtaccagcaggaacagtggaggaatgtgtacagaagttcatcgaaattgatcaagcatggaaaattctaggaaatgaagagacaaaaagagagtatgacctgcagcggtgtgaagatgatctaagaaatgtaggac

SEQ ID NO: 17591 - DNA, 478 bp, Homo sapiens
ctctgacaattcaattattttctgttattaatgttgccactgctttctgtttgtctgcactttcttgataaatatttgctatcgttttactccagtcattcgatgttgctgagatttacatatgactcttgtcaacatctcatcttttgacccaatcttattcatttaataagaggtctcattcatttgcatggaaaaatgctcattgtatattgcaaagtgaaaataacgagttgcaaaacagtgtatacatatatgtgtgtatatatgtacactttatttgtacatttctatgtgacataatgcaaaggaaagtgtctgattttattatacaccaaaggttaacagtgaatatctgtgtgatctcttttwttwtctttttgcctatctgcatcttctcacttgccaaaaaatgaaatatatgtttatgtgtgtatattacttgtgtcacaaaaaaccctaaagtagacagtaaaag

SEQ ID NO: 17592 - DNA, 475 bp, Homo sapiens
atgtttgtttgtttttgagacagagtctctctctgtcaccaggctggagtgcagtggcacaatctcggctcactgcaacctctgcctcccaggttcgggcgattctcctgcctcagcttccctaatagctgggactgcgggtgcccatcaccacgcccagctaatttttgtatttttagtgaagacgggggtttcgccatgttggccaggatggtctcgatctcttggccttgtgatccacccgcctcgacctcccaaagtgttgggattacaggcgttasacttgcgcccggctgagaattggacactttcaactggggccctgagaggctggtggcagcacacccagggtcattcagtggggaaggtttccggagtagggacgaagatggagatggggttggcttggggatcaggagtgaaggatgggaatgcagatggaatcagaggggaaaatggagataagatttggaat

SEQ ID NO: 17593 - DNA, 472 bp, Homo sapiens
tttccacagcgcgggggaacgggaggctgcaggatggtcaagctgacggcggastgatcgagcakgcgcgcagtacaccaacgcggtgcgcgaccgggagctggacctccgggggtataaaattcccgtcattgaaaatctaggtgctacgttagaccagtttgatgctattgatttttctgacaatgagatcaggaaactggatggttttcctttgttgagaagactgaaaacattgttagtgaacaacaacagaatatgccgtataggtgagggacttgatcaggctctgcctgtctgacagaactcattctcaccaatarttagtctcgtggaactggtaagttgcacagaaggaaaatgtatttggtgggtggggttaaaggtactatgtgcttcctacagaaaatttacaaaatctagaaaatgatctcagtatcctctttcttgtctttttcttaattcaggatct

SEQ ID NO: 17594 - DNA, 344 bp, Homo sapiens
agtctcgctggcgggaggccacgggctttccacagcgcgggggaacgggaggctgcaggatggtcaagctgacggcggastgatcgagcaggcggcgcagtacaccaacgcggtkscgaccgggagctggacctccgggggtataaaattcccgtcattgaaaatctaggtgctacgttagaccagtttgatgctatkgatttttctgacaatgagatcaggaaactggatggttttcctttgttgagaagactgaaaacattgtkagtgaacaacaacagaatatggtacgtgtctgtaggggaaagtaattktttcccctagagtaaatgttgcagtgtttc

SEQ ID NO: 17595 - DNA, 503 bp, Homo sapiens
gttatacagattagagacatagcaagaaggtttgatttgattgattgtgtagggcaagggaaatggagaaggatgagtcaaggatgatagttctaagtttccgtaggagactggttgaacaaggatgccactcagtaaaggaaataatacatgaagaagagtaatgtgaaggccagggaagacagacaaataaattgctttggaactgttaagtttgctttgcttgtggacatccagatggaaattggttttatatgacttaaggctctggagagcaacctcgacttactggggtgggcatgagattgaatgtaattctccagaggaaaagttgtctatagcaagggtatttgctcatgacagaagccaatgaggggccgggctcggtggctcacacctgtaatcccagcactttgggaggctgagggaggtggatctcaaggccaaaagatcgagaccatcctggccaacatggtgaaacccgtctctactaaaagtacaaa

SEQ ID NO: 17596 - DNA, 439 bp, Homo sapiens
aattataaagtggctccagcagccgttaagccccgggacgcgaggcaggcgctcagagccccgcagcctggcccgtgaccccgcagagacgctgaggaccgcgacgagtcgtgtctgaacccggcttttccaattggcctgctccatccgaacagcgtcaactccatggcgcggttcctgacactttgcacttggctgctgttgctcggccccgggctcctggcgaccgtgcgggccgaatgcagccaggattgcgcgacgtgcagctaccgcctagtgcgcccggccgacatcaacttcctggcttgcgtaatggaatgtgaaggtaaactgccttctctgaaaatttgggaaacctgcaagagctcctgcagctgtccaaaccagagcttcctcaagatggcaccagcaccctcagacaaaatagcaaaccggaaga

SEQ ID NO: 17597 - DNA, 412 bp, Homo sapiens
acacacacccctgattccagaaacacaacaggagctgactcaaaagggagtgtctggtgcaggcatgcagggaggaagaatgactctgagcttgaccattcaacttcgaaactttaacatcaatggatcagcacacactggtgtacggtctgctatgcatgcagccctgtgctaggcaaaagaagtatcagaccaggaactgacagcctcactgcaacaggaagagaggcttcacacaataagcgtttcattcaaccaggctggacctgtgcttattgagttgaacatcactgagcacaaaatgcaagccagacaccataagagctgtaaggatgataaagatgtctttctaccctcgagagctctaagtgtggtcaggagagaaacacatgcaaagattatgctggctgga

SEQ ID NO: 17598 - DNA, 385 bp, Homo sapiens
tcaccaagggaagagtcaggggagaaggaacacaagactccggaagcatgccagcgtataaaaccacactttgcctcattggttcgtgcctcagcttccaatctggacatggragsacaataacagtgggcccactgctctccgaattcctgcgcgcacttgaagggagtgtctggtgcaggcatgcagggaggaagaatgactctgagcttgaccattcaacttcgaaactttaacatcaatggatcagcacacactggtgtacggtvtgctatgcatgcagccctgtgctaggcaaaagaagtatcagaccaggaactgacagcctcactgcaacaggaagagaggcttcacacaataagcgtttcattcaaccaggctggac

SEQ ID NO: 17599 - DNA, 639 bp, Homo sapiens
tagtttttatagatttcaaagacttgggaaaaaatattcagggaatatctaggtgagtatcatagatttgatcccatctgctgaaaaaccagataattagaaaggtatatctatttcttttgctaactctggggcttctgcttacaaatagcttttattacccctcacacctcctgagctttattttatagtagaggaaggtcagtgtttcataagcataggtttgttaagtggttaagtacaattgtcccccagtatcatgggtgatcggtcctaagacacccctctggtaccaaaatccagggatgctccagttctttgtacaaaattggcatatttgttgtctgggcctggtggctcatgtctgtaatcctggctatttgggaggctgaagtgggaggatcacatgaggctgggagcttcagaccagcctgggcaacatagtgagaccccatctctacaaaaaattagctgggtgtggtggtgtgcgcctgtagtcctagctactcggggagactgaggcggggaggatcactgaagctcaggaattggaggctgcagtgagctatgactgcaccattgcactccagtsmgcctggtgacaggcaagcaagacgctgtctctaaaaaaagaagaca

SEQ ID NO: 17600 - DNA, 487 bp, Homo sapiens
atttttcttggttttgtttatcagccgatctgtttgctggatttgggcttggaatgacccacctgtaaagtgcttttccttcctcctccccttgaactctgcagggggcttggcttggagggggcaagggagggaaagagagaagggggaaacacaaaaaacttctttctttctccctccgtttatcttcagcccgacattgtcacctcctctttgaggggttagaagaagctgagatctcccgacagagctggaaatggtgatgaatcttttttaatcaaaggacaatttcttttcattgcactttgactatggaaacagaggctattgatggctatataacgtgtgacaatgagctttcacccgaaaggaacactccaatatggcaattgacctcacctcaagcacacccaatggacagcatgcctcaccaagtcacatgacaagcacaaattcagtaaagctagaaatgcagagtgatgaagag

SEQ ID NO: 17601 - DNA, 425 bp, Homo sapiens
cgccttcctgcggctaagatggcgacggagcatcccgagcctcccaaagcagaattgcagctgccgccgccgccacctccaggccactatggcgcctgggctgcccaggagcttcaggccaagttggcagagatcggagctccgatccagggtaatcgcgaggagctggtggagcggctgcagagctacacccgccagactggcatcgtgctgaatcggccggttttgagaggggaagatggggacaaagccgctccacctcccatgtcggcacaggtagggagattcttctgttttttaagattccatctgctgatccttttgtagttcatgagcatgatgattgggtgttcacgtgcatgtgtgagatgtggcacccttgcacattactcgcctgacctgagtggggaaaaaaaaaaaaaaaa

SEQ ID NO: 17602 - DNA, 329 bp, Homo sapiens
tctggaagacggcagagctgccgccattttgcgggaagaggaggcgctgtacctgcagtgctgcttttcttgcctagactctaggaactatccgagctccactccccacaacatactcaaaggaacggagagaaccgggacccccctgcgggacccggaactgatctgacaggatggcatctgatgactttgacatagattgaggccatgctggaagctccctataaaaaagaagaggtgaatgcctcaggatgagcaacaaaggaaagaagttaaaaaggattatcctagcaataccaccagcagcaccagcaacagtggcaatgaga

SEQ ID NO: 17603 - DNA, 92 bp, Homo sapiens
atcccgcgcgttgcggtcaagatggcgctggtggcttctgtgcgagtcccggcgcgcgttctgctccgcgcgggggcccggctcccgggcgc

SEQ ID NO: 17604 - DNA, 352 bp, Homo sapiens
agatttctgtttgctactgtgtcttatgccttgttctcctacagagaagattctttgaagttagtggaagctcagcttaaaggaagatctactgctctgtgtggtggatgaccatgggggagcgagaaggcagcctccggcttttgttttgtgtgtgtgtgtgtgtgtgtgtgtgatgtacctggaaaaataacacgattaggattaaagagtatgtttggcatgtttaaaataaattgtaaaccaaacgtattttaaagaatttatacaaatttgtcatttagtaaaatgaatgactattgagtattcatgtcaataaaacaaccacttgaatacaacaaaaaaaaaaaaa

SEQ ID NO: 17605 - DNA, 435 bp, Homo sapiens
aattatgattagcgctgggtgcggggtttcggcggccgggagggagttgtcggcgccgcggccgctgcggacggacgctcgcctgccggctgaggaaaaagaagcaactaacaaaacactgtgataataaggattattcagtatgcagtttgcaggatatccatgacgacattgaaaatgaattttttgtattcaccagatattcttatatgagaagatctattttaaacagtctaaatattttttcttctgttggaccagcatggcaggatttaagcgagggtatgatggaaagattgctggattatatgatctggataaaaccttgggtcgaggccattttgccgtggttaaacttgccaggcatgtctttacgggtgaaaaaatatttagactgtttaaaatagatcttctcatataagaatatctggtgaa

SEQ ID NO: 17606 - DNA, 504 bp, Homo sapiens
attttctcttgctgccgaatgtaagaagagccatacgcctcccgccatgattctgagacctccacagcgatgtgaacttgccgaataatatttcattttctggatatacctcactttatctacttgctacagaagggcatcctgcttactttaaagttttggcaattaggaataaagctgctataagcatccagtcctgcaggttgaaaaatccaagatcatggcactggcaggttttgtgtctgctgagggcctgatcttcacttccaagatggtggctcgagtgctgccttctccaggatacaggaatactgttcctcacatggaagaagtgaaagatcaatgaatccactcttgcaagccaatttttgctctgtttgtttgtttttgagacaaggtctcactctgtcaccctagaggttggagtgcagtggcacaatctcttctccctgcgacctccacttccctgctcaagtgatcctccccacctcagcctcccaaata

SEQ ID NO: 17607 - DNA, 228 bp, Homo sapiens
aaaaaaaccactttggtagtgccagtgtgactcatccacaatgatttctccagtgctcatcttgttctcgagttttctctgccatgttgctattgcaggacggacctgtcccaagccagatgatttaccattttccacagkggtcccgttaaaaacattctatgagccaggagaagagattacgtattcctgcaagccgggctatgtgtcccsaggagggatgagaar

SEQ ID NO: 17608 - DNA, 261 bp, Homo sapiens
agagccctagtcctgatggcccctggtggcacatatcgaatgcctagggcagaaaggaagtgggaatggcgaagatgtgacattcctcggtgttagatcctgttttttcttaacaagttgaggcgtgggtagagcaggaattggttttccagcattgtgtccgtaaacctgagttagaataagatgtaacggaagccacgataaagactcggtcaaatcctgcaaaaaaaaaaaaaaaaaaaaaaaaaaaaaaaaaaaaaa

SEQ ID NO: 17609 - DNA, 222 bp, Homo sapiens
agagccctagtcctgatggcccctggtggcacatatcgaatgcctagggcagaaaggaagtgggaatggcgaagatgtgacattcctcggtgttagatcctgttttttcttaacaagttgaggcgtgggtagagcaggaattggttttccagcattgtgtccgtaaacctgagttagaataagatgtaacggaagccacgataaagactcggtcaaatcctg

SEQ ID NO: 17610 - DNA, 269 bp, Homo sapiens
agagccctagtcctgatggcccctggtggcacatatcgaatgcctagggcagaaaggaagtgggaatggcgaagatgtgacattcctcggtgttagatcctgttttttcttaacaagttgaggcgtgggtagagcaggaattggttttccagcattgtgtccgtaaacctgagttagaataagatgtaacggaagccacgataaagactcggtcaaatcctgcaaaaaaaaaaaaaaaaaaaaaaaaaaaaaaaaaaaaaaaaaaaaaa

SEQ ID NO: 17611 - DNA, 345 bp, Homo sapiens
agcggccggcgggcggcggggatacttctacatagacataatcaagttttgactatttggaaaccaagcatcattaaaattctctcaaactcctaattgcgaagaatcgataacatttcaagaagtgataacatttctctgaacaagaaaagaagtgattgaccacgttttaaaagtaatttcttgccagtgtctctgagcttcataatatttttggtgattatgaagctcagagacactgcaagaaataacttttaatttaccggtcaaacaatggtattttaacagcagtgataacaatttacagtattggggattggattacccacctcttacagcttatca

SEQ ID NO: 17612 - DNA, 204 bp, Homo sapiens
agckgccggcgggcggcggggatacttctacatagacataatcaagttttgactatttggaaaccaagcatcattaaaattctctcaaactctcagagacactggcaagaaataacttttaatttaccggtcaaacaatggtattttaacagcagtgataacaatttacagtattggggattggattacccacctcttacagct

SEQ ID NO: 17613 - DNA, 504 bp, Homo sapiens
tggtatagctcattatctgtgctggattaaccagaatttttatattgtcatttctgttcaccaccattgtgtgtaattgatctttttcgattaacccaaagcaatgaagtagtcatatttactaaagttttagtttcgtgcgttttattgtattaacattttttgaatattggtaatgtggtatcatttatgaaccactgtatttgataaagcattatcgataacggagtttaccatgagttcagacaagataaattaaatatttctcaaactcctactgtgagtaaggcaatgtggagaaggtcaatggttatggtgagggatggggtatagggggctagaaatgtaggatgaccaaggttctcccctagttgctattgctgtaaaaagccccctgtccaaggagttgaactgcaagtatgtttaataaaaaaacaaaaaacaaacaactttcctttttccagtgcagaaaatttgtgagtatataatatcagggtttaaaaa

SEQ ID NO: 17614 - DNA, 442 bp, Homo sapiens
aatttgagccgcgtcgagctcccctgggacctgtggccgccgcccacagaccatgctcctggggcgcctgacttcccagctgttgagggccgttccttgggcaggcggccgccgccttggcccgtctctggagtgctgggcagccgggtctgcgggcccctttacagcacatcgccggccggcccaggtagggcggcctctctccctcgcaagggggcccagctggagctggaggagatggtccccaggaagatgtccgtcagccccctggagagctggctcacggcccgctgcttcctgcccagactggataccgggaccgcaggactgtggctccaccgcaatcctaccagtgtccgcccagccagataggggaaggggccgagcagggggatgaaggcgtcgcgratgcccytcaaattcagtgcaaaaacgtgctgaa

SEQ ID NO: 17615 - DNA, 169 bp, Homo sapiens
aatcctagtcttcgtttggtccggttgcactcttcctatagcccagaggggagagggcctgtggctgggggaaggaggacgaggttctgcctggatcccagcaggacgctgtgccatttgggaacaaaggaatagtctgcctggaatccctgcagatcttggggccgga

SEQ ID NO: 17616 - DNA, 458 bp, Homo sapiens
agtctggggcgggcgctcgggctgcgcgggctctgggcagcagcagcagcagcagcagcagcatcctctcttcctttacttcccttccgcttctttctcttccttctccttcttttttcccccctccccttcttcccctrcccttctacccctctcctttttctccggaggcgctaagtccgtgagcggtggcagtcgcgaccgcgggtgcatccagtttctgcgcccaggtaagagaccgtccccacctctggctctatgtagggcgcctctccttttgcctcggtctctgagtagaaagagataggaatggggaggggttgtgtctcgtcctctgggactcgcagcaggcagtctggtagttggtcgagtggccagccgtgcacctggcggaagattcgggcctgtcctctccaggtgtcactgcggacaggggccggacgctactggtacctgag

SEQ ID NO: 17617 - DNA, 399 bp, Homo sapiens
tattttcagtagggacggggttacaccatgttggccaggctggtctcgaactcctgacctcaagtgatccacccgcctcagtctcccaaagtgctgagattacaggcatgagtcactacgcccggcccatgtctgtctgtcttgatgtgtgagcagcagctgtggtcattaaaccattagtttacccctctagaactggggtctgcaaactcccacctgcagccaaatctggcccacctcctttttaatgtaagggctgtgagagtggtttttactttttttaatgattaaaaaaatcaaaataatattctgtgacaatgacaggtgaaatttatatgtgacaagtgaaaattatatgaaatttaagagtccataaataaaatttgttggaacacaaaa

SEQ ID NO: 17618 - DNA, 476 bp, Homo sapiens
caaatttcaactcataggagcttctcatgaagttcatttttaagaatcatttcacattatcacagagacataatggctgatactacaaatgtttaagtgaccactatttgagctaaagtgcctttcccagaagctgattgcagtggtatggaacatttgatcattattatgggtcctctagtcttcttaaagggggaaatgaggcatttgctttcttctcagtgctgaggagtcatttggcttgattctcagaataattctaccatctgaaaggaatttacctcccatgttgtgtctgttgagtttatgaagtttatatcattctgtaagggatgagatagtttgaactgcaagtcccttgagttaagaatgactctaaaaacatcacaagtgatgggaggmaattaaaactttttgaatgtcagtcatataaacattgataaaaatggaatatatcagtttcgttgactgggtaa

SEQ ID NO: 17619 - DNA, 277 bp, Homo sapiens
actgttgaatatttgaagcaagatttcagattttagtttaggtgtaatagaattatccattctgaagtttaatttgctttacttttagctggcatgaaacacaaaacacttgatgaaaaaatttgattatctgggcaggtgcagtggctcatacctgtaattgcaatactttaggagaccaaggcaggaggattgcgttaaatgtacactgttgagttttctgtacataaaaataattgaaataatacaaattttccttcaaaaaaaaaaaaaaaaa

SEQ ID NO: 17620 - DNA, 462 bp, Homo sapiens
catttcgttctcccgccgmcgacccgcgccgccaaactgaggctcttcaataagccaggcagcagccaacctgccaacacctactgacactcactcatctcccagagagagaaagagagcgagagagagcgagcgcgagagagcgagcgcgagtgagagcgagcgagcgagcgaggaaagagagagagggagagacaaaatacctaccaggaaagggggggaggaagtccaatttttgcaaactattcatttttttttcttgatttttctcactgctttctttgaacaatactttaaagagagaggatcgtattatagataccgcgggggcaaagctaaaaaaggggggaggggggaggaaaaaaattcaagaagcagaaacccctcgcggagttttactggaagaaaaaaacgggtctgaaagattcctcctcttcatcatcatcaaccatcattcattca

SEQ ID NO: 17621 - DNA, 597 bp, Homo sapiens
atgattcccacatagcctgggtcctggataggatttagattccacagatactctcacagtgccatttggctgtagaaaagaactaaatgtgaagaaaagcaggatataaaacatttatttgctggcatgtatagaaatataactggtgtcattctgctgtcagcatgtcagaagattttagacttttctgcagtggttatgaaagctttaaccatgttacaggggcagactgatactggagtttgaaagctactcttggagacatgggctgcctactattttggccttccaacaattttataagaaactcaatagataacgataaataccttcaagcttaaaatcgcgattatgatttctgctgtgcgcaatgaaactctgagtgaaacagtcctccaggattttgaagtcctctgcatccgggcagtggaacagaagtgtggagaagattcatcatctgcttcttaaatgccctagtcagaaaggggtactcatcatttctgttcatattttatacggctacaaatagatgtgagaagagcaagaaaacatagtcctggcaggcagttgcttctgatgacactctgcactctggag

SEQ ID NO: 17622 - DNA, 249 bp, Homo sapiens
gcgcgccaagacggctcggatgccggcggtctctgctgaagagagaagatggcgcttgacggaccagagcagatggagctgcaggaggggaatgcaggcagcggactccgccaatattatctgtccaagattgaagaactccagctgattgtgaatgataagagccaaaacctccggaggctgcaggcacagaggaacgaactaaatgctaaagttcgcctattgcgggargagctacagctgctgcag

SEQ ID NO: 17623 - DNA, 221 bp, Homo sapiens
  misc_feature 132,198,204: n=a, g, c or t
atatactgggagaggcttctgggtcaaaggaccagtctgcagagggatcctgtggctggaacgtggagatcttctacagaggccagtggggcactgtgtgtgacaacctgtgggacctgactgatgccagcntcgtctgccgggccctgggcttcgagaacgccacccaggctctgggcagagctgccttcgggcaangatcangccccatcatkctggac

SEQ ID NO: 17624 - DNA, 243 bp, Homo sapiens
aatcaagcatcagtcatataataccacagatttgaactcctgcccacaggggacctcccatctcctggcccctatcataggatcactgggcctacctgcactgtggggccaagccctgtctttttcccaagccctcaagcacacgcatgagtgttcatcccgacttggtagggggcttttcacccttacaagatggcaaaagattcacattgcttttttaaaaaaaaaaaaaaaaaaaaaaaa

SEQ ID NO: 17625 - DNA, 215 bp, Homo sapiens
aatcaagcatcagtcatataataccacagatttgaactcctgcccacaggggacctcccatctcctggcccctatcataggatcactgggcctacctgcactgtggggccaagcctgtctttttcccaagccctcaagcacacgcatgagtgttcatcccgacttggtagggggcttttcacccttacaagatggcaaaagattcacattgcttt

SEQ ID NO: 17626 - DNA, 279 bp, Homo sapiens
aatcaagcatcagtcatataataccacagatttgaactcctgcccacaggggacctcccatctcctggcccctatcataggatcactgggcctacctgcactgtggggccaagccctgtctttttcccaagccctcaagcacacgcatgagtgttcatcccgacttggtagggggcttttcacccttacaagatggcaaaagattcacattgcttttttaaaaaaaaaaaaraaaaaaaaaaaaaaaaaaaaaaaaaaaaaaaaaaaaaaaaaaaaaar

SEQ ID NO: 17627 - DNA, 367 bp, Homo sapiens
attaaatgtggtgaaaggaacaggaaaagaagtgtctttcagaatagcttacatttccttcctgcttggcagaatcatttgtgagttcacataaatgggttcatgcagataataaccaagaaatgggaagacattaattagaattgatttacaattacacacctcactcaagcccattagttacattctgtttttcaaaattgctttcattttgtgagtgtgccagacttttaaagatttggtaagacttgatgtcagccttctccaaggcctttaatacatgataggtcagttgccaagagggataatttttttttgtaattaggaaataacattttaaacactgtatcctgtaaaaaaaaaaaaa

SEQ ID NO: 17628 - DNA, 700 bp, Homo sapiens
  misc_feature 658: n=a, g, c or t
cacaattatgagaaacctcttgaatgtaagcaatgtggaaaagccttcagtgtgtccacatccttaaaaaaacatatgagaatgcacaatcgatagaaactctataaatgtgagaaataggagaaagttttcaattctaacagatgctttcaaagttgtgaaaattcccactgaagagagaaatcctgtcaatgtaagtaatatagaaagcgagatacaagatgattcatgtatagtcaggtaccacataatcatgtttcagtcagcaatggaccatataggttggtagccccataagattatataacacctaaaacatttctatcaaccgcaatttagtagcagtagtaacaccatagtgcagcacattatttaagtgtttatggtgctggtgtaaaacgtgctgcactttcagttgtataaaagtacaagacagcggccggggacggtggctcacgcctgtaatcccagcactttgggaggccaaggcgggcggatcacgaggccaggadatcaagaccatcctggctaacacggtaaaaccccatctctactaaaaatacaaaaaattagccgggcgtggtggtgggcgcctgtagtcccagctacttgggaggctgaggcaggagaatggcataaaccaaggaggccgagctgncagtgagctgagatccggccaacagagcgagactctgtctct

SEQ ID NO: 17629 - DNA, 388 bp, Homo sapiens
gagccgagacggtgcagggcgggagaagcaccttcactcccagcctgcgccccgatgctgcgcgttctgtgcctcctgcgsccctgggaggccccttcgggcccgcggctgcgcttccgacggggcggccgggggctcagagatccaagtgcgcgccctggcgggtccggaccaagggatcactgagattctgatgaacagaccttctgcccgcaatgccttggggaatgtcttcgtcagtgagctgctggaaactctggcccagctgcgggaggaccggcaagtgcgtgtcctgctcttcagaattggagtgaagggcgtgttctgtgcaggtgcagacctgaaggagcgggaacagatgagtgaagcagaggtkggggtgtttgtc

SEQ ID NO: 17630 - DNA, 381 bp, Homo sapiens
acttaactcataggaggcctgtgataaatgggagcttttatcatagactgactttcctgctcctgttttgcttcttctttatgtttaggtgaaattacggatggtgctactaaaacatatcaataatttgaatttcacttttgtggatgctttaaacatcatagtcattagaaggtggatctggctgattgtactttaagttttcagtttgagctggagctttgtattataacaggagggtactggacaagatgaggaaactgaggtacagatgggaaacttgctcaagttcacacagcaattaagtgatcaagtccaagagcwaaaccatgcaggctggctccagagctcacgatagtccaccactgctttccacsatca

SEQ ID NO: 17631 - DNA, 443 bp, Homo sapiens
actggttgttcagcaccttcggtccggttgaggttgtcaagtcggaccaaacaggttgtttctctgcagtttccaacatggcagggaggtttaatagacatggataagaagtccactcacagaaatcctgaagatgccagggctggcaaatatgaaggtaaacacaaacgaaagaaaagaagaaagcaaaaccaaaaccagcaccgatcccgacatagatcagtgacgtctttttcttcagatgatcctatgtttccttcttcctcatcatcgtcttcaggaagccagacagattcaagtattgaagatgctgccaagggaaaaattaagaagaagagaagagagaaaacaaataaatgggaaaaaagaaaggacaaaatatgaaacatcaaaaaaaaaaaaaaaaaaaaaaaaaaaaaaaaaaaaaaaaaaaaaaaaaaaar

SEQ ID NO: 17632 - DNA, 145 bp, Homo sapiens
taaatattagagtattcatgataaaacattttgagaaggggtaagcagtgagttattacccacaatttaaagcaaattttgaatgaatctttaagttaggtatctaccttcccaccagccccccaaaaaaaaaaaaaaaaaagct

SEQ ID NO: 17633 - DNA, 510 bp, Homo sapiens
agaataaaggtaaataaatggctttgtggtggtaattactggggtgtttggattgggaggaataaacattggtttatattttataagttcagtttcttggagaaaagggaatgtgtagctgttttactttaattatattttctctattctgcctcaaaacctagttgcggttgttccttgagcactgtggcatggagctgagtttctgtggctagatcttagcaaaaccaaaatacaagtggctttagcgccttgccccttctgaagctctgctgtcattacttcagcctgagctgaaatgctagctgaaaggcagggcaaatgaagaagaggagccactcgctgttcctaggcccagcacattggagatacaaagtagcataacccaaataccgagattatttgtttttagtatatgttaagaaagatagtagctatggtacgagagatacagcgtagtaaacattattgagacttgtttggggaagaagacccttggagaaatgcaaa

SEQ ID NO: 17634 - DNA, 471 bp, Homo sapiens
attctgggatccatggatgccagagaatctctgaacagagtttctattcggctttccacactctcaagtttagcctctgacatcttacctttcttgctcatggtttccttaactatgtatacatcccttaaatgaacatgaaatgatcataagccttcatattgctacaggcagcttgaatacagtctccagggtgttacccagagactgtggggtcatttccattctgtatctccaagatctcataagctaaaatagaacagattgagcgttcactcaccaacaacagaaaatttgggtcaactttggccactctctccacaccaattctatcattgctactgcaaaaccaaaatatccagtgaatgccattacagcattagaaatgaggaggctttttcccagcccttctgaactatggctattgctacctccawgacagtgagcctggtcacttctcttcctgcagaa

SEQ ID NO: 17635 - DNA, 440 bp, Homo sapiens
ttcaaacacaagcacggaagaagagattgcactgaccagagtaccgccaggtgtgatgctccgtagtcgcagggatgaaggaaaaccatgggcggasttgtsatggacagctcctaggtggacataaatggaaactcattggttctggggcacggcgggaagagggagacggmcctggacggccgcaccaagaatttcacaacccaaacccgactagaaagcctgggttatggccacaccgtgcccttgtcagatggaggtaaggccttctgcatcatctactccgtcattggcattcccttcaccctcctgttcctgacggctgtggtccagcgcatcaccgtgcacgtcacccgcagccggtccctctacttccacatccgctggggcttctccaagcaggtggtggccatcgtccatgccgtgctccttgggtttgt

SEQ ID NO: 17636 - DNA, 461 bp, Homo sapiens
aagagattctggttcctagagaggccagagatgtttgaagtatatcgccccaagtggcacggaggagaaagtgacacccggaaccgggaaaggacttgtccaaggtgaacgcaccagcgaccaggtctcctgccgctcagactggacttgtttctaccgttaatttggttctgcggtgcttcagagacagacagacccaagtcccaggcacagccccaccacccccttgcgttaacaagtctcttcaactctctgaatctgtttcctccgctatcagatggagattacaacctagctcaaaaggctgctgtagaatggccattaagtctgtgaaaagaggctcaacatgattagtcatagggtgaatgcaaagcacgaccacagtgagatcccacttcgcacccgctagatggccataaacaaaaagacagaaaagctcaagggttgcgagagtgtggaga

SEQ ID NO: 17637 - DNA, 340 bp, Homo sapiens
  misc_feature 106..107,141: n=a, g, c or t
atgaccggatgtctgtcacagtcatcaaggggtcttgtctgtaatgccaggaggtgtagcacgagatgggaaggtgggggacacactgaagcgaggaaatcctagnnggagggccagcctggaggggcgcaaataccgtcnbbcccaggccccgccccaccccggcagccagagccctgcaagcagtgggggctttctacataagaggcatccacgctgtgctgctctgaacattgagagaatgttaggctgggcgtggtacaggctatgctaaatcccagcactttgggaggccgaaggtgggaggattgcttgagcccaggakttcaagacggagcct

SEQ ID NO: 17638 - DNA, 518 bp, Homo sapiens
aaaaccaaacctatgcccaaatcccatctgtgtgggtttatctcctgggacccttcctaacatattagtcagagtccaatcaggaagcataaaccactcaaaagtttaaagtggtaaaatttaatacggagaattattcattataacaggtgaacagcataatgagagattggctagcacaaagtaaagagaactctagagaatacaggactagcccaggccaggcatggtggctcatgcctgaaaattccagcaatttgagaagctaatgcaggaggatttcyttaaggcccaggasctagagaccggtctgggacaacacagtgagaccctgtctctgtccaaaaaaaaagaaaaaagttagctgggagtggtggtgcacacctgtagtcccagctactcggaatgctgaagtttgagcctgggaggtcaaggctgcggcgaggcatgattatgccactacagtccagcctggtgacagagcaagaccctgtctcaaagaacaaaacaacaacaac

SEQ ID NO: 17639 - DNA, 534 bp, Homo sapiens
ctctctctcttctctaggcatgtgctctgagaaaaggtcatctgaggacaaagtacccgtctgcaagccaggaagagagcccttgccagaaactaaaccccgctggaaacttgattttgcgctttccagcctctagaactaatatgtgaaaaacatttaaatcagaaagtaaatgacaggatgatttgcaagacacagggatgtaaaattaaaaagcctctcgagctccaaagaaattactgtttaatattatatcatgttgaatttttcccaatggtaatcttatgatggctgcagctacctgttaacttcaacaagcacactggcctggagactacatgatggtgtctcagtaaaggatttacaactgcaaacatctcaagcagcagtgccacatccctgctacctccctgcttgtgcgtgtgtccctacattatccaaaataggggtgggctaatgacgattgcaggctaactccagcctaccacttgcttctataaataaagtcttattgtacaaaaaaaaaaaaaaatg

SEQ ID NO: 17640 - DNA, 667 bp, Homo sapiens
ttatagcaaatgcttcacagaagtagtgaggatacagaattgatcagagatagtcattagagccttcagaaagagcagctttggagtgagacagaaagactatattgaatttattgacgaacaaaagatctacaaatggagacaactcttgaggtttggtttgtttcttagtttggtttcttgtctttattggggggtagggcacacaaatagaatggtggctacagtgtcaaattgtttataaactttatactagccgtgtaacttgggcaagttattcaatatctgtgacactcctatttcaaaaatgtaacatggataaaatacttgcttggttttgctatagggattaaattagataaagtgacataatacatgtaaagtgcttggtcccataggcctggacattgttagcttgtattagttaatttataatgggtactttttccccctttgtcaatgatcccatccctaatacctagcacgtggctgttcacatagtatggatttaataaatggctatggaattaatgtacaatgagaagtaggttttatttatttatttttatkattcatwcatttatgtatttacttagtagagacagagtctcgctctgttgcccaggctaaaatgcagtggcatgatcatgaatcactatagctcgag

SEQ ID NO: 17641 - DNA, 351 bp, Homo sapiens
cacctgggatggggtttgtgggcaagttgattttgccacactgtagggcccaggtggtcccattgccaccgtgaagccaaattctagcccaagtctggtagagcagtcgggcagctagttttcgggggaggatgatgtggtgggacagaggacctcagtggcctattacggagccctcttcccagactaaattcatagccgagagctcggggggatggtagagttaaaatttaaaataattttctaaattctgtatttggatattagtgtttaagtggtaatttggcaacagtttataaagtgatgttctgaataccataaattatgtgtaggactgtcaaaaaaaaaaaa

SEQ ID NO: 17642 - DNA, 459 bp, Homo sapiens
agatataaggctcctacctaatctatcctgcaggcatgctgctgccacacttcattaacctaacaaagaactatgattgctgatggagakacaagtaggcccttctgtgaaaggagaaatgggaggtggaatttgaatggactttctgtgtagaaggctcagaggtgattgtgctactgacagaggcctgggagtccctctgctgccgtcctacacccaccccgcctgccctctgacgggggaagcagaatcataggttctcaagaccaaaaggcaacttcaakggaagaagtgcggatgcgttttagagakgcttcattttgttcttgaaatcaakatcccccatgttcaagctctactaacctccctgagactcatgttcttatctacaaaatgggggtacttgatcataaactgttgtacaattacattaaacgatgtttagttaaaaaaaaaaaa

SEQ ID NO: 17643 - DNA, 515 bp, Homo sapiens
tagttagtgtcaaaaaagaaatcaatacatctagaagggggggcccgcctggctgcggttcagatgaaaagggtttgtgcacttcaggtgctgcggctcattccgagccagcagggaagcaaggaccgtcctggactgctttttttgtttttcagttttttattacatatatgaaacataaaatttgccattttaaccatttttaagtctacagttcagtggcattaagtacattcgcatactgtgccacccttaccaatatctgtttccaaaatatttcatcaccccaaacaggagctctgcacccttaaacaacaactccccatcccctggtcacctctagtctacttcctgtctctatgaactctgcacactgtttgtataaataaagttttattaggacatagccacgcccatcatttacacatagtggctgctttcactccacaagggcagagctgagtaattgcaacagagactctcttgccacagtgcctgaagcatttactatgtgg

SEQ ID NO: 17644 - DNA, 66 bp, Homo sapiens
aggacgtgttccgaggaagccagacccggagccgtggcctgccgggccggcgacatggatcccctg

SEQ ID NO: 17645 - DNA, 64 bp, Homo sapiens
akgacgtgttccgaggaagcyagacccggagccgtggcctrccgggccggcgacatggatcccc

SEQ ID NO: 17646 - DNA, 537 bp, Homo sapiens
caattattttagctgtttcataatcattaattgttatgtaagaagaatgtctgtgtttttccaggaatgcatacttgagtgtgtagaggtaaaatgacatgcctgggatttgctttaaaataatatcagcaaagagaaaaggagagggagaagataaacaaatgtagcaaaatcatgaaaagtattgaattaggctgatgagttaatgggagttaattcaagtcgtctttatctacttttgtgtatatttgaaatttttcattataaaaacatttatacagttcagggtttttggttgtcttttatgtccgtcaccactaactagattgtgtactctaaggaagggattacaacttgtttttgaatctctgttgctttatatagttgctgacattgtagcatagtgtatcatgcacatacagtgttgaataaattaataaaagcgtatttaattaagtatatgctgtcccacagtacttccctttctttctggagcttactcccatgacacttactactgctgcctctttctttgat

SEQ ID NO: 17647 - DNA, 501 bp, Homo sapiens
gagtgtttctgtgcaatgcaaattgctttggcttccacacagctcctgtcgcttcaagtgcggatgagtgttgctggagatggccactggagaggctgagtcaaatcaatctcctcacctgaggacttcctaagaccagcgcactgaaggaccagcagcaacaacaacaataatgctaatgctcccttatggacaagactgcaattctctgcctgctgaagctcagctatgaccacgtgacttgccttggccaatgaaagaggaagagtatgtaacactgctgaatggaagcaagtggcccctgcccctgctgcagagattctagacatgtgtgccatgctggagcaaggagacagggagtcctggagaaaggagacatggaacagagctcccagcccagtcaatatgtaacatgagtgagaaataaataacactttgttgctagaagttttttttaaactgaagtataactcagcttcccctgacccatgcagaaagtca

SEQ ID NO: 17648 - DNA, 159 bp, Homo sapiens
  misc_feature 116,141: n=a, g, c or t
tacaccgtcagastgctgagtattccgcattcaagctggagaatgagaggstkaaggcagctttkctccaatggrggacaaactcaaccaggcacamctcgaggtccagcagctgnaggcctcagttgaagaactattgangggattgatttgacaact

SEQ ID NO: 17649 - DNA, 140 bp, Homo sapiens
aaaaaaaacaccttgtgtaatgaaaaacccagatctataacctctccctatatattctgcatgcattgaagtaggctcaaaccctcagggacctggtatagacgcagaatctgtttcacacaacaactgctatttgaagg

SEQ ID NO: 17650 - DNA, 593 bp, Homo sapiens
attttaattatgtcggcctgcagtcatttccactgcccataatctaatgtgttttgcctgttgacatgttaaagatgggagccacttagagccattcttcgatcttgcccttcctacctcctcaaactgagagtatgagcatctgcttcaaggcacacacgttcccaattagctggtgtaaagtcacactaaaaccaagcaaaaagggttctgcaacataagggaaagggaagtggaggcactaagattgcttcggcagccaaaggattccttgggaacttgtaaaaggtagagtggggtgggtgacaatgaacatgtacttgtgggtttgttttctgggaatagtggaacctaaacttctacatctgaaaggaaaatagattaacctttttaaagtttattactgaatttttaggcctcgtgttttggacatgtgagtacaagccagtggtacagtgccagtcatttactgcgggcacctgagattgctactgatctacatcacatcagcaagccaatagttggcattagactatgtaaaaraacaaaatccaggccgggtgcggtggctcacgctgtagtcctagcacttt

SEQ ID NO: 17651 - DNA, 604 bp, Homo sapiens
aaaaagcgccattacgcagagagaaagttacgaggttcgtggccgcggtttccccaggcagctggcgctggaggcttcggcgtcacgtgctggtctggatttttctcgatgcactggggaaagcggtggactcttatcgtgggagggctcttgatctgtgatttatagataggcacagctactcccgttcgggaacccaacggcagacaggtcctagtgcccatcagatacccgcggccgggactcggagctgtggggtgtggggaggcggaggcaccaactaagagcgacctagcatcgcaaagccgccctcggggccttcatggcgggacgctccctgggaaaggctttagcgcgggtgtctctctctctggccttggctctgtgactatcaggtcctcgcgctgtcgcggcatccaggcgttcagaaactcgttttcatcttcttggtttcatcttaataccaacgtcatgtctggttctaatggttccaaagaaaattctcacaataaggctcggacgtctccttacccaggttcaaaagttgaacgaagccaggttcctaatgagaaagtgggctggcttgttgagtggcagactataa

SEQ ID NO: 17652 - DNA, 333 bp, Homo sapiens
aactttgggggatgctatcctatttggtgattttcttgctttttctccaaggtaaagtcagaatcgattgaaatatcagtcactttctcactgacaaagtgacacagcagccgatgggagggttgacctgtgaggaatttgtggagcgtcaagccccagccagaggaaggagtcagactgttggagggcctgccgagaagtcacggcatccaatcttttgaccaaggggggaagcaatcctgtggttaaaaacatttgagaaaagagacctacagatagccttttgggcatactgtttcttggcacccaaaaaaaaaaaaaattgcgaaaagc

SEQ ID NO: 17653 - DNA, 98 bp, Homo sapiens
actttgggggatgctatcctatttggtgattttcttgctttttctccaaggtaaagtcagaatcgattgaaatatcagttccamcttttttccttcca

SEQ ID NO: 17654 - DNA, 322 bp, Homo sapiens
aaaaaaagcccaagggcctaggtaaacaatggacagcatcctggatgatgatgcaattttaagcctgaaaagaatatttggtcttcaatcttggcaagcatacctgtaaagtagatggtaaggctgctgatgagtaatcaagtcatagctggaatgtgabtgcctggctgatcttccaaggtccccttgcatctatgtgtggccttatgaatcaatccttgccaatggaaagtgaatggaagtgatgtgtgtcggtcccaggactgaccatagacctcctgcatgtgctccttaatgctatttcttcagttcagggtgggaa

SEQ ID NO: 17655 - DNA, 396 bp, Homo sapiens
  misc_feature 160,355: n=a, g, c or t
aagggcctaggtaaacaatggacagcatcctggatgatgatgcaattttaagcctgaaaagaatatttggtcttcaatcttggcaagcatacctgtaaagtagatggtaaggctgctgatgagaaccatttgagtaatcaagtcatagctggaatgtgantgcctggctgatcttccaaggtccccttgcatctrtgtgtggccttatgaatcaatccttgccaatggaaagtgaatggaagtgatgtgtgtcggtcccaggactgaccatagacctcctacatgtgctcctttatgctatttcttcagttcagggtgggaatgggaatgcccagagcaactttggaagctatangctgaggatgctagaactgccatcagcctgggaccctgaac

SEQ ID NO: 17656 - DNA, 487 bp, Homo sapiens
gaagtagatgatgctaatgaggatgactggatgtcacacccatgatgctattaggtcctcataatagcatagtgaggtggacagctagtacctgacccatctcacagatgaacatactaatgcctaacaaagcagaacgactcacgctgggtcccagagctggccagtggaagcactgagacctccacatactgaaggcatggactattgaccgctgttggtattggtctcatcattgactatcattaagtgttggctgtttgcatgcttcctgcccagtggcaggttcaaagaagcccgcagaagcgtgctcctttctttcccagggcccgcaattgggctggaagatagagcaacaaaaagcgcccatgtaactcatgggaacattcatgtgtgctgaatggcaggtgaaggtgccacagagaggctgaggatttcagagggcacatgaactggagtgaggtcgcagagcaggaacccaagacct

SEQ ID NO: 17657 - DNA, 170 bp, Homo sapiens
gagcaaggagaaatgccccaaaggagactgacccggcgcggtgctggcgggagcgctcaagggcagcggatttgttgttgttgctgttttcctttgtgggtgtttggtgcttgatttccagaaactctccagcgacttggacttcttcttttttttttttttccttttaa

SEQ ID NO: 17658 - DNA, 511 bp, Homo sapiens
tatttttgttgttcattgttaatgctttagctctcaagtgtctgatgttcatcccattttctccttccttagtttataaatgacagtttattttcttaggattctcttatttatgttttttaactgtaaggattcttgacatgtaggtttttaaaatgttttattgtagtaaaatatatataacttaaaatcgaccattttactattttggtatacaattcagtgccattaagtatgttcacaatgggctgggctcgatggctcacgtctgtaatcccatcactttgggaggccgaggcgggtggatcacctgaggtcgggggttcgagaccggcctgaccaacatggagaaaccctgtctcttttaaaaatacaaaattggctgggcacggtggtgcatgcctgtaatcccagctactcaggaggctgaggcaggagaatggcttgaacccgggaggcggaggttgcggtgagctgaggtcgcgccactgcactccagcctgggcaacaa

SEQ ID NO: 17659 - DNA, 475 bp, Homo sapiens
gaaatgccttcatttggtttgctttcactgcaaaaaatctaataatttttttcagggtagagatgggtggtagttgacttaaagagtaagaatattacctacctcagcacaattagcaaatcagttatggtgggactagatattgacttttgcttwaattaggtatcaggaaagataccattcctggaggccagcatattttcatttttattcggatagctctcaagtgtctgatgaagtaagtaagaaaatgtcttgaggagaaatgggtttgttaaagataacatgtgtgatttcaaacctgaaaatgtgttgtagatagacaagaaaaggtcctccttctttaattactactgctcgaaattaacaacaccatcatcagtgtattgattgtgcaggaaaatgtgtttactcatgacatgctcacagatgctctgtgctgggagttgggctcttaagaggacctacttgggag

SEQ ID NO: 17660 - DNA, 314 bp, Homo sapiens
aaaaaaacacgacccaccttctagccctcctcccctttccccgcccactccgggctggccttatccagtagcgtctgggtccctggactaaagccgtcaaatgtaaccaattgctgaggagctctcccctaagaatcccgcctccactctgaggaacagcttcgctkatcaatggatcccctcctagacgcaatgagcgcgcggggcaaktggagaagcggctgaactgcccaatgaacaagcggtttccgtggttaggggcgtggcagaagcggtcgtcaggggcgtggcggmagttacttgggcggggccgg

SEQ ID NO: 17661 - DNA, 400 bp, Homo sapiens
ctctcgagtcactccggcgcagtgttgggactgtctgggtatcggaaagcaagcctacgttgctcactattacgtataatccttttcttttcaagatgcctgaggaagtgcaccatggagaggaggaggtggagacttttgcctttcaggcagaaattgcccaactcatgtccctcatcatcaataccttctattccaacaaggagattttccytcsggrartttgahccyaaaggcttckgrakgccytkgacaagattcgctatgagagcctgacagacccttcgaagttggacagtggtaaagagctgaaaattgacatcatccccaaccctcaggaacgtaccctgactttggtagacacaggcattggcatgaccaaagctgatctcataaataa

SEQ ID NO: 17662 - DNA, 443 bp, Homo sapiens
tataatgtgaattagtgctgtggtttaggaattggagataactcaaaggagaggtatttggtgtaatggtaggctttctggagaaaatgatatttaagccaagaactcttagaagttagctaagagagagatgggaaaatgagacgacattgctggagtagataaaactgcatgttaaaggcaggaagatggggaaaaaaagttcagtaaagctggaatggggaaatgtagtcagggactgaattttaaagggctttatcaacctcagtaaagagtttggaccttatgttgagggtggctgaaaacatattcatagtgtcatgaacaaattttatcttcagtcacttgggctgatatatagagaatggatttagagagatgagaccaggtgcagtccatatgagatgtgaaatagagaagtggaatcgtagggacggggagaa

SEQ ID NO: 17663 - DNA, 399 bp, Homo sapiens
aattaggtcaaggcatgaataaaatttctcccttgtttccactcaaaaactacaagtatagttccttgaaaatgtgaamtccgaccaagtgcagtggctcatgcctgtaatcccagctcgttgggaggccgaggcaggtggatcacaagtcgcaggtggcgtgatttgatttgtgtgaaggcaatgaaatgatacacagatacaccgaagcctcccaaaagaatcctggttccaagactcaagaagatggattaatgtttttccattaattgttggaatttatgccattttttactatgtgccatcaattttaaagcacttctgaaaagacataacaatctaaatgagatggcattttaaattcataaaaatacagtattttcctcaacttttaaaaaa

SEQ ID NO: 17664 - DNA, 404 bp, Homo sapiens
acaagtatagttccttggtaagatgctccaaccatggctgggtgcggtggctcaagcctgtaatcccagcactttgggaggctgaggcgggcagatcacgaagtcaggagattgagactatcctggctaacacgaaaatgtgaaactccgaccaagtgcagtggctcatgcctgtaatcccagctcgttgggaggccgaggcaggtggatcacaaggtcaagagatcgagaccatcctgtccaatctgtcgcaggtggcgtgatttgatttgtgtgaaggcaatgaaatgatacacagatacaccgaagcctcccaaaagaatcctggttccaagactcaagaagatggattaatgtttttccattaattgttggaatttatgccattttttactatgtgccat

SEQ ID NO: 17665 - DNA, 200 bp, Homo sapiens
gttctcactcctatgacagaaaacgagggtgtggccagcaaaggacttcaaggcccatgatcccttagrrggggscsgsyksmwtwrgggkkgsyksykgkttkkwamskkscktkgttgggggctggggaggatttacggctctaaagccttccatataacgctttaacggtgggcagagcggtttctgttgcgtcccg

SEQ ID NO: 17666 - DNA, 509 bp, Homo sapiens
aacccactccggtccccttccgcgctgtggaagctttgttctttcactcttcacagtacattttgctccctctttggatctgtactacctttatgagctgtaacactcactgtgaaggtatgcagcttcactcctgaagtcagaccacgaacccacccagggggggaacaaacaacttcagacatgccacctttaagagctgtaacactcactgtgaaggtctgtggtttcattcctgaagtcagcaagaccatgaacacacccaaaggaaggaactctggacacatctgaacgtctgaaggaacaaactccagacacaccatctctaagaactgtaacactcaccacgaggatccacagcttcattcttgaagtcagcgagacaaagaacccactggaaggaaccaattctgggcacaatgactaaattcgggctgataacgagaaaggttcctgaccaaggggagtaaaggagatggaatgaagcttgtgtgctgtacttcaagtca

SEQ ID NO: 17667 - DNA, 483 bp, Homo sapiens
aacccactccggtccccttccacgctgtgaagctttgttctttcactcttcacagtacattttgctccctctttggatctgtactacctttatgagctgtaacactcactgtgaaggtatgcagcttcactcctgaagtcagaccacgaacccacccagggggggaacaaacaacttcagacatgccacctttaagagctgtaacactcactgtgaaggtctgtggtttcattcctgaagtcagcaagaccatgaacacacccaaaggaaggaactctggacacatctgaacgtctgaaggaacaaactccagacacaccatctctaagaactgtaacactcaccacgaggatccacagcttcattcttgaagtcagcgagacaaagaacccaccggaaggaaccaattctgggcacaatgaggttcctgaccaaggggagtaaaggagatggaatgaagcttgtgtgctgtacttcaagtca

SEQ ID NO: 17668 - DNA, 416 bp, Homo sapiens
  misc_feature 302: n=a, g, c or t
agtcaaattcaaattaaaaggtcgagacacgaatcagggaatattccgggaaagaaagagggaacctgcggasctcggtcagtttggaggagtcacgtatcacacgggaaaccagcacacaagacgcaacaaaacccgacccagagaagcgtcctttacagagcgcacgggctgggagcatgtttgaaagaagacagaccagtctatttttgtggttgtttttaaataaaaggaagaaataaggggaaccgtatgtttcaaacagttatttccgtttctccatcgccttcttccaaagcganctaaactctccaccccttcctcaggaaacggagtctggagaacaacttgtctttcctgtcgccccacatttttccttggacagagcctagggttcagactttcagggctggagt

SEQ ID NO: 17669 - DNA, 255 bp, Homo sapiens
aaattcaaattaaaaggtcgagacacgaatcagggaatattccgggaaagaaagagggaacctgcggasctcggtcagtttggaggagtcacgtatcacacgggaaaccagcacacaagacgcaacaaaacccgacccagagaagcgtcctttacagagcgcacgggctgggagcatgtttgaaagaagacagaccagtctatttttgtggttgtttttaaataaaaggaagaaataagggcaaaaaaaaaaaaa

SEQ ID NO: 17670 - DNA, 286 bp, Homo sapiens
aaattcaaattaaaaggtcgagacacgaatcagggaatattccgggaaagaaagagggaacctgcggasctcggtcagtttggaggagtcacgtatcacacgggaaaccagcacacaagacgcaacaaaacccgacccagagaagcgtcctttacagagcgcacgggctgggagcatgtttgaaagaagacagaccagtctatttttgtggttgtttttaaataaaaggaagaaataagggcaaaaaaaaaaaaaaaaaaaaaaaaaaaaaaaaaaaaaaaaaaaa

SEQ ID NO: 17671 - DNA, 493 bp, Homo sapiens
cattctggttctcttcagtgtccattgagaaagtttctcaactgtttgtaaaatacggggggaaaaaaacacgcatttctaaacctggtacttaaggttatactggattgtttgctacctaattagaagttattggggaaggggcattgtgtctttttatatgatttttagccaaatccagatgttctgatacacatttctgaatacctgtctgactgtaaatacggcctgtggaggttcaggttgataaacctttcacctgactgctccacagccatgctccttgccagcttctggcacattgtacatagatttgttgaatgtttaaatgatgttgtttttctaaatgctgttctctaaaacaattttttgaatttcttttgctttccattgttttggactttgtgtgttcgtttttaaaaaaaaaaaatgtttcctaaatatttwacaccaggaaaaatatttttaaatacactggtgctaattgaaacag

SEQ ID NO: 17672 - DNA, 382 bp, Homo sapiens
agcagacattctcctccttgacactaggtgggtaggagcaggaggacagcggcctgccaacaggttgttccaggcgataggcggctttggggtcgccccaggagtccagctgcgagagaccaatgggatttgaaaatggccttgatgattcagacggccgtgacgtccgcggggtcaagttgtcggcaggcggasgcgcagagtggagtaacagcgccatctagcagctgcctcgggggaatattccgggaaagaaagagggaactgcggacctcggtcagtttggaggagtcacgtatcacacgggaaaccagcacacaagacgcaacaaaacccgacccagagaagcgtcctttacagagcgcacgggctgggagcatgt

SEQ ID NO: 17673 - DNA, 500 bp, Homo sapiens
atttccaactagctggcgggggcggaagatggcgacgccctcgggtggtcgaaggcggggtcaggatctgtgtgtctcgctttagatcaactgcgggacgtgattgagtctcaggaggaactaatccaccagctgaggaacgtgccccaggccctccctcagccaggctctgttgcagatggttctccaggacgaaaattttgtcagtaaagaagagttccaggcagtggagaagaagctggtggaagagaaagctgcccatgccaaaaccaaggtcctcctggccaaggaagaggagaagttacagtttgccctcggagagtagaggtgctatccaagcagctggagaaagagaagctggcctttgaaaaagcgctctccagtgtcaagagcaaagtccttcaggagtccagcaagaaggaccagctcatcaccaagtgcaatggtaggcgggaggccgtgctctccaccacggttatataaacgggctctttcctaac

SEQ ID NO: 17674 - DNA, 495 bp, Homo sapiens
atttccaactagctggcgggggcggaagatggcgacgccctcgggtggtcgaaggcggggtcaggatctgtgtgtctcgctttagatcaactgcgggacgtgattgagtctcaggaggaactaatccaccagctgaggaacgtgccccaggccctccctcagccaggctctgttgcagatggttctccaggacgaaaattttgtcagtaaagaagagttccaggcagtggagaagaagctggtggaagagaaagctgcccatgccaaaaccaaggtcctcctggccaaggaagaggagaagttacagtttgccctcggagagtagaggtgctatccaagcagctggagaaagagaagctggcctttgaaaaagcgctctccagtgtcaagagcaaagtccttcaggagtccagcaagaaggaccagctcatcaccaagtgcaatggtaggcgggaggccgtgctctccaccacggttatataaacggggctcttt

SEQ ID NO: 17675 - DNA, 435 bp, Homo sapiens
agccatttccaactagctggcgggggcggaagatggcgacgccctcgggtggtcgaaggcggggtcaggatctgtgtgtctcgctttagatcaactgcgggacgtgattgagtctcaggaggaactaatccaccagctgaggaacgtgatggttctccaggacgaaaattttgtcagtaaagaagagttccaggcagtggagaagaagctggtggaagagaaagctgcccatgccaaaaccaaggtcctcctggccaaggaagaggagaagttacagtttgccctcggagagktagaggtgctatccaagcagctggagaaagagaagctggcctttgaaaaagcgctctccagtgtcaagagcaaagtccttcaggagtccagcaagaaggaccagctcatcaccaagtgcaagactcagtctcaaatacaaaa

SEQ ID NO: 17676 - DNA, 475 bp, Homo sapiens
gtattttaactaatggttgccttattaagaccatctcttccacagacaagtatatcagttatgcgctcttgtcattgttacaggaattatttaaactgagtcctaacagtgaaagttttacctgacttttgctgatttttttttctttctacatggggagatttatctctggagcatctcttgtgtttttgtatggtttgcttcagtagctagagaggctactatcaggaagtgaaatggatcatttctaatggtaggtctccattgcctacatggtatttctgagagtggtatcagggtgtccagtgaaagacggataggttgacatgtcatgctcatttggcctaaaggttgttactgccaggaatggacttacaacttaccagaatgtgaatggtgacaaaaggcakgttctactctggaaaaatatggtgttattttattagaagttcatggccgggcgcggtggctcacg

SEQ ID NO: 17677 - DNA, 217 bp, Homo sapiens
tagacctagaaaagaatcgtgacgggcaggaaaccattacaccaccacctgggctgtgctctccggctcccgccgccacccccgccctcgccttcgcctccgcctccggtgcacattaaagatccaaagtcatgactgactccaagtatttcacaaccaataaaaaaggagaaatatttgaactaaaagctgaactcaacaaaaaaaaaaaaaaaaa

SEQ ID NO: 17678 - DNA, 307 bp, Homo sapiens
aataagaaaaccaaccctgccttcgcccatgcccgcccctgcccgcagttgccaaagagccgccttgtcgctgtgggcgtcagggcttggctggctcagtgcacaacccacagtggccttcagaggctcctcctgggactgggaaccgccgcaggccaggcggacggcgtgaggtttgtgttggggctggttctgcccatgctagggggtgggggagctcccaggacagaccagccttgtttctcatgtaatgcagtgacgctgtcattaaacacgtggattcatgtgcaaaaaaaaaaaaaaaaaa

SEQ ID NO: 17679 - DNA, 547 bp, Homo sapiens
acacgaatgcgctgctgttttaaaggaaaccatatataaattcgttgatatttttgtttttctaaataaaacagaacttttttctttcttactcctttcaagagacctttgagactatatttacagactttagcaaggaagtccaaactattttaactctgagccagactagaaaattcacggagaaatttttgacagaggatgtggaaaaagcgctgtaataggattttcaatggtgagtgaagggaacctcctctttttattttatttttgttgttgttagacaacaaatttttttttttgaacggcactgctccttgcggagtatggctaattcaaaggcagtacgcccagagtcggcagccttctctttttagagtcatgtcagtgtactggatcgcaagttgcaaacttccctttagtgacttgtaacttaaggacttattattttcaggttggttcaagacaacgccgccgaaaggaaggcgaatggggttgagggaaagagccgcgccttctcagtgtctctgaagtcacaaacataagc

SEQ ID NO: 17680 - DNA, 433 bp, Homo sapiens
  misc_feature 351,385,421: n=a, g, c or t
gactcgcactggagggcggccgagcgcttcctgcagttcgagatcgcctggttcgccgagccgctcttcaagaccggggactaccccgcggccatgagggaatacattgcctccaagcaccgacgggggctttccagctcggccctgcscgcctcaccgaggccgaaaggaggctgctcaagggcacggtcgacttctgcgcgctcaaccacttcaccactaggttcgtgatgcacgagcagctggccggcagccgctacgactcggacagtggacatccagtttctgcaggacatcacccgcctgagctcccccacgcgcctggctgtgattccctggggggtgcgcaantgctgcgatgggtccggagaactacggcgacatngacatttacatcaccgccagtggcatcgacgaccangctctggaggat

SEQ ID NO: 17681 - DNA, 497 bp, Homo sapiens
gctattttgaaggaaataacttcaccttaggatccaccattagttattactgtgaagacaggtaagtgaacacagcctgtcaaatgccagatcttgccccttggcagcattgttttggggaataacccagtctgtgtccacctggtcatctgatttcctactgctgcaggattctaagctcattctgattttgagagctgctttggccctctgctagctctcctcaatccctagaagacagactgatcctactaaagtatcctacttaccccaatgcaagtatctctttttcctctccgccaagacaagataaattatttaaaatgaatggatttggctgggcgtgatggctcacacctgtaatcccagcactttgggatgctaaggcaggcggtttgcttgaggccaggagatcaagaccagcctggccaacatggcaaaacccttgtctctactaaaaatacaaaaattagctgggcgtggttgcacactcctgt

SEQ ID NO: 17682 - DNA, 510 bp, Homo sapiens
gctattttgaaggaaataacttcaccttaggatccaccattagttattactgtgaagacaggtaagtgaacacagcctgtcaaatgccagatcttgccccttggcagcattgttttggggaataacccagtctgtgtccacctggtcatctgatttcctactgctgcaggattctaagctcattctgattttgagagctgctttggccctctgctagctctcctcaatccctagaagacagactgatcctactaaagtatcctacttaccccaatgcaagtatctctttttcctctccgccaagacaagataaattatttaaaatgaatggatttggctgggcgtgatggctcacacctgtaatcccagcactttgggatgctaaggcaggcggtttgcttgaggccaggagatcaagaccagcctggccaacatggcaaaacccttgtctctactaaaaatacaaaaattagctgggcgtggtggcacmtcctgtaatccagctactca

SEQ ID NO: 17683 - DNA, 160 bp, Homo sapiens
aaagcggctagaacggaggggagggggatgagcaatgagggaataatccccattccgtctggaatcagagggcgggcctgccgcggaggcatctgggaaacggagttcccaggtaggcgaccaggggccgtcagaagtcagcggcgcctgcgcgggcgct

SEQ ID NO: 17684 - DNA, 139 bp, Homo sapiens
aaagcggctagaacggaggggagggggatgagcaatgagggaataatccccattccgtctggaatcagagggcgggcctgccgcggaggcatctgggaaacggattcccaggtaggcgavsaggggccgtcagaagtca

SEQ ID NO: 17685 - DNA, 410 bp, Homo sapiens
  misc_feature 405: n=a, g, c or t
cccatttccccgggtcctttgatcacgcgcctgacggcttttccggggcccgggagccaaccgagggcgttcctgtcggggctgcagcggcgggagggagcccagtggaggckccctcccgaagcgccactgcccatgctgaccacccagccctccggctgctgatgtcatgagtaacaccactgtgcccaatgccccccaggccaacagcgactccatggtgggctatgtgttggggcccttcttcctcatcaccctggtcggggtggtggtggctgtggtaatgtatgtacagaagaaaaagcgggtggaccggctgcgcatcacctgctccccatgtacagstatgacccagstgaggaactgcatgaggctgagcaggagctgctctctgacatgggagancccaa

SEQ ID NO: 17686 - DNA, 220 bp, Homo sapiens
atttccggggcccgggagccaaccgagggcgttcctgtcggggctgcagcggcgggaggtaatgtatgtacagaagaaaaagcgggtggaccggctgcgcatcacctgctccccatgtasagctatgacccagctgaggaactgcatgaggstgagcaggagctgctctctgacatgggagascccaaggtggtacatggstggsagagtggctaccagc

SEQ ID NO: 17687 - DNA, 382 bp, Homo sapiens
  misc_feature 333: n=a, g, c or t
tccggggcccgggagccaaccgagggcgttcctgtcggggctgcagcggcgggagggagcccagtggaggcgccctcccgaagcgscactgcccatgctgaccacccagccctscggctgctgatgtcatgagtaacaccactgtgcccaatgccccccaggccaacagcgactccatrgtgggctatgtgttggggcccttsttcctcatcaccctggtcggggtggtggtggstgtgggtggaccggstgcgccatcacctgctccccatgtacagctatgacccagctgaggaactgcatgaggctgagcaggagctgstctmtgacatnggagaccccaaggtggtacatggstggcagagtggctaccagcacaagc

SEQ ID NO: 17688 - DNA, 491 bp, Homo sapiens
ttggacaagacgaggaggcgcactcagagtcagagaccccggggcagagacaggggcaagaagaaggggccaccgagaccccaagagagtcagggagacagacgcaccaaacgaccgacacaaccagggacaggttcaagcaattctcctgcctcagcctcgcgagtagctgggattacagatatccttcgagttggatttcgactgggttctgccagtgggatgtatccatgcgagattctggaactaacatcagagagagtccaagcttctaacttttatcagcggcagtgacaatagtcaagcagcattgatgacaaacggcaagagtttagaaagtaccagtgacgtgcctgatagaatctcaccacaagatggaagccaactcgtcagaagcctggaaagcccacccagcgtgggacctctgtgggtccaggatcttggaatggtatcccatggttcaatcttctggattcaaccacataaattta

SEQ ID NO: 17689 - DNA, 476 bp, Homo sapiens
attaagccaggtggtttcagtgcagtattgaactcaagacttttaggacacccaaagcctctgccacttttatttttatttgtttgtttgtgagacagagtctcgctctgtcgccaggctggagtgcagtggcgcgatctcggttcactgcaatctccgcctcccgggttcaagcgattcccctgccttagcctcccgagtagctgggactacaggctcgcgccaccacgcccagctaattttttatgttttagtagagacggggtttcaccatgttgtctgggatggtctcgatctcctgacctcgtgatccgcccgcctcggcctcccaaagtgctgggattacaggcgtgacaccgcgcccggcccagttttatattttaccgaggcactgccactcttagattttcacgtagttttaaaagactcaactttctcagactgttaggaataatacatttgttgatgtcgactag

SEQ ID NO: 17690 - DNA, 439 bp, Homo sapiens
ttcaaaatcaacgcttattaccattcctaaaatcctagggcccttaagaattatgttaaatataccctgcctgtgcagtatgagtggaataacaaagccaggatgacggtacatgtgtttgcagcatgggttactgtacattttaagcccactgttgagacctactgctcagaaaaaaaagattcctttcaaaatattgctgctcaattcagtgctttttcttggttgataaaaaacaaacaactaaaatattactcctggctgggcttggtggctcacgtctataatcccggtactttgggaggccgaggcaggtggatcacctgaggtcaggagttcaagaacagcctggccaacatggtgaaaccctgtctccactaaaaatagaaaaaattagccgggcatggtggcgcatgctgtaatcccagctgctcgggag

SEQ ID NO: 17691 - DNA, 348 bp, Homo sapiens
  misc_feature 325: n=a, g, c or t
caaaaatcgtaggactctgaagactgatgctaaacctgctgtgtctgagctctataaatggaacaacaaagcctcgctggcagcacatctgtttgcggcatggtttactgtatattttaagcccactgttgagacctactgcttgggaaaaaaaaaattcctttcaaaatactacwagctgattgacaatacaccatgttacccaagagctctgctggagatgtgcgaagagattagcattgttttcgcgcctgctaccacgacatccagccgaagcccatggatcaaggcgtcattgtgactttcaaatctaactatttaagantacatttcaggctgggggagggg

SEQ ID NO: 17692 - DNA, 447 bp, Homo sapiens
cgctgggattataggcgcccgccaccacgcccggctactttttgtaatttttagtagagatggggtttcgccgtgttggccaggctgatcttgaactcctgacctcagatgatgcacccgccttrrmctcccaaagtgctgggattacaggtgtgagccacctcgcccggccgacaaaagtgtgtatttgaatttagcaaaatcatctaaaggaagcaatatgtgttcttctaagttttaaaaaccaacaaaatgggtccagagtacatgtaccgtttgagatttgacttaccagtgagtatatgagatgactcataggagctaggattagaaaggtagtgttggccaggttgtggaaatgccgtggagtagaactgaattttagtcttcaggcatggtcactgttggcattttctgagccaggagtgatagcatcagagctgggct

SEQ ID NO: 17693 - DNA, 446 bp, Homo sapiens
gagacagtcacgttgatggtgacagcagcagtgaccgtagcagcctagaggtggccgaatgcttactctaatgggctggcccatccctgagtgtctagagttcccagcccgcttaaggaaggaaggaaaacacaggcagctctaagtgtacgacgagggaggtctcatcggcggtgaggaagcccaggcgggtccccttcccagctgaaaggggttcggaatttcactctgtcgccaggctggaatgcagtagggcaatctcggctcactgcaacctccacctcccgagttcaagtgatgctcctgcttcggcctcctgagtagctgggactacaggctggagtgcaatggcacgacctcggctcaccacaacctccacctcccgggttcaagcgattgtccggcctcagctcctgagtagctgggattacagggactatgtcacc

SEQ ID NO: 17694 - DNA, 386 bp, Homo sapiens
accctttgccgccgccttagcccgggacccgaacccagcctctcccctacccgaacaccggccccggctccaccgaggcccgggtcccccagccgtctcgccgccgccatggcggaccctaaatacgccgaccttcccggcattgccaggaatgagccagatgtttatgaaactagcgacctacctgaggatgatcaagcggagttcgatgcggactggaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagag

SEQ ID NO: 17695 - DNA, 428 bp, Homo sapiens
gaagcacggaatgtgtctcctgctgggggccacgggcgtcgggaagacgtgctggtgaaacggctgcaggaggtgagctcccgggatgggaaaggcgacctgggggagcgcccccgacacggcccacggtgggcaccaatcttactgacatcgtggcacagagaaagatcaccatccgggagcttggggggtgcatgggccccatctggtccagttactatggaaactgccgttctctcctgtttgtgatggacgcctctgaccccacccagctctctgcatcctgtgtgcagctcttaggtctcctttctgcagaacaacttgcagaagcatcggtgctgatactcttcaataaaatcgacctaccctgttacatgtccacggaggagatgaagtcattaatcaggcttccagacatcattgcttgt

SEQ ID NO: 17696 - DNA, 59 bp, Homo sapiens
gwagcacggaatgtgtctcctgctgggggccacgggcgtcgggaagastgactggtgaa

SEQ ID NO: 17697 - DNA, 249 bp, Homo sapiens
tgcagtactggccgcggcgcgtkggcggcggctgggctgcctcggggtcttcgacggccgcgttgggttttgtttcagttttcwwgtgtggcgytgcagcacaaggctgcgaatctgggagtccaaaggagtgtttgcggggagggcccgaggtcgctgtgtccggggcagagcggccggttcgtcccgagtctgcgctctttcgggtccgctgctgtgtcccggtccgcagccttgtgctgcagcgcc

SEQ ID NO: 17698 - DNA, 245 bp, Homo sapiens
tgcagtactggccgcggcgcgtyggcggcggctgggctgcctcggggtcttcgacggccgcgttgggttttgtttcagttttcaagtgtggcgctgcagcacaaggctgcgaatctgggagtccaaaggagtgtttgcggggagggcccgaggtcgctgtgtccggggcagagcggccggttcgtcccgagtctgcgctctttcgggtccrctgctgtdtcccgggtccgctctcctcagcatga

SEQ ID NO: 17699 - DNA, 153 bp, Homo sapiens
atttcgcagtgccgatctaggtaggattcagacccaagccccatgagtccacatactgcttccactcctactttactttaaatgttttaaaaagttaattttttattaatttttttatcttgttaaccgatgaactgaagagaaaaaaaatta

SEQ ID NO: 17700 - DNA, 531 bp, Homo sapiens
caaaaagcagtcttgaataatcaaaacccttcttccagatggtctaatgtcaatttcttttctgacgcagctactgttgtgtcttcttcctcattgcctggccctggttctgaagcactcatctcccagtcatcttctgttaattgctctggggtgacatctactggtgcttaaattttgtgtaatattcacaatctctttcatgatttccttgattggctctgttgtaaatcctgtgaagtcatgcacaacatttggacatggttttctccagtaggaatttattatttggggcttgatggctttaacagatttttctgtaacaccagtggcatcatgaatggtgtaatccttcgactttcttgatgttctctctagcagggttctctctggtagttcaacaatcttttccatagagtaccatgtgtaatgagcattaaaggtccttatgaccctctgatctagagagactggattagagatgttgtgtctggggagaagtagaccaacttttcagtgttgaacttaggg

SEQ ID NO: 17701 - DNA, 232 bp, Homo sapiens
atttcgcagtgccgatctaggtaggattcagacccaagccccatgagtccacatactgcttccactcctactttactttaaatgttttaaaaagttaattttttattaatttttttatcttgttaaccgatgaactgaagagaaaaaaaattaaaatctcattttaatagagaaaaaaaaaaaaaaaaaaaaaaaaaaaaaaaaaaaaaaaaaaaaaaaaaaaaaaaaaaaw

SEQ ID NO: 17702 - DNA, 448 bp, Homo sapiens
aattctgggtgttaggcccgccattcgcttgactcacgccttcgccgtagcatctttcgcagcggaccgaagagaagaaaagtaggccagagccgaactctcttcctgccaagatgtctattggtgtgccgattaaagtactgcatgaggccgagggcacattgtgacatgtgagacgaacaccggtgaggtatatcgggggaagctcattgaagcagaggacaacatgaactgccagtrgccgcaagaggaagakgacgtggaatgggacgtggaaacatctttcaaaagcgaagataatttwctaagttgaacagaactttgtcctttttwctttcaggttatctgagttcattggartrggtgcttgtgcatatatgctaggtatcwtttgccatctttctctttagatcaggggaaatgtttaarctaaataaatctggggggt

SEQ ID NO: 17703 - DNA, 387 bp, Homo sapiens
aaaactcttcatctcgcggctgtctgacttcctcccagcacattcctgcactctgccgtgtccacactgccccacagacccagtcctccaagcctgctgccagctccctgcaagcccctcaggttgggccttgccacggtgccagcaggcagccctgggctgggggtaggggactccctacaggcacgcagccctgagacctcagagggccaccccttgagggtgcaaggcccccagtggccaacctgagtgctgcctctgccaccagcagtcgggaggagccacctgaggagcctgagcagtgcccggtcattgacagccaagccccagcggcagcctggacttggtgcccggcggbtgacctvggaggagcactcgctggagcag

SEQ ID NO: 17704 - DNA, 443 bp, Homo sapiens
ggggactggggatcccgccgccgggccgcagcatggggcgcttccgcgggggcctgcggtgcatcaagtacctgctgcttggcttcaacctgctcttctggctggctggatcggccgtcattgcttttggactatggtttcggttcggaggtgccataaaggagttatcatcagaggacaagtccccagagtatttctatgtggggctgtatgttctggttgagccggggcctgatgatggccgtggggttcttcgggtgctgcggagcatgcggagtcgcaatgtgtgcttggatcattttttacctgcctcctggtgatatttgctgctgaagtaaccactggagtatttgcttttataggcaagggggtagctatccgacatgttcagaccatgtatgaagaggcttacaatgattaccttaaagacaggggaaaaggca

SEQ ID NO: 17705 - DNA, 474 bp, Homo sapiens
atagtaacaaattaatattagcaatgaacacatatatgcttactaaatgtcaagcagatttctaagcatgtttatacatattaaattgcttcacatttacaactctataaggtaaatagcagtattacgaatgagaaaaccaaggcattcggaaattaagtaacttgagtacctggaatcgagctgcgtctgccgagaagcgtctcgtgtcgaatttggcccccgcgccgagccggsraaagagatcgtggacgtccatctttacccagaaagcgccacagttctacggcgcctgcgcagactacttcccaggccccgggcagcgtcggaagagggagcttcacttccctagaaggtcagaggaagagctggatctggggaccccaggwaagctgctttgacaaccagaggsctarggtctttggggaaagttgcccagagtgaacttaccacagatgccagagactcagatac

SEQ ID NO: 17706 - DNA, 143 bp, Homo sapiens
aaccaggctactgggggaatccggcagaccagattagagctcagcaatgtttgatgagtgtcacgtgtcaagccctgggttaaaggatactttgtcctactttgtctgcaccacggtgtaagaagaggaggaagaggaggaag

SEQ ID NO: 17707 - DNA, 536 bp, Homo sapiens
atataccctgcgtggggttcactgtagtagctgcactaggtgattcttggagcgggcctgagagacaaggacatgtggatcccagtggtcgggcttcctcggcggctgaggctctccgccttggcggcgctggtcgcttttgcattttagggtctgaagcggcgacsgaaagcatttgccggcgaggaaccactgtgggctctctgactcctctccgcagctgtggcccgaaccggatttcaggaatccgccaaggaaggcgtctaaggccagcttagactttaagcgttacgtaaccgatcggagattggctgagaccctggcgcaaatctatttgggaaaaccaagtagacctccacacctactgctggagtgcaatccaggtcctggaatcctgactcaggcattacttgaagctggtgccaaagtggttgcgctcgaaagtgacaaaacttttattccacatttggagtccttagggaaaaratctggatgggaaaactacgagtgattcactgtgacttcctttaaactag

SEQ ID NO: 17708 - DNA, 449 bp, Homo sapiens
  misc_feature 142: n=a, g, c or t
aaacgggatggggagctggaccaggtgacagctgcatggacatatgccccaggctttcctgctggggtccatccatgagcctgcaggtgccctcatggagccccagccctgccctggaagcttggctgagagcttcctggangaggagcttcggctcaatgctgagctgagccagctgcagttttcggagcctgtgggcatcatctacaatcccgtggagtatgcatgggagccacatcgcaactacgtsactcgctactgccagggccccaaggaagtactcttcctgggcatgaaccctggaccttttggcatggcccagactgkgggtgccctttggggaagtaagcatggtccgggactggttgggcattgtggggcctgtgctgacccctccccaagagcatcctaaacgaccagtgctgggactggagtgcccacagtcagaa

SEQ ID NO: 17709 - DNA, 404 bp, Homo sapiens
aaacgggatggggagctggaccaggctggagtgcaatggcgcgatctcagctcactgcagcctccgcctcccgggttcaagcgattcttctgcctcagcctcccgagtaggtgtcagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggc

SEQ ID NO: 17710 - DNA, 230 bp, Homo sapiens
agatcggtggacgtgctcgcctccactcggggccaggtctatgtcccggtttcccgcagtcgcggcaagggcgccaaggcggcaggaggagggtgagcggtcaagagacctccaggaagagcggctctcggctgtttgcatcgccgatagagaagagaaaggatgcacgtcccaggagggaggaactactccaacttttcctattcagaaacaaaaaaaaaaaaaaaaag

SEQ ID NO: 17711 - DNA, 489 bp, Homo sapiens
attccgatccgctgcccctgagaggtgggccttgggagaggcagggcttggacgcccttcctcggggcagcggggtgcagggagagttcttctggctgtgagtcccggagtccccgaccctggcaccccttcagcaaggttctcaggcacatctgccgggggcgctgaggggacctgagatggacgggccgggagggaggctgaggtaagacctgaggctgaggtaagacctgaggctgaggtaagacacagtgctggggcctcccttgaagcccgtttgaagtgaggtccccacagctgtcagaggacacacagggtgggggctcctaggtgggaaacaggtaaacctcttgggcgcctggggctggaggctgagtggtcctgaaaagaacattcaggccaggcgcagtggctcacacctgtaatcccagcactttcgggggctgaggcgggtggatcacaaggtcaagagatcgagaccatcctggc

SEQ ID NO: 17712 - DNA, 566 bp, Homo sapiens
acgcacccagggaaagcacgaccctgcagacaccttttcagactctggcctccagaactgggggaacatccctgtttcaagccaccccactgtggttgtcccacagcagccctaggaggctggcactggcaggtgagagaaatcacctatccggtcttcaggaaatcagagaacagataaagtcacagtaaactcgattcctaaaatcctaccaccaccatagccctgggaagatgggatggaactgcagaaagtggtagtcacaggtcaataagaattgacctgcaaagccacaaggtaaggttaggagtgccctggagaccaaaccctgcccctgcatgggaagagggtcggacaccgcagcctaacagtcccatcctgaaggcctgtggacgcggcctgtttttccagctctatggagccaggctagactctcaccaacagccaaaccccaggctcctaaaagaatgaggaaaactgcagaggtgcyttttagcttttgtctctaagattaatcaaacattgagcggcatataaaaatctaatctctgaataatgtcttcaat

SEQ ID NO: 17713 - DNA, 220 bp, Homo sapiens
  misc_feature 122: n=a, g, c or t
ttttctccctcctagagcctggttgcagccacttgtgcgatcccggaccttgccgcggccgcctggctcctttccgcgccatgagccgcaggttcacggtcacctcgctgccccccgcaggnhhwgccagaagccctgacccagagtcccggccggcattcggtcgcagaccccgccacctcccgggggaaagacgtcaaagcaaatccaactgatcccc

SEQ ID NO: 17714 - DNA, 483 bp, Homo sapiens
acacgttattcttttcatttgtgcctgtacccagggagatgggaagggtaggcataaccaaccagtgtccttacaaagggtggcactgaggcaagaagaagtgatttgcctgtccagtgtcccaggcaggaagcaggctctccctcctcagtatgctagccattccttggacaagtgaagtgagcacctgctaagcaaggttttagtgctgcggctgtgacagcaaaaccaagtctttctgcttgtggagctgtccatctagacggggtgacggaaacagtaagtgatgcttaccatgaagaaacataaatgaggatgaggagagggaaagagattttagaaagagtggtcagagaaggcctctcaaaaggcatgagttaaagagatggaataacaggggctttgagtaatgcaaagaatgcctagggcagagggaagagcagcgtggagactgctaagcaagatcctgcctgccttgttgag

SEQ ID NO: 17715 - DNA, 223 bp, Homo sapiens
  misc_feature 208: n=a, g, c or t
tcttccggtggcggasggcggattagccttcgcggggcaaaatggagctcgaggccatgagcagatataccagcccagtgaacccagctgtcttcccccatctgaccgtggtgcttttgrccattggcatgttcttcaccgcctggttcttcgtgtatcctttcactgagcagccagaggaccagcattagtgatgtgggaagctcanggataaacccacgct

SEQ ID NO: 17716 - DNA, 536 bp, Homo sapiens
  misc_feature 300,454,457: n=a, g, c or t
tcttccggtggcggagggcggattagccttcgcggggcaaaatggagctcgaggccatgagcagatataccagcccagtgaacccagctgtcttcccccatctgaccgtggtgcttttgrccattggcatgttcttcaccgcctggttcttcgtgtatcctttcactgagcagccagaggaccagcattagtgatgtgggaagctcagggagaaaccacgctagattgccgtgggctgggctctctgcactccacagtccaccccttcctttgccttaactgctgtgcccagttacgagntcacctctaccaagtacactcgtgadddkctataaagagctcctcatctccttagtggcctcactcttcatgggctttggagtcctcttcctgctgctctgggttggcatctacgtgtgagcacccaagggtaacaaccagatggcttcmctgngsnytgcttttgtaaattacttttttttactgttgctggaagtgtccacctgctgctcataataaatgcagatgtatagcaa

SEQ ID NO: 17717 - DNA, 440 bp, Homo sapiens
tcctgtcgacgtgttcttccggtggcggacgggcggattagccttcgcgggggcaaaatggagctcgaggccatgatgcagatataccagcccagtgaacccagctgtcttcccccatctgaccgtggtgcttttggccatttggcatgttcttcaccgcctggttcttcgtttacgaggtcacctctaccaagtacactcgtgatatctataaagagctcctcatctccttagtggcctcactcttcatgggctttggagtcctcttcctgctgctctgggttggcatctacgtgtgagcacccaaggggtaacaagccagatggcttcactgaaacctgcttttgtaaaattactttttttttactgttgctggaaagtggtcccacctgctgctcataataaatgcagatgtatagcaaaaaaaaaaaaaaaaaggc

SEQ ID NO: 17718 - DNA, 528 bp, Homo sapiens
ggattagccttcgcggggcaaaatggtgagagcgttgaggggagttccagacggagatgcgaggacccctcgggtctgacccacaccgcgcttatctcctcagacgccggagatccagagggctagacgctcctggaacctccggcttgggctgaagggtggggaagggggaagccccttgccatgaactccttaggtttctcagctcgcgatttctaagggcgagaggcgtggggcgaattttgaataccttccagtttgtatatctctgttatcggtggtgtgttatctttatttggaaagttcttctgcctaacccgtgcccatcctacaatgccctgggcaaatgtttattggtgaagcacttccaactctcaggcacttggccagactttcctaggagcgcccacagcctctgtacagatctctggccacgttccatggacttctttgttttcggccacgctcctagtgaccaccgtctgacgcgcatctagctctgggatgatgtctattcatctttgtatt

SEQ ID NO: 17719 - DNA, 473 bp, Homo sapiens
ttttccactatggcttccagcactgtcccggtgagcgctgctggctcggctaatgaaactcccgaaataccggacaacgtgggagattkgcttcggggcgtctamcgctttgccactgataggaatgacttccggagarcttgatactaaatttgggactctttgctgcgggagtttggctggccaggaacttgagtgacattgacctcatggcacctcagccaggggtgtagccaagtagctaacacagagttcctcttcgaagaaaccttaagaaaatatgttcccggccgggcgtccgccgccccatctgggaagtaaggagcccctctgcctggccgccgccccgtctgggaagtgaggagtgcctctgcgcgactgctgtgcaaccatccaagtatgaagtgacagccttgtgtgttatctttctgtcctccccaagtttgcattttcgacattaaagtttacttttt

SEQ ID NO: 17720 - DNA, 265 bp, Homo sapiens
ctggtctcaggctcctgggctcagatggtcctcctgcctcagcttccaaaggcacaggccaagttgtagctttgtcccttgccatcatgcccaacaagaggttctataccttttaatgaattgactttcataaattggttatgttggtgggcaagttctttaagctggaaattgtaaattcctcctgaaatgttttttcatgcagttaccatgaactaatactacaataaaggatggtcttgggtgtcaaaaaaaaaaaaaaaaa

SEQ ID NO: 17721 - DNA, 448 bp, Homo sapiens
aagcctggtttatatccatctacaaggtttgcgaacccatgttgccgatttttttttctgctacagaacaactcccttggtacaataaaaaagacgagtatttacttttcattgaaagtggagaacctgaaaaggaacctggaaagaagcagctggaaaagaatggagcttgcttgatatttcactagataaagaatttaaggcgagtatctatctttgttctccttggcaactgagagtctgcccttggaaacatcaggcaccatggggaagcgggataatcgggtagcctatatgaatcctatagcaatggccagatggagaggcccaactcaatctgtgggcccaacaatccaagattatctaaatcgaccaagacccacctgggaagaagtaaagaaacaattagaaaataaaaaaacaggttcaaaagcattagctgaatttg

SEQ ID NO: 17722 - DNA, 398 bp, Homo sapiens
cacatcctccacctctcttggtccagcgagcgttgccgggccagggtcaagcggagggctccgacggcgcggacggagcgaasccgagccatggcgcaccaaacgggcatccacgccacggaagagctgaaggaattctttgccaaggcacgggctggctctgtgcggctcatcaaggttgtgattgaggacgagcagctcgtgctgggtgcctcgcaggagccagtaggccgctgggatcaagactatgacagggccgtgctgccactgctggacgcccagcagccctgctacctgctctaccgcctcgactcacagaatgctcagggcttcgaatggctcttcctcgcctggtcgcctgataactcccccgtgcggctgaagatgctgtacgcggc

SEQ ID NO: 17723 - DNA, 405 bp, Homo sapiens
acttccgctgacgtcggaggtcagaggttacagacaagatgtcggcggatggtagcttcgagcccttgcggagaggagcatctctgtgacagaagcttgtcgacggcggcttctaggagctagtcgaaggagcgaggttgaggcgggcagcgacccgtcagtcgctcacctgggcaccggccagctgcgagacgtgacttggggaccgcrgggaagtggagartgtkargtgccaaagactagtaatgccccgtatccccctaggaagccgggaagccaagctccgcgggaccgcttcatgccgctgactggtgtagagcccgccagaatgaacaggaagaaaggagacaagggctttgaaagcccaaggccatataaattaacccatcaggtcgtctgcatcaa

SEQ ID NO: 17724 - DNA, 499 bp, Homo sapiens
tcttcttgacttccaccagttgctccggcgggtgagagtggagaggcccctccttcatcccccaggctccctcccttcctggagctgcagcctcagcatcctccgcccagcaccccaggattcaggcgttgggtcccgcccttgtaggctgtccacctcaaacgggccggacaggatatataagagagaatgcaccgtgcactacacacgcgactcccacaaggttgcagccggagccgcccagctcaccgagagcctagttccggccagggtcgccccggcaaccacgagcccagccaatcagcgccccggactgcaccagagccatggtcggcagaagagcactgatcgtactggctcactcagagaggacgtccttcaactatgccatgaaggaagctgctgcagcggctttgaagaagaaaggatgggaggtggtggagtcggacctctatgccatgaacttcaatccccatcatttccagaaaaggacatcaca

SEQ ID NO: 17725 - DNA, 497 bp, Homo sapiens
ttcatttttgtttatgttgtctaaaaattacattgtagtgtgtctaaatattacattgtagtgtttctaaagagtgctttgaaactcagtgatttgatttattttttgtttaaaaatagttttgttttcttgttttactgcactgtgaacacagaatgtggcctataacacatctgcttccaaaactttttaaaaagcttttagtgtggcctagaacatgtccattttttgtaattgtttcacgaacaagatgaagatatcttctctgtccgtagaactgaaaactttatgtgcctgttagttaactcagtatcgtcaattatattgttcagattcatgtgttatctaattttggcctattatattcattaaaaaccaataaggttatgtgaaactttgttagtacaattgtttttgctaataaatttttataatctttgctttatgtactcaacagctgtgtaattcgaggcatataagtgcagcattgttatgtc

SEQ ID NO: 17726 - DNA, 60 bp, Homo sapiens
acgccacgggacagccaagctagaagcctgaggagccggagagggtgctggctgccgcgc

SEQ ID NO: 17727 - DNA, 406 bp, Homo sapiens
atgctcgccaggataccccctcttcccatggcgacctcagaccgcgggcgtcasgttggcgatggtctccggagacggcttcctcgtttccaggcctgaagcgattcatctaggacctcggcaggcggtgcgaccaagcgttcgggscgagagccgtcgagtggatggtggcggccggagcccaagggaaccagatggccggggccggagccgccaagcgagattctcaccttacccaatccctgccgttgaacccgatctcctaagaagtgtgctgcaacagcgtttgattgcattaggaggtgttatcgcagctcgaatttcagtttaaacgaacacctttcctctggccctcacttagcttgtgaacaggcctttttaaaatcctttcttggtgtagcagcaa

SEQ ID NO: 17728 - DNA, 490 bp, Homo sapiens
acaataccgtctccaccccacagatccaagagctcctgtctccccaggagccccccaggcctcccgaggcakkagaacagcagcccggattcagggaagcagctggtgcactacacagcgcascgctgttccctrctggaccccsggctccgtggacaccgggagcaacgacctgccggtgctgtttgagctgggagagggctcctacttctccgaagggacggcttcgcsgaggaccccaccatctccctgctgacaggctcggagcctcccaaagccaaggaccccactgtctccwtagaggccccggaggagctgggcccagccgcccacccccacccccagtgcagggctggtcttggggaggcagggcagcctcgcggtcttgggcactggtgggtcggccgccatagccccagtaggacaaacgggctcgggtctgggcagcacctctggtcaggagggtcaccctggcctgccagtctgcctt

SEQ ID NO: 17729 - DNA, 492 bp, Homo sapiens
  misc_feature 42: n=a, g, c or t
tcagcccctcggtgaccgtgcccgacatgagsstgcctgtancttgacagcagcctggccagtatccaagagctcctgtctccccaggagccccccaggcctcccgaggcagagaacagcagcccggattcagggaagcagctggtgcactacacagcgcascgctgttcctgctggaccccggctccgtggacaccgggagcaacgacctgccggtgctgtttgagctgggagagggctcctacttctccgaagggacggcttcgcgaggaccccaccatctccctgctgacaggctcggagcctcccaaagccaaggaccccactgtctcctagaggccccggaggagctgggccagccgcccacccccacccccagtgcagggctggtcttggggaggcagggcagcctcgcgtcttgggcactggtgggtcggccgccatagccccagtaggacaaacgggctcgggtctgggcagcacctctggtca

SEQ ID NO: 17730 - DNA, 322 bp, Homo sapiens
acaataccgtctccaccccacagatccaagagctcctgtctccccaggagccccccaggcctcccgaggcagagaacagcagcccggattcagggaagcagctggtgcactacacagcgcmscgctgttcctgctggaccccggctccgtggacaccgggagcaacgacctgccggtgctgtttgagctgggagagggctcctacttctccgaagggacggcttcgsaggaccccaccatctccctgctgacaagctcggagcctcccaaagccaaggaccccactgtctcctagaggccccgggagagctgggccagccgc

SEQ ID NO: 17731 - DNA, 438 bp, Homo sapiens
tacaaggaactgatttttcttatgttagcactaagggcaaaaaccaatatttataatgtaagcactatccaggtaaaacactggcccaagatttggtaaagagatttcattgcaatgtaataactacagttttttacaaattggaacagctttggtgtgtcgtaatcaagggttttttttgtttgtttgtttcaaataagccatctgattgtggtgactggggcccatgtccaagacaattcccggcatattctgtcaccctcccgtggggcgatcactgtgtggggaccccattccccagttaaagtgtgtctctgtaccttacaacagcgattcaggacccaagtgtgaacaacactcagcccgccctctggagcgtgtgctgtctttagggccctacccaaagtcactgtaacagttaagtgtgtcattaacctt

SEQ ID NO: 17732 - DNA, 500 bp, Homo sapiens
ttttccactatggcttccagcactgtcccggtgagcgctgctggctcggctaatgaaactcccgaaataccggacaacgttggagattggcttcggggcgtctaccgctttgccactgataggaatgacttccggagaacttgatactaaatttgggactctttgctgcgggagtttggctggccaggaacttgagtgacattgacctcatggcacctcagccaggggtgtagccaagtagacaaatggaatcctgtgctgaacccgaatcttccaaaaaaacagcctacaatctgtgaccaccacaagatgtgccctgatggcagctgaagtttgattcagatgggcacttttcttccccttccctgcctagtttccttttgttccttgagtccacgcagaattccattctctggtcagcagacaggcttaagctaaagtattgcctctattctgtaaagttctgtacatagttcccaagcttctgcaggggggtgatt

SEQ ID NO: 17733 - DNA, 129 bp, Homo sapiens
agacgttcgcacacctgggtgccagcgccccagaggtcccgggacagcccgaggcgccgcgcccgccgccccgagctccccaagccttcgagagcggcgcacactcccggtctccactcgctcttccaa

SEQ ID NO: 17734 - DNA, 486 bp, Homo sapiens
acaacagtatagaaaaccaattagggaagggtaggtatatgtaaaataggtgaagggtgaggatcaatcagaagaaagccaccaaatgggaaaagagactctcaatccagaacgtggatttgactcatagcttggcttccaggctttaaactgtctcggcttgaagggctcaggttcaaggacaattgcctgaaagagacctcttctgatctcaccttgttcacaacggtattctggaccagatataaacatatttttcttggccgaaagtgttatgttttacagatctctttgatactattctgctcaagccagcagacctctattcttcctgattggaaaatatcctatatgacatcttgcaaatggcaggtacagacattctgaacacctgtgtgctcactattgcttacttgaataacctttgagccatgatttttctctctgaatgatgacagctccaagattccatgaaagaccttcctg

SEQ ID NO: 17735 - DNA, 499 bp, Homo sapiens
aacaccatgttcactctagggtgaagatttaacatttgaatgtattacaattaggccttataaatcaaaaggtaaagcagaggacataaaagccctctgtgctcagtctccgtagaatggccagaaccattctgtggttggtggtctctaatcaggaaggaatgctgttctggaatttgccatttcacttctctgaggatcttcatttcgtagagtgaagaatggtatttagaagtcaagatctggaaactagactaggaaactgaaaattagagcaagaaaagcagtaaaccaagaaaagaagcctgcacaataccagcatctgaaaggacaagtgaaggaagaaaaaccaattagaggatacatcagaacaatgcattctccactctccccctctgaagattcagaattaagagaaatttggagatgaagatcacctgagtgtcctcattttactaatgatgaactaggcctaccaagccatctaatcatcctgagg

SEQ ID NO: 17736 - DNA, 68 bp, Homo sapiens
agggtcattagctgttgagcctccccgggcgggcccaagcctttggatctcaggtgaccggcacaggc

SEQ ID NO: 17737 - DNA, 382 bp, Homo sapiens
aaaaattaaacctcaccgacggattcaattctctcgttctcaggccgtcttcatcgccggagcgttttcttacgaaaagaatgggcttctggacattgttaaaaggtctgctgctctttgcaaatgcactggcaatcctcaacgaagaccgtttccttgttccaagaggatggacactcggagaactccaccaaaccggtagaagaaactctcccaaaggscaaatcattggtctgatccatgcctgccagtacatgaggctacccctcatgctcattaacacagcagtcatcgtcttgaagcttatctccggttgaagatwttgtgtagatgaasataaactacattgcgttcttcaaatgattgtgattagttacaaatc

SEQ ID NO: 17738 - DNA, 512 bp, Homo sapiens
taaatgtgataggaatgaagaagttggtactcactgactctaataactaacagtcccagggttgactgatgtagctggatccaagggtttgctcatccaaactcactctctgagatacccctagcaacacttggccttcactggcctggcttacgttcatcctaaaaccacaatgacctgggatatgcagggctctaactggccatgtctgggccccttgtctggctcagtggtaaaactgcctcttaggggcttgagattaggtgatggggcagttgttttcaattcaggagctactgccaaaagaggggtaaaatagatactgatcaatagtcttgggtcattgatttttattcccatttacttgttgatgaaaccagttcagttgtcccataggaagtcctaccttctggatttgtctgataattttcctttggcgctatttgacttgttcttctttcttctgtatttcctaaaactggaattgtgtatgacagcktgataatatacag

SEQ ID NO: 17739 - DNA, 516 bp, Homo sapiens
aaccattagtccatcgctgcccttttccattaaacattatctgccttcttagattgttttatttttttaaacaggataggtaatgcaacagagaattaacggtgcaactaacaatgaaaacgcatttgaggttcccgaatcagtgaaggctttgcaaaggctctttgcttacccattaaactagtgaactccacaagattgtgatgatgatggcaacatagttcttagatttctccaaatctccacattaaagaaaaaaaaagtcatagcaactagacacccaaaccatgaactccaacattcaagtggttggggaaaactttttgacaacttcgagacctgcctataattggcatctctgcaggagaaagcagagggggatggaaatcttctggaattttttttagtggggatggaaatcttctggacagtggtgatggttagacaactctgtgaatacactgaggatcactgaactgcacacttttaggatgatgaattttatgaaattttcaa

SEQ ID NO: 17740 - DNA, 491 bp, Homo sapiens
gattttgagtcccatccactgcccttgacacaaaaatgtgcatctccttatccccaccgtgaattccaagttctaacatctgatcaagcaagaccaccattttccctttttctttcacagcgcaggcaatgtcagtaatccaggaaattccgcaaattttacctccccagaattgacctaccaattattacccatgacttgcctcctagtccaagcatgatctgggtacttttgaggattagtggagtaatcaaccaacccaccccaatccttggtggccagactctaccagagctgaaggcagtttgaaagacagctgtgtgaaaagaatgtgttgcccaggaccactggacaagcgcctgcgagtggacatggtgggttttggttttcttaggtggacttgttcggggctttataaccatagaatggtgaacacttggaaaatactatgaaaggattaaaagttttatcgaagtaaaaaaaaaaaaaaa

SEQ ID NO: 17741 - DNA, 362 bp, Homo sapiens
agtctgtaggtgactgcagaaggaggaggagctccatctgttctctcttcaggcagttgttgtgtgtctcagtgcttgttgggttcacaacctattaaataagccggctggtcttcaccctcccagacaagtcaactcaggggagtcagcagggcacgggccttggcccaasccccagctgggccatgcctgggctgtgaagtgggcaggcgagcagcaggcaagaccatctctgcaagtgcagcatagcctcagcctagggcagcgggagtgtgtggcccaagctgtgagcaaaggcacagatggtgaaaggagtagaggcaccccatgggaaacatactgacctgttgtgtgtgccccag

SEQ ID NO: 17742 - DNA, 502 bp, Homo sapiens
attctgcctgccatgggcactgagtacagctgctcatcatactggactaatcaggtcaaggacatggggcttcattctaagtaactcagctgtcatcttcattataaaaccacacattttcctctgactctgggcaatgacctgcgtatataagctgttagtcataagggctggatggggcagcatctcaatcatatagggcacaggacagacctcagtatcaccagcaagaatccattacagttcaacatgtagtacctccagaccttttccctgtgcccctggactccaaggtctatcccaccctcagctgtccatcttctagagcaggcggtctagcctccccaaaccagaagaacttcctttttatattcaaccacctgatggatgtccctgatcagttccctcagctgcagagcacaagaagaaccttcaggatccagctttctcctcgggcacgggggaggctcggcggacctgctgattggggaaccgatatggc

SEQ ID NO: 17743 - DNA, 102 bp, Homo sapiens
gtgaagcgcacaccgacggggacgagagcgcagaggatggcgcttttagatacttccagtcttccgatgttgtgatcgcagtgtgagtgaagacactcagga

SEQ ID NO: 17744 - DNA, 149 bp, Homo sapiens
aggagtaggtttttgataaaagaattgccacctcccatcccagaaagctcaatgatggaacactaaaagcaccttcctgaagttatggctttctggcacacacaacrdatkatatagcattraaatgacctccttctaaaaagcaaaaa

SEQ ID NO: 17745 - DNA, 432 bp, Homo sapiens
taacgattaccgggtggccgtgtttggggctggcggtgttggcaagagctccctggtgttgaggtttgtgaaaggcacattccgggagagctacatcccgacggtggaagacacctaccggcaagtgatcagctgtgacaagagcatatgcacattgcagatcaccgacacgacggggagtcaccagttcccggccatgcagcggctgtccatctccaaagggcacgccttcatcctggtgtactccattaccagccgacagtccttggaggagctcaagcccatctacgaacaaatctgcgagatcaaaggggacgtggagagcatccccatcatgctggtggggaacaagtgtgatgagagccccagccgcgaggtgcagagcagcgaggcggaggcttggccgcacatggaagtgtgccttcatggaga

SEQ ID NO: 17746 - DNA, 459 bp, Homo sapiens
tataaagtgtttatttctggcatttttaatacttttggaccatggttgactgagggtaactgaaaccaaggaaagcaaaaccacagataaggggtgactactgtgtgcaccatttttattcattctgccatgtgcttatttatcttgtttttaaacagctctattgagatataatttatatactatacaattcacttaacatgtacatttcagtagcttttagtgtatttacaaatgtgtgcaaccatcaccgtggtcaattttaaaacattttcatcaccctcagaaagaaaccctgaggtggaagcaactcaagtgtctatcaacaggtggataaagaaaatgtggtatgtacatacagtggcttgagccaggagtttgagattgcagtgagctatgattgcaccactgcactccaccctgggcgacagagcaagacgttgtctcagggggaaaaaa

SEQ ID NO: 17747 - DNA, 97 bp, Homo sapiens
gtctggagcttcacattctctgccccccacccaccgcgccggcgctcccttgtcacgcctcgggaagcgcgcacctgccaagcagacaaggtcactc

SEQ ID NO: 17748 - DNA, 401 bp, Homo sapiens
tatgtctgtattgttgtagattaacactttatttatctaatgagattatgtacattaattatgctttaactacagttaacccttgaataatacagcagctaaaggcactggctcccatgcaatcgaaaacctcaactctccccactggctgaggcaggtggattgcttgaagccaggagtttgagaccagcctggggaacctaatgagaccctgtctctataaaaacttctcagaaattacccagacatgatggtatgtgtagttccagctacttgggagactgagatgggaggatcgcttgagcccaggagtttgaggtttcagtgagctgtggtcatgccactgcactccctcctgggtgatacatcaagaccttgtctccaaaaaaaaaaaaaaaaag

SEQ ID NO: 17749 - DNA, 462 bp, Homo sapiens
agatacccccggagctccagccgcgcgatcgcttycccgccgctctgcccctaaacttctgccgtagctccctttcaagccagcgaatttattccttaaaaccagaaactgaacctcggcacgggaaaggagtccgcggaggagcaaaaccacagcagagcaagaagagcttcagagagcagccttcccggagcaggcgcaggaggaggaagcgagcgcccccgagccccgagcccgagtccccgagcctgagccgcaatcgctgcggtactctgctccggattcgtgtgcgcgggctgcgccgagcgctgggcaggaggcttcgttttgccctggttgcaagcagcggctgggagcagccggtccctggggaatatgcggcgcgcgtggatcctgctcaccttgggcttggtggcctgcgtgtcggcggagtcgagagcagagctgacatctgataaagac

SEQ ID NO: 17750 - DNA, 410 bp, Homo sapiens
atggtaagcgcggacgccatggtaagcgcggacgccatggtaagcgcggacgccatggtaagcgcggacgccatggtaagcgcggacgccatggtaagcgcggacgccatggtaagcgcggacgccatggtaagcgcggacgccatggtaagcgcggacgccatggtaagcgcggacgccatggtaagcgcggacgccatggtaagcgcggacscatgcacacggaccctgactactcagctgcctatgtcgtcatagaaactgatgcagaagatggaatcaaggggtgtggaattaccttcactctgggaaaaggcactgaagttgttgtctgtgctgtgaatgccctcgcccaccatgtgctcaacaaggacctcaaggacattgttggtgacttcagaggcttctat

SEQ ID NO: 17751 - DNA, 495 bp, Homo sapiens
attgccagattccggggggtctcccagcccattgctgcagcatcctgtgcgtgacctggatctgttacttcactaggagttacaaagtagtgactttccaaatgttatccttctttccacgtttatgagctccagttcttcttgaaaaagctctaaagcacatgcctttatcatctgtgtggttaccctagcatgcggcctgcagagggaaggctcagaggttccattcctccctttatcagggatcagaatgagctggtgccctgaggtttgtggctgtgtgtgtgccgagaggacggagaacaggccagcccagatccacacctctcagtgaaccaaaagtgaccctgccccctttgcaggccccgcgtgcctactggtcccagcctgttgtctgccccagcttgcctttctacgtggaaacttgcccagtgcaatctcactgatttttgaaaatatatttgatgcgtttcagtccaaaaaaaaaaaaaaatg

SEQ ID NO: 17752 - DNA, 131 bp, Homo sapiens
aggcggctctcgtggaggcagctagcgcgaggctggggagcgctgagccgcgcgtcgtgccctgcgctgcccagactagcgaacaatacagtcaggatggctaaaggtgaccccaagaaaccaaagggcaa

SEQ ID NO: 17753 - DNA, 477 bp, Homo sapiens
agagccattttcaaatgtcccccttcctctaggcaagaaaaaaaaagaagataagggaaagacaaaggaaggaaatggaaggaaaggacaaagaagaaaagtctactctgaatcttgacatgtcagcttgattctagaagtgcgtttacctggaggacttacccacaactttaaccttgatgcttgcatgtgcctctccagcttcgtttttcagattgatgtggtaaacaccagagtcatctctttcagctatatcaatgaccagagtgctgctatcaggtcttcaacaaaccagaagactcattaggatccataatagctgccagtgtagaggagcctcagttactttcmtttgatcattatccctgggagaagaagccaacagctcctggtgaccacaataagagatttcatttttacctcttacgaarrctcagtggaacatttctcatcaccggctgkcacataatactctga

SEQ ID NO: 17754 - DNA, 488 bp, Homo sapiens
acttcccggtggagtgaggaacccagcaacacgctcctgacttcccttcccaaggactcgacctgagaaccgcctactcggagatccagagggagcgggcagacattgggggcctgatggccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcgctgcagtgcccctttgagcaggagctgctgagacggcagcagaggctgaaccagctggaaaaaccaccagagaaggaagaggatcacgcccccgagtttattaaagtcagggaaaacctgcggagaattgcsacactgaccagcga

SEQ ID NO: 17755 - DNA, 475 bp, Homo sapiens
  misc_feature 279: n=a, g, c or t
acttcccggtggagtgaggaacccagcaacacgctcctgacttcccttcccaaggactcgacctcgagaaccgcctactcggagatccagagggagcgggcagacattgggggcctgatggccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtngtcctagagcaccgccggsggaaccagctcatcaagaagaagaaggasggagctggaagccaagcggctgcagtgcscctttgagcaggagctgctgagacggcagcagaggctgaaccagctggaaaaaaccaccagagaaggaagaggatcacgcccccgagtttattaaagtcagggaaacctgcggagaatt

SEQ ID NO: 17756 - DNA, 380 bp, Homo sapiens
attttcaaatgtcatccctttctagttatggcaaataagaaaccaagaaacacaacaggattttgtcataagtcctctaggcaagaaaaaaaaagaagataagggaaagacaaaggaaggaaatggaaggaaaggacaaagaagaaaagtctactctgaatcttgacatgtcagcttgattctagaagtgcgtttacctggaggacttacccacaactttaaccttgatgcttgcatgtgcctctccagcttcgtttttcagattgatgtggtaaacaccagagtcatctctttcagctatatcaatgaccagagtgctgctatcaggaaaaactaggtgaatgcagaaaattgcatccagctgaaatgacccagcaagg

SEQ ID NO: 17757 - DNA, 399 bp, Homo sapiens
ccagcccttccaggcagcctgctgcccagttgaatgaaggagtctgctctcagagtatctgctgtgggagagccccggaccccaagcatcttcaaargtctaataattaatggggctgtccagctgaagctgacatccgcacgcagccctcccagagctctgcacctcagccagcccacggcctccaccgtctggccctgtcggctgagtggtrcccagcaagaaaacatactctcctcaggccagatttcatagtgaaaatgagaagcagagacgaaatggctcagccgccatgtactcggagatccagagggagcgggcagacattgggggcctgatggccggccagaatacagagagtggaatccggagctcatcaagcccaagaagctgctgaac

SEQ ID NO: 17758 - DNA, 517 bp, Homo sapiens
atattgttaatggctcgctataaactaccttacaacttgagtttctactccattcttactggacttttttcaatcctttaattttttagtttttgttccagtcaaagtttttagttgcatgaaacagaaactaactctgcctgatttaagtaggaaaagaatttgctgagaggctattgagtagctcacaaaatcatggagcagcaggctcagaaacagtatttttgagcagtggctccgaaggcaccgtcttcttcaagaagtttatccggaagccaatgcacccattggacataaccgggaatcctacatggttccttttataccactgtacagaaacggtgatttctttatttcatccaaagatctgggctatgactatagctatctacaagattcaggagtcaaattctgaagatctttaaagtcatagtcatggcaaccatgggaagagcagtcgaatcagaaagaagaaaaaaaaaaggttttgagacatgactctatcaactgactgtaa

SEQ ID NO: 17759 - DNA, 236 bp, Homo sapiens
  misc_feature 96: n=a, g, c or t
aggtgagccgtggctcagggtccggagcgcggtcgggacacagcgcctctaggagaaagcctggaagsgctccgggggtaccagagctcttagcgngccggcagcatgtgcggggcccaaggtcttccgggctctgcgtgggggtcgctgcggctggagaccagggagggggatggaaacggggttggaaagtaatcccacccgagcagtaaatggaaatgttttctaacatataa

SEQ ID NO: 17760 - DNA, 495 bp, Homo sapiens
gacatctttacccactttaactgaagttcccacaataatctcatcatgaggctcactcgttctcacctccagagttctggggggtaaaataatacataaatgcaaggattatcttatatatacaccaagggaaaggaaatactgcctattaagaattagcagctaacagctgggcgcggtggctcacacctgtaatcccagcactttgggaggccaaggcaggcggatcacaagatcaggagttcgagaccatgctggctaacaagcatcaagcaaagaacttgtaatacgctgaatgctgcatagaaggttttgaaactacttacctgctgtggaacacctgtataactttaaaatgcatcaatcaatctcgagagtatgatcatgcttcctgcttttaaggatctgaagttactgcwactccawgtatacaagacttctttgggacccattgaaccatctctmaatgctcatgtttgcaaaatcaattggctc

SEQ ID NO: 17761 - DNA, 522 bp, Homo sapiens
agagctggaggttctgatcagcaaataaggaaggaacaacatctgacatctttacccactttaactcatcaagcaaagaacttgtaatacgctgaatgctgcatagaaggttttgaaactacttacctgctgtggaacacctgtataactttaaaatgcatcaatcaatctcgagagkattgatcatgcttcctgcttttaaggatctgaagttaactgmaactccaagtatacaagacttctttgggacccatggaagcatctctacatgctcatgtttgccagattcagtggcctcctgaaacctggccctagctaataagttaaaaagctctaagtaatcccgagctgcatttgaatctccaagatcacttgttcatgggttggtaatactttaaagagccatttgtttaactgctaatctggatcttatattctgagccccagcttttttctaaagcaaagaaaatacaaaataaaagtaagaccaaatgcctttgtaccatggaaaaaaaaaaaaaa

SEQ ID NO: 17762 - DNA, 384 bp, Homo sapiens
acccactgtgkaactgtgagtatatgaaatctaggcaacaaaataaatagadhagagactggwwgacgtgwtgsttcctgggagaacatgtgccccatcaagcaaagaacttgtaatacgctgaatgctgcatagaaggtkttgaaackrcttacctgctgtggaacacctgtatdractttaaaatgcatcaatcaatctcgagagtatgatcatgcttcctgcttttaaggatctgaagttaactgcaactccaagtatacaagacttctttgggacccatggaagcatctctacatgctcatktttgccagattcagtggcctcctgaaacctggccctagcttaatwagttaaaaagctctaagtaatcccgagctgcat

SEQ ID NO: 17763 - DNA, 490 bp, Homo sapiens
acccactttaactgtgagtatatgaaatctaggcaacaaaataaatagaacagagactggaagacgtgatgcttcctgggagaacatgtgccccatcaagcaaagaacttgtaatacgctgaatgctgcatagaaggttttgaaactacttacctgctgtggaacacctgtataactttaaaatgcatcaatcaatctcgagagtatgatcatgcttcctgcttttaaggatctgaagttaactgcaactccaagtatacaagacttctttgggacccatggaagcatctctacatgctcatgtttgccagattcagtggcctcctgaaacctggccctagctaataagttaaaaagctctaagtaatcccgagctgcatttgaatctccaagatcacttgttcatgggttggtaatactttaaagagccatttgtttaactgctaatctggatcttatattctgagccccagcttttttctaaagcaaa

SEQ ID NO: 17764 - DNA, 501 bp, Homo sapiens
tgaaagtgtaagaggggtgctgaatggggggaacagaacttctgaggcaacttcattgcacaccctcccttgttcaaaggccacatcagttactgctgtacagataatactcttagttcctgagctagccagtaggactgtgtatccccaactgtccttacacatggcagacactcaggaaatgcctgttggattaatgtaaggaaggttggagagagagggccacctttcctgacctggaagcagtatctccctgatactgaaccccacccagaagctctctggggctgccattcctgggagtacacaggatagtcccgtcattcttcttgggtgggcggastgctgcagcacctcagccctggcctgcatgcttttaggaactatgagcagattgtgaaggcacaccaggacaacccccattgaaggggaggaccaggtctctgacaggtcaagttcaacgtgtttcaaggcatcatggattccctgttccagtccttt

SEQ ID NO: 17765 - DNA, 505 bp, Homo sapiens
cccatattaatcagagatggcaaaagaaaaagttctcatattaccaggttgattttgtgtctcatttcaaattttaatttaaaattatggttttcatttttgtttaccttaaagtgatgcttaaaagtggcatgtaattaggacacttaggtttgttgaaagcattttcgacatttgtataaaagaatttgtgataaatatatccaggtgctcaccaaagaaacatgtattaacaacttaaattagatttttctaactgatagttttcactcatttataatcagtaggagagactgtctagatgttggggcagctctatgatttaagtctgtaacatgttataactgaatttagtaccctagttttgttaagctattaggattttctaatagaacttactccccctgcctccccagccttatgtttcttttaatgacttctggatcctgagctccctttgcagtctgaaaaaggtattgcagtcagaactgtgtactgacgataa

SEQ ID NO: 17766 - DNA, 430 bp, Homo sapiens
aawttawtggktttymatttttgtwaaccttaaagtgatgcttaaaagtggcatgtaattaggacacttaggtttgttgaaagcattttcgacatttgtataaaagaatttgtgataaatatatccaggtgctcaccaaagaaacatgtattaacaacttaaattagatttttctaactgatagttttcactcatttataatcagtaggagagactgtctagatgttggggcagctctatgatttaagtctgtaacatgttataactgaatttagtaccctagttttgttaagctattaggattttctaatagaacttactccccctgcctccccagccttatgtttcttttaatgacttctggatcctgagctccctttgcagtctgaaaaaggtattgcagtcagaactgtgtactgatgataaaagc

SEQ ID NO: 17767 - DNA, 298 bp, Homo sapiens
atataccttagaccctcagtcatgccagtgcctgckctgtgcctgctctgggccctggcaatggtgacccggcctgcctcagckgcccccatggcggcccagaactggcacagcatgaggagctgaccctgctcttccatgggaccctgcagctgggccaggccctcaacgatggaggaggatattctgcagctgcaggcagaggccacagctgaggtgctgggggaggtggcccaggcacagaaggtgctacgggacagcgtgcagsgctagaagtccagctgaggagcgcctggct

SEQ ID NO: 17768 - DNA, 431 bp, Homo sapiens
  misc_feature 377: n=a, g, c or t
agtgtcagctcgcgagccctggcgtcgcgtaggagggaggatggagagcggcgacgaagcggccatcgagaggcaccgcgtccacttgcgctccgccacattgcgcgacgccgtacccgccacactgcatctgctgccctgcgaggttgcggtggacgggcccgccccggtgggcctttcttcacgcccgccatccgccaggccccgagggactcgaagtgtcgtttcggggccgctgtctacgggggaggaggtggcggtgcgcctggcctcgtgggatacgtgatggtgacagaagagaagaaggtgtcgatggggaagccagaccccttgcgggattccgggactgacgaccaagaggaggagcgctggagcgngacttcgaccgcttcattggagccactgccaacttcagccgctttcascctgtg

SEQ ID NO: 17769 - DNA, 510 bp, Homo sapiens
agttctctcttttggtcgctggcgcctgtttcctcagagccactttttcctttgtgttgtctggtcgttcactactttgagggaaaagaattttgccgttcgcgttcgattgactccgtccccaagatcctgtagccccacggacctggcgactccaccgtgttcgggtctttctaggaacccaatctgccttcatgaagaaaagacagaggcagaaaggaagatggcttactgcctgacaaattgttatcaggtatgcagaaaatgtatacttccacaaaatgacatacttgcatcaccaggtaaacacatttccttctaggcagatgtgtctccagagcttctttaagtaaataaagactcactcaagcactgagtcacttgttgaatttccccagggagtggaggttctcatactgataatccttgaaaagcatttcagcatttcagtaattgttaattaattttgtcccttatggtgcagatatatatttcttattttgctgagtg

SEQ ID NO: 17770 - DNA, 491 bp, Homo sapiens
aaggtggatcccagaggctcagactggggaagaaagttatgccatgtagaagtaaatttaatgaggccctgcatgccttcctgcagccctgtttttcccacgttcggccctgtacagcctgatctgtggaatgggggtggaacgtgcggaggctgagcaagcgctgaccacctgccagcaccgtgctgagctcccaatgtacacggattgaaccagaaatggccggggatcacccacttcacacccacaaaaccaccaacttcatatggtgcagcctgactaccacatttaatttctcagcaatcttgagaggtataaggattacatctccacttttcagatgaggagaataagtcatcactccaaatcaaacattagtgaacaacagagtgagaatttaagttctgagcccggactccaagccctattcaaaactattacatgacaccgataaatccttttatactaacctgtaaacaatcaattacagc

SEQ ID NO: 17771 - DNA, 455 bp, Homo sapiens
tcccacgcggtctctgggctggttgagctgcgccgctgcaggtagtgctgagttgctccaggtaagctcctcctctcaaaaagctctaggaaccgagccaccctcgccctaggagcaacgcccctgagtaatatggggtttcgtcggatttctgcccgccgctctggatcacacgtttgttctccctatttgagtcgcaaggccttccttcattccacctagcaggctgcttggaaaagggcagagactcattactttgcaccagattggagaggatgaagtccctgaggtccaagaacatggaaacctgacagtggacgccaacagctgtggagagaagccgggcgacagctgtggagagaagccgggcgatatgctcacgcttccgtgtgcccagcaatcctgctttatctttttaaataaaggtgattcctgacaaaaaaaaaaaaaaaaag

SEQ ID NO: 17772 - DNA, 418 bp, Homo sapiens
aagckgccgcagagcgscaaagttcgcaggtctggggctctcttcccagagagctcgtaggggaggacagtcaagggactcaagcgtctctcttgactccccttctctcgctgtgcaktggcggcgcgaggggtcgacgctcagggctaatctctatgagtcaccctcgaggccccgggtaatattgggtggatcacaagaactaatctttcatgatttggaaaccggaaggaaagaagcacttttgtagctgacttacctcaatgacatgaccagtgtctgagcctacaactgcgctatcttccctggatttttcttcacsttttcgttactcatgagccagactactctctgagctcctaccatkgggcagcactgtgctggttgcaaaggatgcttggagaacctgaccagccct

SEQ ID NO: 17773 - DNA, 486 bp, Homo sapiens
attttattttgctttgttctgcacttgaagggagcaggcacaaggctgccagaagagctcagctactttaggctgtgctgtttggaacgagggatgttaagcagaaaggcccaggctggtgggggactgggaggctgccttccagcccatccctgctgcttgaccttggatgcgtcattggtggtggaacataggttcaactatctttaaaatcaaggctgggccggcgcggtggctcacgcctggaatcctaggactttgggaggcggaggcgggcggatcacctgaggttgggagttcaagtccagcttggccaacatggtgaaacctgcctctgcggaaaatacaaaaattagctgggcgtggtggtgcgtgcctgtagtcccagctattcgggaggtgaaagcaggagaaccacgtgaatcagggaggcagaggttgtagtaagccgagattgtctcactgggcaatagcacgagactctgt

SEQ ID NO: 17774 - DNA, 413 bp, Homo sapiens
cctacgtttgtgcctctgcttttaaaggtgctgtgctggacagttggcatgccagggttcgagaagagtgaatggcttgacgtacttgcagttaactgtgcaaaattggctggctgcctctgttcctactgtactgtaactttgatcatgtctgttcctgttccattctcccaggagcttctctgcagactgacacaccctcccccaccccgggtagtggagatgctggtgtctgggtagtcatggatttctgctggacatttgaatgtgataaacaatccagcattacttaggaaatgctacatgcggaatgtgcacgtttccaggggcgagtattgtcaatcaaaaggtttgcaatgatttccttcctgccaaaaataaacatgtgaaactgcaaaaaaaaaaaaaaaaaa

SEQ ID NO: 17775 - DNA, 414 bp, Homo sapiens
aaaggcggggcctgggcgcccgcgggaaacccgggcccgttgcatccgctgggtgtagccgtggggatggcaggttcggggaggctggtcctacggccctggattcgggagctgattctggggtcagagacaccctccagtccacgagccgggcagctgcttgaggtactacaggacgccgaggccgcggtcgcggcccatcccacgcccctgatacgtccgacgtcggggccacgctgcttgtgtctgacgggacccacagtgtccgatgcctggtgacgcgggaggccctggacacctcggactgaaggagttcggcttccgcgggacagagggccggctgctgctgctgcaggactgcggggttcatgtccaggtcgctgagggcggcgcgccgcagagttctatctccag

SEQ ID NO: 17776 - DNA, 285 bp, Homo sapiens
atgctgccacggggactgaagatggcgccgcgaggtgagattccggagtaaacggttgtcctccaccccgctggaaatcctgttctttctgaacgggtggtataatgctacctatttcctgctggaacttttcatatttctgtataaaggtgtcctgctaccatatccaacagctaacctagtactggatgtggtgatgctcctcctttatcttggaattgaagtaattcgcctgttttttggtacaaagggaaacctctgtaccaaaaaaaaaaaaaaaaaggc

SEQ ID NO: 17777 - DNA, 123 bp, Homo sapiens
attccacgcagagggaaccgcttgtgcaaaggccccaagactgcaagaacatcctgaagagggtagaagagaggtctgagcgggagtgcactgctttggatgctcacaaggagctggaaatgg

SEQ ID NO: 17778 - DNA, 458 bp, Homo sapiens
cttgaagatttgtctcctgtgtttttctgaaagttttaaaccttcacagttgcagatttatgtccgtgtttattttggtgaattactgtatgtggctggcatttacatgaagctcattgtctggcaccatttgtggatcttccatggagttgcttctgtgcctccctcagaaatcatctcgatgggctgggcgtggtagcccaggcctgtaatcccagcactttgggaggccaaggcacctgaagccaggagttcgagaccaacctgggcaacatagtgaaaccccgtctctactaaaaatacaaaaattagccgggcgtggtgacgcacgtctgtagtcccagctactggggagactgaggcaggagaatcgcttgaacctgggaggcggaggctacagtcaactgagattgtgccactgcactccagcctgggtgacagagcgagactccgtccca

SEQ ID NO: 17779 - DNA, 498 bp, Homo sapiens
tagcagccaggtcaggctgggcatggtagcataggagatggtggtcctgaggtctaggcttctcaggtaaactgaagggtagccctgacctgtgtggacacacagtgggtcataatgaggtagctaaacggttgtgccactgtgaatgtctttcctagtccttgggaaactgcctgccacgtcccaggtttggtgagcattgtgagtgctcacactctgctccactcgctcagttccactgcacatgcaggcaggtgtgccgagcaggtagggcttgctggcccctctgcaccagcaggcttcacttcttaggctcccaggtcggcccctggagactctggtttttaagaaatgcacacagctacagaacacacaaccttgcataaagagggtttgtggactcagctgaagaaatccaagtccaagacatatggaattaagcactccttccctcaaaatttcccctggtggttaatgtatcaaaagccatttcatctg

SEQ ID NO: 17780 - DNA, 446 bp, Homo sapiens
acttagctcaaggggcctcgaggactctctgcgtctctggagacaagggcactacacgcacttcagaatgaagagttgcgggagcatgctggggctctgggggcagcggctccccgcggcgtgggtcctgcttctgttgcctttcctgccgctgctgctgcttgcagccccgcgccccaccgcgcgtcctacaarscggtcatcgtgktgcatgggctcttcgacagctcgtacagcttccgcmacctgctggaatacatcaatgagacacaccccgggactgtggtgacagtgctcgatctcttcgatgggagagagagcttgcgacccctgtggaacaggtgcaagggttccgagaggctgtggtccccatcatggcaaaggcccctcaaggggtgcatctcatctgctactcgcaggggggccttgtgtgccgggctctgctt

SEQ ID NO: 17781 - DNA, 348 bp, Homo sapiens
aattataaggcagttcatagatgctgctgctgctgctgctagcatttcatctgctgagaatcacactcagtagcaacagccgtccaagatacagccctgcgggctttgagtgttaacgttgggtgcatagtgatgaggcttttttaaagccttgaaacggggccaactggtaatacctaaggaacatttcctggcaacagaaaaagctctcttggtctttaaagttcatgacagattccctaagtgtttgtaaaacatctgccaaccacactgatgggctctcacacaaaggttttggaaatacagactgatttcctttggttactaaaactgatttttttttttttt

SEQ ID NO: 17782 - DNA, 392 bp, Homo sapiens
actccagttctcggaggaatgctttcaacttttctgcattcagtgtgatgttgtctatgggtttgttatatatggcttttattattttgaggaatacatccagatggcctgaagcaagtgaagaatcacaaaagaagtgaaaatggccggttcctgccataactgatgacattaccttgtgaaattccttcttctggctcagaagctccccaactgagcaccttgtgacccccacccctgcccaccagggaacaaccgcctttgactgtaattttccactacctacccaaatcctataaaatggccccacccctatctcccttccctgactctcttttcggactcagcctgcctgcacccaggtgattaaaaagttttattcctcaaaaaaa

SEQ ID NO: 17783 - DNA, 469 bp, Homo sapiens
aacggattagaaggacttttaaagatgtgtgaggaaagagctcaccgctgaagaaggctgctgcatcactgaacttcttatcactaacatagcgagattttagtttggacgaatttgaggttataggggagatagcgatrgcagaagactaggtggaaatggcacatctaggttggctgcagtcgaaacggtttgagcgtggtcgctgtggctcatcgtcggcaccaattaacgaagcgatgacatctgcgttgttaggggtttcttaaactgagttggtagaaatgcgamgtcagggttcccgccggcttcgagcctttcttggcgtatttgtatcttgagctgatttctgcgtcasccacatctcgctctgatccgcacaccccccggttgttttgcagtagcagtctcagccctcttctcgtctcatycccaaatcgtaatttcagttcacagctttttatctata

SEQ ID NO: 17784 - DNA, 212 bp, Homo sapiens
ctcggccgccaagctccgcctcccgccccgggctgtgccggggtcgcctgaggccgaccacccgcaccccacctctagcggctttgctcgaggcccaccttcttcccacccccggcaaactccagtaggctcgccctcgctgactccccacccctcaaggaaatgtgtcaaaattgtattaaaataagacaacgtgtgatgagaaaaaaaaa

SEQ ID NO: 17785 - DNA, 481 bp, Homo sapiens
attaaactgcttgaactgcttgggttgaacccaactctgccacttactggctgcgcaacattgaccaagttatttaatgtcccagtgtctcagttccctcttttgtatataggcataataataatcatacctatacttcacagagtgttgtggaaattaaataagtacatatatagaaagtgcttcacagggacaggcgcacacagtaagtgctgtgttagagccacagctgaaacaactacaaacaaaatatgatgaacttaaagagagaaagtcttcccttaggaatgcagcatatttcttatctaatttaaaacagctttatcaagattattcagatgttcaagctcaagaaccaaacgtaaaggaaacgtatgattcatccagccttccagctctgttatttaaagcaagaacacttctgggagccgaaagcaatctgcgaaatatcaaccatcagttagagaagctccttgaccag

SEQ ID NO: 17786 - DNA, 441 bp, Homo sapiens
aataaccggccgccgccgccaccgcggaccgagcgcggagttctggagtctcggacccgaagccgccacagggcgccccgcctcccgcccgccatgcccgcgccccgcgccccgcgcgctctggcggccgccgcagcccgcgtccgggaaggccaagctgacgcacccggggaaggcgatcctggcasgcggcctggcgggtggcatcgagatctgcatcaccttccccaccgagtacgtgaagacgcagctgcagctggacgagcgctcgcacccgccgcggtaccggggcatcggggactgcgtgcggcagacggttcgcagccatggcgtcctgggcctgtaccgcggccttagctycctgctctacggttccatccccaaggcggccgtttcagatttggaatgttcgagttcctcagcaaccacatgcgggatgcc

SEQ ID NO: 17787 - DNA, 483 bp, Homo sapiens
tctttcagattatctcatttcttctggatctgtctctgtattcctcactcccttccccatcccaaccccttctttctctagattgtttacatatgaagggcttttctctctcagagttgctgtcttctctgagacacacaaatctaagtcagaccattgctccacgccctcccaccttttctttagacctcaacttcgctgcgggtgggggtttggtgtcctaaggagactcctggaagctgaatggagaggaggaagaaatgaagaaggagtgattgaatgtcgggcaaggcactggctgagctgctgtggctccctagcctaaggggcctgctgtccctctgaggcctagtgaaaaagctgcaggaggtgcatcctccasctctaatcttggaggctattatcttacctccaagcactgagctgggttactgcccaattccatccttccctgaaggagagaagggaagtgaaaagtagagt

SEQ ID NO: 17788 - DNA, 433 bp, Homo sapiens
  misc_feature 137,428: n=a, g, c or t
aaaaacccagcgaaactccgcggagccgcgcggcacgatggacggtcgggtgcagctgatgaaggccctcctggccgggcccctccggcccgcggcgcgtcgctggaggaacccgattccctttcccgagacgtttnacggagataccgaccgactcccggagttcatcgtgcagacgaactcctacatgttcgtggacgagaacacgttctccaacgacgccctgaagacctacgctaccactgccatcgccatccaccgmatctcaccaacagactgtggctcctagtgatgtggactcacctcggaggtatccgagctggacacagcccctggacagtgatccagacagctggccgtcccccaaggagcctgtcaccttcagcgagacccatttcctcsccatccccagagacctcttgtgttcntggca

SEQ ID NO: 17789 - DNA, 553 bp, Homo sapiens
tgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatgcaaataaagttactcaaatctgtgaagactgtatttgctataactttattggtattgtttttgtagtaatttaagaggtggatgtttgggattgtattattattttactaatatctgtagctattttgttttttgctttggttattgtttttttcccttttcttagctatgagctgatcattgctccttctcacctcctgccatgatactgtcagttaccttagttaacaagctgaatatttagtagaaatgatgcttctgctcaggaatggcccacaaatctgtaatttgaaatttagcaggaaatgacctttaatgacactacattttcaggaactgaaatcattaaaattttatttgaataa

SEQ ID NO: 17790 - DNA, 424 bp, Homo sapiens
ggtttccaagctggttttgaagtcgcggccgctgttcctgggacgtccggttgaccgcgcgtctgctgcagagaccatgtctgccgacggggcagaggctgatggcagcacccaggtgacagtggaagaaccggtacagcagcccagtgtggtggaccgtgtggccagcatgcctctgatcagctccamctgsgamawggggttccgaagctwatgcctccaccaaggagagctacccgcacgtcaagactgtctgcgacgcagcagagaagggagtgaggaccctcacggcggctgctgtcagcggggctcagccgatcctctccaagctggagccccagattgcatcagccagcgaatacgcccacagggggctggacaagttggaggagaacctccccatcctgcagcagcccacggagaa

SEQ ID NO: 17791 - DNA, 501 bp, Homo sapiens
gccacgaaggatttcccgtgccgtgggagcgggttcaggaccgctggtcggacctgagagtcccagctgtgggaagctcagctgtgtaatttgtagtaacgaagcagaagttacaacgaaaagacaagttttcctgtgcttggcagggcccccctcccccccaccraggcctgcagtggatagagcctagcagatcctggacaatactatcctaaaagctacatctctgacagtgatttccagcgactttgtcaacacggtccgcccccagcaagtataagaggaaaaacaacaaatgtctttactgccttgtctttcccccttgccacttgtcattattcaagttttgtaagttcctgatttccattcagtgcagctgcaaggttaccagctgtgcttgcgttgcaagacctgtcacagtttgattaactgccttctttctgcttctgtaagccctcttgcctgccccgcgagtttcacaccatcaaattcctgctgcac

SEQ ID NO: 17792 - DNA, 383 bp, Homo sapiens
ttgtagatgaggcagcgcaggggctgctgcttcgccacgaaggatttcccgtgccgtgggagcgggttcaggaccgctggtcggacctgagagtcccagctgtgtgtgagggctaggagggctgggggtggttggggattggctggagtggtgctggggcaagtgactgtgcgtttaaagggtgaggcgtatggagctgtggcgggcggagataggtgcaatcttatttatgtggcagggcagatattatggttactgaaatgccttttaaacccgactcaactatttcatttcaagtgtgctgttctgkcattttctccaaggtgggaagctcagctgtgtaatttgtagtaacgaagcagaagttacaacgaraagacaag

SEQ ID NO: 17793 - DNA, 517 bp, Homo sapiens
caaatggattttgttttttaagtgaaagcaagtttattaggaaagtaaaggaataaagaatggctactccctaggcagagcagcctcaaatgggtttttaatctctaaaaagactaaaaaccactgtccttccaccttaaacattattttaatctcagcagatgaacagagtacctgttctgcagagaaaatataaatcttacgtgtgagttgttagggatttccttcaaggtattaaaacaacagatcggctgggcgcggtggctcatgcctgtagtcccagcactttgggaggccgaggcgggtggatcgtgaggtcaggagatcgrgaccatcctggccggcatggtgagaccccatctctactaaaaatacaaaagttggccaggcacagtggtgggcactgtggtcccagctacttgggaggctgaggcaggagaatcacttgaacccaagaggcggaggttgcagtgtgccgaggtcgtgcactgtactctagtctgggcgacagagcaag

SEQ ID NO: 17794 - DNA, 253 bp, Homo sapiens
tgacgttattttgttcaagctgggatacagtaggcaggtctgagttcatttctgagactgcctgccaaatatcaatccctttatggcaagtgatcaaatttccttgattttttcttttttttaatatatatgtttttttattatacttgaagttctagggtacatgtgcacaacatgtaggtttgttacatatgtatacatgtgccatgttggcgtgctgcacccgttaactcgtcctttacattaggtatat

SEQ ID NO: 17795 - DNA, 419 bp, Homo sapiens
aaggaagcggatagcgtggagtgacggtvccaccgcggcgcarrrgrrksyksmawcssmgwgsrgrrrrgrsrrrmmssrgwgygmgmarkwrsykggkkggsmrcatggctgggatcaccaccatcgaggcrgtgaagcgcaagatccaggttctgcagcascaggcagatgatgcagaggagygagctgagcrcctccagygagaagytgagggaraaaggygggccygggaacagcwgaggctgargtggcctccktgaacsgtagatccagctggttgaagargagctggactgtgctcaggagcgcctggccactgccctgcaaaagctggaagaagcgggaaaagctgctgatgagagtgagagagatacaaaggttattgaaatctgggccttaaaagatgaagaagatgg

SEQ ID NO: 17796 - DNA, 364 bp, Homo sapiens
tgttttgttctggctttgaggcttgttttgttgtctgtgtctgtctgaataacctgcgtgtctaaaaccacgtgaaatgtgaatgattattggcaatattaccttgacagaatcatgggactttgagaagagggaggacagaggcctctgtcgcactaacgctctcgtggttgctcgactgttgtatctgtgatacattatccgactaaggactctgggctggcagggccttctgccgggaaagctagaaacactaggttcttcctgtacatacgtgtatatatgtgaacagtgagatggccgtttctgacttgtagagaaattttaataaacctggtttcgcaaaaaaaaaaaaaaaaaaggc

SEQ ID NO: 17797 - DNA, 504 bp, Homo sapiens
taaatattgtacttattggaagtaatatcaaactgtatggtgataagtattgttttgattcttatggttaaagggaaatagagccttgcattatattcaacacagccatttgtgtgtgcacaatgcaaactaaggtattctagacctatcttagagcagcatccagwatttgctttctagataatatgcccaataacatgacctagaggggcttctgtgctgtgtagggatttaaccaacttcagtggttcagggagctcaaactatatgtaaaacaagtttagaatgtatgctatctagcccgttatctctgatccttctctaaaaccatttgaaatagcttcattgatcaacatttcataaatgcatctgtggtagaggtagaaagcagcacctttcctaattggcaaatgatcagactaatgtgtgctaatgtttttcttccatgctttcagtcagattcaactattttatcctccacagttgcttaacttggtgttggag

SEQ ID NO: 17798 - DNA, 50 bp, Homo sapiens
tgttttgttctggctttgaggcttgttttgttgtctgtgtctgtctgaat

SEQ ID NO: 17799 - DNA, 525 bp, Homo sapiens
accagtgaagtactagcataaaaacagacgcatggaccaatgtggaacagcgtagaaaaaccagaaataaccccatgcatatacagtcaactaatcttagttctggagactgggaagtccaaggttgagggacacttctggtaaggacttccttgctagcaggactctctgcagagccccagctattgggagagtggctgagtactgagtctatcactacttggatgatacagtgttttttctatttaacttgtctattccttatgaagcttctgtcttcaagataagcagaattgttcagaatccactggaatccaaattcaacttgggcctcaatttctgcagatggacacctctggactccaaaaaaaatccaaggacataaaaaacttaagcagcctttattacatttagttcaacaagtttaaagtgtaggtcactttccacttttgtttacttgatgcttaattttactggaatcgttaaaagaaatatacttgcaatttttttaaaaaggtaaaaaaa

SEQ ID NO: 17800 - DNA, 448 bp, Homo sapiens
acaaacctagcgccaaggttggctgtcaaggtagattccagggtgtggaagtggctttgtggtgccacctctaaccgctcggaggtcaacccccattctacaccgaaaactaggccttggctgctatggaaggacagcggcaagaaagccacgcaaccctaacactcgcccaggctcatttcaacaatggagagtacgcggaggccgaggcactgtactccgcttacattcgccggtgcgcttgcgggcctctagcgacgagagtcccgggagcaaatgcagccctgaggatttggctactgcatataacaacagggggcaaatcaagtacttcagggttgatttttatgaagccatggatgactacacatctgccatagaagtccaacccaattttgaagttccatattacaacagagggttgatactgtataggctgggatatttt

SEQ ID NO: 17801 - DNA, 506 bp, Homo sapiens
cacatttattttcctaacccctgtaaaccctgtccagaccctattagcttaatctgggtgtctgcctgacaggactagatagaatggttacctgggtgcctatttccaagagaaccataaaattttgagtctctccctgaacttctctgggcaaacctcctagtatgtctggccttcagtccatcttggggatcagggagacctcagccccattcctaaccatcttgctcattaaagcagaagagtttgggggtaggagcagagagggatcagggagtgtggagggggagagagcaacttggtgctggtaatcaaggctttatattcactttgggtcattctctcgcagtttaatgtttctggtctacttgaagctctgtagttggcagcaaggtcatcattacttacaccatttcttttagtttaggggattccttggctcagcagtcacagccacagcctttcatgtgggacatggggcttgttgccttattgttatgatactc

SEQ ID NO: 17802 - DNA, 459 bp, Homo sapiens
  misc_feature 406,433: n=a, g, c or t
tttccgtgcacatataagccatagttrcagtacaggtggcagtatttagagcactcagatttcagttctgttaaatgtgaaakagggatcgactgacgttcattgctgttcbataactagtgtaaaatatgtatatgtttatctttatttttataatatgcaaatacatttaaatttatacagtttgaagcttctagcgttagttcacactgggtgcaatattctgcatgagaactgtgccaagatggggctgatttcttattttagtataagacttttttgttttttctttattctttaatcctcttcacattaaaaaaaaaaaatctctctgttagcccatggattaagtgttggttcatagagattgccaataatcrgaaagaaccttaaatktgcatttaanacattktcccttcccttcttttcaatnaaggtccctgcctatataaatcatct

SEQ ID NO: 17803 - DNA, 413 bp, Homo sapiens
atctcctatccgctccgggcgctgccgccggaagggccagcgacggagggtctcagatggcggggcttgaggcccacccgggctctcgggtcggcgagtcccgttggggagcccttgtgcctgctaggatatttagcagatgccaggcggccagaaacgtcctcacttttctccctcggccctctggggaaccgccgtgagcgtttcccacggacacaaacttaacaggcccagaacgtccagggaggacgcgttgtgagcctcaaagagcccacttacgtgaccgacagcaccaggccgacgggcactcgctgaactgctggcccggagcagcacagctcttaagtgggcagtggcatcttttatacaaataaaggaaggtggccccacgtcccgaaaaaaaaaaaaaaatg

SEQ ID NO: 17804 - DNA, 477 bp, Homo sapiens
ctgattttattgcatgggatccaggtatatggcttgataagcagttctttggcatttgctgagactgtgattctgcttaataataatgtaaatcctattgtcactcaatagagaatttttacacacatacacacacacacacccagatcaagcctgttaacaatgtgttcaaatctatccttcatcatttttgtctgcccaatgaatcaatttctgaaagaagatgttaacatatttcactataactgtagacttgtcaacttttatagatcaagttcttagctaagtttaacaaatgtctgttgaatgaaaataaactcaaagcaaaatttgttttccttccattggtcccttatattactcaatacagaactacatgcacaaaaaatatttgaatcctagttgatttaagaaatgttttcaagagcagcaagctatatgatcaccaacacaacacacttactacaaaaggtgtag

SEQ ID NO: 17805 - DNA, 426 bp, Homo sapiens
  misc_feature 411: n=a, g, c or t
taataaatattggaatactggcttttgtgtatttttttgtgttacttagtttttggagaaaggaaatatttctagactttcttgacttgtcataactttttattgttaaagaatatagtttaaaaattattaaatattagggagccttctgcttcattgggactttaaggaatgatagccataggaagggatatatcttatattatcataaagcttttaaaaaataatatatttattacaattttttaaatttattttttatttttagaaacagggtcttactctattgcccaggctggtctcaaacttctgggctcaagtgattctcctgcattgacctcccaaagtgttgggattacaggcatgagccaatgagctcagccagttgttttttttttttttttttttttnsragggktttttttt

SEQ ID NO: 17806 - DNA, 365 bp, Homo sapiens
attctgtctggtgtactggtaatatctggactggtttaatggcttgtttcatgggagaagcgctaaactttacctcaacatttatgtaaagataaagctgcacagattctgagtcttgaaagtttatttcaaagaaaagacaatgcctgtgccacatatttgacttggttttataaatattacgaagctccaggaaatatgagcaggatctcaaatatattcaacaagcttccaatttttgtcttttgagatggttgctcttggaacacagaaatatgctttaagatgtcaagcctcctctgctgatgctgtatggagaacagacaagctttcccatcaagccctaaccaaactgcagaactgtg

SEQ ID NO: 17807 - DNA, 314 bp, Homo sapiens
ccatccctccctggtagctaggtcccgatatactcctgtcttgtgagattgtcgagatgagatgggggacactcttcctctgtccttcctctctcctttcctccatagcaaggacgaccttccctgctccatgcccagagtatagctagatcccttcccctccctaccctctgaatgtgtgctagatcaggtgccccactgtgtttcctgaaatccttgggagccggatctccccatctcccctactcactcttcccttttcttctctcagtgttgtctgaataaagtgtgaaatctttaaaaaaaaaaaaaaa

SEQ ID NO: 17808 - DNA, 432 bp, Homo sapiens
actttgtttattcytttgtctgtattaatggacttttgactcttttttcccccttgatagtaggtcacattttcctgcttcatttcataaatacaaaatttttgttgtagagtggatatgatacatcatatctctaaactctttttatcttcccttgatgaatgttaaaattagtggctgattatattgaatttttggaaccttggtcttctgttttaagatgggtctatagaaagtctgaggcgttggccaggcgtggtggctcatgcttgtaatcccagcactttggatggccaaagtgggtggatcacttgaggtgtcaagagtttgagaccagcctggccaacatggcaaaaccctgtctctacaaaaatacaaagatgagccggtgtgatggcaggcgctgtaatcccagctgcttgggtggctgag

SEQ ID NO: 17809 - DNA, 441 bp, Homo sapiens
  misc_feature 402: n=a, g, c or t
agaaaggcctctcaggaaggcaacagtgcatggcgactctttaccccttcgcccgcctcctgatctacgtactcgcctattcctgcgtttactcgtgtttgtacatgttggtttactttcttcgcatttttgtagaggattaggcagccaagctggaccaaagtcaccagggtggtgaaggcccggcccaccgccgaaatctgcagtcttttaattctgcactttctgcccccgctccccgcacttgactttccagaaatggccaatttctttcaaatgctgtatactggaaaaatccaaaggactcatcagatgaacacatttcaaagagccactaccaattttttttcttaagcaaagcatcaagcctctgatttsccgctgataaattctctgtgtcanacactgctccaggccaggaacacaagaaggaaagtagac

SEQ ID NO: 17810 - DNA, 374 bp, Homo sapiens
agttttccggcctagtttgcggctgctcctgccgtgttgcgtagggcgcctgtgcttgaggttgggggttgcgtcgctctctggtaaaggcgtgcaggtgttggccgcggcctctgagctgggatgagccgtgctcccggtggaagcaagggagcccagccggagccatggccagtacagtggtagcagttggactgaccattgctgctgcaggatttgcaggccgttacgttttgcaagccatgaagcatatggagcctcaagtaaaacaagtttttcaaagcctaccaaaatctgtaagactttgttaattctttgctgcttctatttgaaacctagagccacacttagggaagggtaaatttccaaatatc

SEQ ID NO: 17811 - DNA, 435 bp, Homo sapiens
agagtggagcggccgccggagatgcctgacgcatctgtctgaggagcggtcagtgacgcgatggagcgggcaaggagacagggtctggctatgttgcccaggttggagtgcagtgatgcagttatagctccctgtaacctcaaactcctggatcaatctagactcctgcctcagcctcccaagtgcctgttagtacaggcttgagggatcgcttacacctgagacgaactacagaacagcacgtaccagaggtggaagtccaagtcaaacgcagaaggactgcctcactgagcaaccaagagtgtcagttgtaagcgatccctcaagcctgtggtcccagctactcgggaggctgaggcaggagaatcgcttgaacctgggaggcacaggttgcggtgagctgagatggcgccactgcgstccagcccgggcaac

SEQ ID NO: 17812 - DNA, 404 bp, Homo sapiens
araaagcacgttttgcataacttctagatacatgtacttctattttgaakgasctggtatatctttktkctttacaattctcaacctcagcatatgtaagtbbractcagaaggcaacattccctgaacatactcttccaccagaatctcctctacagakttkkgctgccccttttaccagtggctgaatctactttctcttatggatcgcttacacctgagacgaactacagaacagcacgtaccagaggtggaagtccaagtcaaacgcagaaggactgcctcactgagcaaccaagagtagtgacttgtcaggaggatcaatatgaaggacggcctaaacatctccctgcaaatgctttagcagcatctccctcccctcamccctggggagaaaggattgt

SEQ ID NO: 17813 - DNA, 434 bp, Homo sapiens
acagtctgtggagacagttgtgtccctgtggctttggtgcgcctgtgtgcactttctccctccacctggagcatgggctaacaccggagaaaggaaaagacagagtcagacaggggacaatgaagcctttgaagtgccagtctatgaagaggccgtggtgggactagaatcccagtgccgcccccaagagttggaccaaccacccccctacagcactgttgtgatacccccagcacctgaggaggaacaacctagccatccagaggggtccaggagagccaaactggaacagaggcgaatggcctcagaggggtccatggcccaggaaggaagccctggaagagctccaatcaaccttcggcttcggggaccacgggctgtgtccactgctcctgatctgcagagcttggcggcagtcccacattagagcctct

SEQ ID NO: 17814 - DNA, 481 bp, Homo sapiens
acagtctgtggagacaggtgagcgacgaacttctgagacagggacaatgaagcctttgaagtgccagtctatgaagaggccgtggtgggactagaatcccagtgccgcccccaagagttggaccaaccacccccctacagcactgttgtgatacccccagcacctgaggaggaacaacctagccatccagaggggtccaggatagccaaactggaacagaggcgaatggcctcagaggggtccatggcccaggaaggaagccctggaagagctccaatcaaccttcggcttcggggaccacgggctgtgtccactgctcctgatctgcagagcttggcgcagtccccacattagagcctctgactccaccccctgcctatgatgtctgctttggtcaccctgatgatgatagtgttttttatgaggacaactgggcaccccttaaatgactctcccaagatttctcttctctccacaccag

SEQ ID NO: 17815 - DNA, 573 bp, Homo sapiens
attttatccagatcctattcaagatagagtcactggttcaaaggcctctgacaaggggacagaaccacttgtggccaagtcctcccaaatgcaacaaccagtggacaggagagtggagagaggcctggagtgaatgttaatggaatttcctccatgttgaaggaagcataaggctgcagtgcaatggcataatctcggctcaccacaacctccgcctcccaggttcaagtgattctcctgcttcagcctcccgagtagctgggattacaggcgtgccctaccgcacccggctaattttgcatttttattagagacggagtttctccatgttggacaggctggtttcgaactcccaacctcagataggattctggttttcgttcaagatagtgtccctgacactagaatcataagctcttggtgaagaattacttaagcagatcctggattctagtggaacaactaacaccaaccagtttaaagacccccacagaggwaccaaatcagcaagagaataccgtttcttcatctccctgccccatgacttcaccccacaattttcaaccaatcagt

SEQ ID NO: 17816 - DNA, 384 bp, Homo sapiens
attttatccagatcctattcaagatagagtcactggttcaaaggcctctgacaaggggacagaaccacttgtgccaagtcctcccaaatgcaacaaccagtggacaggagagtggagagaggcctggagtgaatgttaatggaatttcctccatgttgaaggaagcataaggctgcagtgcaatggcataatctcggctcaccacaacctccgcctcccaggttcaagtgattctcctgcttcagcctcccgagtagctgggattacaggcgtgccctaccgcacccggctaattttgcatttttattagagacggagtttctccatgttggacaggctggtttcgaactcccaacctcagataggattctggtttthcgttca

SEQ ID NO: 17817 - DNA, 495 bp, Homo sapiens
cttttttctcgttccccggccatcttagcggctgctgttggttgggggccgtcccgctcctaaggcaggaagatggtggccgcaaagaagacggtgagtgaggcgggccaggcccggaagacgattcacgtggagagatgttttggccagggcgggcagatgtgagcccacgggggtgacagcatgcctgctggcatttggagggccccagaaggaatcccagtggccctctcaatgacttggggtcctcgacttcggaagtttaaggggctcggcttcaaaaagctgggtccggttttgaggcggttgcaggcgaggcccttaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaaacagact

SEQ ID NO: 17818 - DNA, 296 bp, Homo sapiens
cctkgctcgttccccggccatcttagcggctgctgttggttgggggccgtcccgctcctaaggcaggaagatggtggccgcaaagaagacgaaaaagtcgctggagtcggatcaaactctaggctccaactcgttatgaaaagtgggaagtacgtcctggggtacaagcagactctkaagatgatcagacaaggcaaagcgaaattggtcattytcgctawacaactgcccagctttkaggaaatctgaaatagagttactatgctatgttggctaaaactggtgtycatcactam

SEQ ID NO: 17819 - DNA, 355 bp, Homo sapiens
aacctcaaggagccctgttgtgctaccgactgcagagctcatggacatccatcaggaagcctccaatacccaaaccaggggtagttgcctaatccatatccatgtggatagctctttacttaggaaaccttgatggcttatttggatgacaaaggttcccttttggcgatacatagccatgcgagacaacatagccatgaaacaaaccaagtccaccagtggcttcctaggaacacatttgctttcctgataaaagaggacagatgcagttgcagaagtacctgtgcctctttttctttttcttcttctttttcttttttaatctcttaaatgcagatataagaactgggtactg

SEQ ID NO: 17820 - DNA, 542 bp, Homo sapiens
aacgacgagtttcagaacgatggcagagctcccgcgtgagrgctgctgcccctcctgggcgccgcctgctgctgatgctacctctgttgggtacccgtgcccaggaggacgccgagctccagccccgagccctggacatctactctgccgtggatgatgcctcccacgagaaggagctgatacgaagcgctgcaagaagtcttgaagaagctcaagagtaaacgtgttcccatctatgagaaagaagtatggccaagtccccatgtgttgacgccggtgagcagtgtgcagtgaggaaaggggcaaggatcgggaagctgtgtgactgtccccgaggaacctcctgcaattccttcctcctgaagtgcttatgaaggggcgtccattctcctccatacatccccatccctctgctttccccagaggacccacaccttcctcccctggagtttggctttaagcaacagataaagtttttattttcctctgaagggaaagggctcttttcctgctgtttcaaaaataaaagaacacattagatg

SEQ ID NO: 17821 - DNA, 269 bp, Homo sapiens
  misc_feature 84,216: n=a, g, c or t
agtcgtggactcgtgcagctggggcgtccgcagccgctcgtcacccgcgtgatgctgtttctggcgttgggcagcccgtggcgntcgaactgcctctctgcggaaggaggactgcattgtgtgcggccgccgcgctccgaggtccccgggcctctgtctcccgggcgtcctccagsagcgggysttcggggmgggtagccggctggagtacgggmncttcgggagccgcgcgccttctccggcgtccgggtcgagcgcagatccctgtt

SEQ ID NO: 17822 - DNA, 204 bp, Homo sapiens
gttctgggctggccttttcctctcccaggtgcgcttccctgcttgatctgtgtaccctgctctttctccttcattccgcagcctcctttgccctgtgacctgcaggtactggacggtccctagagaggataccgggacgctcctgaagccgcgagatgatttcaagcagatgcagccbtgaccattagggccaacggccaaatt

SEQ ID NO: 17823 - DNA, 449 bp, Homo sapiens
gagtaatcccggaaggacagggagagaggggtggccgtgggtggggtggggtggggtggaagggaccacatccagcaggctgagagggcaaggagttggtgcacacctacaagggctgcatcaggtcccaggactgctactccggcgttatatccaccaccatgggccccaaggaccacatggtaaccagctccttctgctgccagagcgacggctgcaacagtgcctttttgtctgttcccttgaccaatcttactgagaatggcctgatgtgccccgcctgcactgcgagcttcagggacaaatgcatggggcccatgacccactgtactggaaaggaaaaccactgcgtctccttatctggacacgtgcaggctsgtattttcaaacccagatttgctatgcggggctgtgctacagagagtatgtgctttaccaagcctggtgct

SEQ ID NO: 17824 - DNA, 211 bp, Homo sapiens
  misc_feature 120,133,136: n=a, g, c or t
agtagctggtagtggaaggaggagctctgactacactctcacgactgttttttgcctcttggttcttgttatgtccctttctttttgaaataagacagaaggtccccaccttcatagacnatagagagayccnaynttatttgtttttaaaaataaattgaaaagtgagaaacamaaaaaaaaaaaaaaaaaaaagaraaaaaaaaaaaaa

SEQ ID NO: 17825 - DNA, 282 bp, Homo sapiens
tttcagatcttagtgaagcctgaatcctgaaatgtgttttgtagaagtactttattacatatatgaaataaactataaagaaggtagtttttaaaaaaaatttcaaatcaaataatttgtatgttttccatgtttaaattatctaaagttattcaatctcctgagcctaacagcaatgtagaaacggramtttttgscttttccaaaagatctggaaagcatgaagactgggctttttttcctatgtctcttgggaactgcagctgcaatcccgacaaatgc

SEQ ID NO: 17826 - DNA, 193 bp, Homo sapiens
agtagctggtagtggaaggaggagctctgactacactctcacgactgttttttgcctcttggttcttgttatgtccctttctttttgaaataagacagaaggtccccaccttcatagacatagagagatcccatcttatttgtttttaaaaataaattgaaaagtgagaaaaaaaaaaaaaaaaaaaaaaaaa

SEQ ID NO: 17827 - DNA, 444 bp, Homo sapiens
agtccgcggcgccacaagcctcagtgtttacttctgccgcctgccagccgggcggggaaggggagtacccggccacccctcactttagctcctcagctttccaaacaaaccagggcgggatgggagtgtcttcttggctgtggaaatcgatcctcctaccttgtcctgaagccacccgccgcctttcctcgtccctcccttcgcggtgattttccggtcccggcgcccggcgagggsccsggctggtgtccgccccgcccgaaaggtgagccagccatgagagggtatcttgtggccatattcctgagtgctgtcttcctctattatgtactgcattgcatattatggggaacgaatgtctattgggtggcacctgtggaaatgaaacggagaaataagatccagccttgtttatcaaagccagcttttgcctctctgctgagg

SEQ ID NO: 17828 - DNA, 329 bp, Homo sapiens
attataaagggcgccacgagtcggcattgtcaggcggcggcaccgcgcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggagccgccgcgcctcggcctagcatgtcrgaagcgggcsaggagcagcccatggagacsacgggcgccaccgagaacggacatgaggccg

SEQ ID NO: 17829 - DNA, 464 bp, Homo sapiens
aactgaaacgtttcctaaccatacatagggatgatactcagatttgtttagatgttgaatgtgaagctaacatttttaaacagcttaaaattgtatcataaaataattttaagttacagtttgttttgagttgcctataaaaatgaatttttaagctaatttgttaagaatttggttatcgggccaggcgtggtggctcatgcctatataatcccagcrctttgggaggacgaggcggggggatcacctgaggtcgagaccagcctgaccaacatggrgaarccccgtctctactaaaaatrcaaaattagctggaagtggtggtgtgtgtctgtaatttcagctacttgggaggctgaggcaggagaatcacttgaacctaggaggcagaggttgcagtgagctgagatcgtgccattgcattccagcctgggcatcaagagtgaaactccatctgaaaaaaa

SEQ ID NO: 17830 - DNA, 394 bp, Homo sapiens
  misc_feature 54,122: n=a, g, c or t
aggattttattagcttctctcccccaggccgcagccaatcagcgcgcgtgcccnggcccctgcgtctcttgcgtcaagacggccgtgctgagcgaatgcaggcgacttgcgagctgggagcnatttaaaacgctttggattcccccggcctgggtggggagagcgagctgggtgccccctagattccccgcccccgcacctcatgagccgaccctcggctccatggagccggcaattatgccaccttggatggagccaaggatatcgaaggcttgctgggagcgggaggggggcggaatctggtcgcccactcccctctgaccagccacccagcggcgcctacgctgatgcctgctgtcaactatgcccccttggatctgccaggctcggcgga

SEQ ID NO: 17831 - DNA, 388 bp, Homo sapiens
caacggctttatcgtaggagcgtcttcgcctcccccgtttccagtagaaaagacagctttgctcctttgaaagcgcagaccgccgcacctccagccccttctccccggggaagtaggccccgctaagaatgtgggaaggtggtggggcggcgactgaagtcgttccgattggcgttgtcccaaggaagcctgcgcggattatcggcggcaggcctccaatagagcctgctaggcggattggctgctacgcggctgggccctgtttccggtacctaggcgggcagccatggtgaccggcgagcggcatgcgacgcgcctctgtggcctgtggaggcccgcttggcgaagctgcttcccgacctastggtctttcggaagcctcggggat

SEQ ID NO: 17832 - DNA, 396 bp, Homo sapiens
ataaaatgactaggtgcattttgactagttcaattttgttctgggacacatgtgcagaacatgcaggtttgttacgttgctcctgttgttgagtcataatacaattttgcctgcagtgtgagctcttgtcatgggaagcaggcaatcgcgatgaaaagatctggctaaatatctgtgaaaagattgtcattttggacagaggtacctgacaaagttggattagatggaacgtggggcaagcccaaatgagagcaagtcatttgctttaatcctgtgtatgaacctacagaaggctcagtctcatgaccgatctacacataaaggaggcctctccaaaccagtagaagaaaggttggtgaacctaactgagcgttaaaccactgcagaaaaggaaaa

SEQ ID NO: 17833 - DNA, 445 bp, Homo sapiens
  misc_feature 54: n=a, g, c or t
tacgccacggcgtctgctggcggccgcggagacgcagagtcttgagcagcgcgncaggcaccatgttcctgactgcgctcctctggsgcggccgcattcccggccgtcagtggatcgggaagcaccggcggccgcggttcgtgtcgttgcgcgccaagcagaacatgatccgccgcctggagatcgaggcggagaaccattactggctgagacatgccctacatgacccgggagcaggagcgcggccacgccsgttggcgcaggagggaggccttcgaggcataaaggcggccgccacttccaagttccccccgcatagattcattgcggaccagctcgaccatctcaatgtcaccaagaaatggtcctaatcctgagtcgtcacccttggattttatggatcacggagctgaccatctttacctggtcctggaactgaaaaact

SEQ ID NO: 17834 - DNA, 515 bp, Homo sapiens
attctctctaatgactgtctccctcgctggatgtgatgaagtaggctacattatgcagcaccccattgaaacaaagaattgagtgtgaccaccaggcaacatctggcaaggaactgagttccaacagtgcacaaggaagtgaatcctgacaacagtcccaagagctttaggagtgaatccttctccactccagcctcagataagtcttgcccttaattgcagcctcatgaaagactctgaaaccttgggcccaggtaacccatgccaagattcctgacctgcagaaactgtgggtcatcaagcatgttctttcaagtctctacatgtgtagtaatttgttatgcagctttagataaccaagagatggaacaatttggaactgccctacagttacggtggggcataaaatgacacaagcattttggaaaacagttgggcagtttcttataaaattaaacagacacttaccctaacacccagcattgtgctctaggtatttacctaagaaaaataaa

SEQ ID NO: 17835 - DNA, 453 bp, Homo sapiens
cgtgatagagtggagggagatggcccagtgactgaggccagctgtgctctcctcagctgtatagccaaaggccagtgcatcctggtttgatttaggtaaagcctagtcagagtgcaaaagacagtactcaaaaggaacagctctgagaaattcagtctgccaacatgggtagatccaagatgtgaccacagggagtaggaccctgttctgagggctggctggagctaggcagagtgctggaggtgggctgggagaaggatgaaagtcttgcagagcatcagtggctgatgcaggacggagattagagcatagagggcaggtaagagggcccaaggtaagaacgagagccaacgggcacaagcattctatatataagtggctcattaggtgtttattttgttctatttaagaatttgttttattaaattaatataaaaatctttgtaaatccca

SEQ ID NO: 17836 - DNA, 377 bp, Homo sapiens
atacaagatcaggaagtgttcttatttgtagtaagttcattctattcaaattaggtatcctttggaataggaaacgttttcagccattgtacattattgaacttttattttgtctaccgtgtacaaagtacctgtgagatggggatacaaagacattttccaaattttgggctccagtcgattcttgtgtattacgctgtgagcaagacttgcatgtcgtcacagagaacggggcactatccctgataaagattgtgggagttggcttcctacagcatcgatcacatggctttaacccacgagcaagatggctgaagctgaagaatgggctggatcacaaaaatagattttctgtctgaggtttaaaaaaaaaaaaa

SEQ ID NO: 17837 - DNA, 308 bp, Homo sapiens
catatttattggcggattagttgttcattgtctgtcttccccacaaggatgtctacttcatgagggcagcttcctaagtcctcagtgatcaactgattgcctgaatgaatgaatgagtggtgaggacagaatggggggtaaaaagctgggagaggcaggtacagtggctcacacctgtagtcccagcactttatgaggctaaggctggtggatcgcttgagcccaggagttgaagaccaccctgggcaaccccctttctacttgttatcatggcgaaaccccatctctacaaaaaaaaaaaaaaaaag

SEQ ID NO: 17838 - DNA, 451 bp, Homo sapiens
cttttgcccagcacacctgtcactcacctcaaccctttctctcttttccccatctttctgtggctagctcctcctcattctttaggtctcagtgtagatagcaccactatcaggaaggagtccagacactgccaggcctaagatgagtaaatggaggctcagagacactaaatgacctaaccaaggtcactagcatgtaaagtactagtgcccagactctgatctgagtccttggacttcaattcctgtaactcccacactgccatcatttgcctgacccttggtatagcaccaaggggttctacacaaagaagagtggatgcacttggagtagattcacttcttcccattcctcctgctaaactaaacacagctaaagcccttggacattatatataaaactaacataaaaagacagaaaggtgcagaaaaagaagcagactgactagca

SEQ ID NO: 17839 - DNA, 381 bp, Homo sapiens
agcatatttgatcactttgattctctgttcttttctctccgcggtgtgtgtgtgcgtgcgcgcgtgtgtgttttcttcttctcctcctcctctccccgagttgcctcctttctccgggtgccgtactgccttttttcccctctttcattctttctctccgtctttttctcccccctctgcgcacgaaggatgtgcttctaggtggtgatctgccctcctctctctcttttatcatttctcctcctcctcctccgccaactcctcggctgcacaccagctctaagagcgagagtgaacgagagagggagggagagagtgagagcgagcgagatctttggagagatttttttttttgcctcctacttctgtcttgaagccaga

SEQ ID NO: 17840 - DNA, 421 bp, Homo sapiens
  misc_feature 315,396..397: n=a, g, c or t
ctcttggataaatgcgcctggatgtctcacatccgggaactcagagtgttaaaacttgagctcattattttcccctagacaccaattattccttttttattttccgtctttattaacgaaagtgwttactgcctaagccagacactgagagccaccatgtattcctctctctctctcacctattcccatgtttaatccattatttggattggtccattttatctccattttctcaaatacaggaaaagacagatcatcatcaaccagcaattgtgactatctacatattcacataaggatttcccaacttggggnatttttgtcaagttgagaccaggcatcttggagtyagttccatcaggktactgtgactgtcatcgatagcctcggagggknnacaactcacaagagtcagcctggg

SEQ ID NO: 17841 - DNA, 416 bp, Homo sapiens
attttccgggaagatggcggcgcacaagtcaggtccggcacatgtttccgcggrsvtccccagcaatgacggatgatatcacctcttcttctctggtgagaktctgaggatagagacttttttctcaccatgaagaggagaagatgggggtcttggaggaaggaggaaaaggcaaggaggctgcaggcagtgtcaggacagaggaggtagagascagggcatatgctgacccatgcagccgaagaaagaagaggcagcaacaggaggaggaggacttgaacctagaagatagaggtgaggaaactgttttaggtggtggaaccagggaagcagagagcagagcatgcagtgatggaagaagcaggaaaagcaagaagaaaagacagcagcatcaagaggaggaggacatcttggat

SEQ ID NO: 17842 - DNA, 428 bp, Homo sapiens
catgattatcagagtgccatggtgaaaggatgagtgacttctacatgttgaaactaaactatagctttaggtcatgtgtgggagacgggtccaagtgagtgtatatagtatttgtcctttggtatttattgttgttgttcgggttgttgcccaacctgcagttttcaggaaccgtgaggtacagccagatggacagcctgtgctttcacatgctgcagctcccccatgcttccctctccatctggagtctgatggactttgccaacactgcagcaccaggagctaatttctacctgcctctcctcagctatgttctcttgacggagcatctatttatatatcacctcatgctgcagcatccagctggttttgttgttgttgctttccatttgcagagatgttaactgcagtggtatttctttttcatt

SEQ ID NO: 17843 - DNA, 543 bp, Homo sapiens
aactaactacatgtcatcttagaacaggctgcttcatagtttatagtggaacagtttccatattctagaaaattagaaaagcttttgataaaagagaactagaaaatttgtcagtaggctatattaaaagacatccttcttggactcttactgcaataattgctttggcttttgaatatactgcattcagaagctaaatcttccctgtgccattgttatagaacgaccaaatgtgaaatggagtgacgttgctggacttgaaggagccaaagaagcactgaaagaggctgtgatactgcctattaaatttcctcatctttttacaggcaagagaacaccttggaggggaatcctattatttgggccgcctggaacagaaagtcctacttagccaaagctgtagcaacagaagccaacaactcaacatttttttcaatatcttcctctgatcttgtttctaagtggctaggtgaagtgaaaactggttaagaatttattccaacttgccagagagaacaagccctccattatcttcattgatga

SEQ ID NO: 17844 - DNA, 432 bp, Homo sapiens
taagatgattagtagcctaaagaataaagaattttacaaattaaagcacaaccactgtcttgaagaaatgtctgttatttcctgattttcaaaagtgactcattattaataataaactgaaactaaagctccccacgttggatgagtagaaatatttggctatatgctatctgtgttccttaacatttattacatattacagtttgggtttaaaattacagttgggaagagttaagtaggacagagtgtcatatcagattttttttgagacaggatcttgmtgtgttgtccaggcttaagtgcagttgtgcagtcatggctcagttccctcagacctcctgggctcaagtaatcctcctgcctccaccwcctgagtagctgggactacagaaaagggccacaacatccagctgaattttttttttttttttt

SEQ ID NO: 17845 - DNA, 257 bp, Homo sapiens
acaccttccggagtcggcctcatcaatcatagatttcacaagtccttgcagccttacccttggcaaaagaccaggagtgttttccaagccctccaaatactcttcgggcgcacctcgcctctgcctgaaaatgtggtgacctggaagaagaactcaagaatgttactaacaatctgaaatctctggaggctgcatctgraaaaggttwtykgaaaaggaggacaattwtgaagaagaaattaaacttctgtctgaca

SEQ ID NO: 17846 - DNA, 387 bp, Homo sapiens
  misc_feature 16: n=a, g, c or t
acgcgcgggctcgcgnttcggtttccccagacctgctcgcagcaccctgctgtcttcccggtccggcccgctgcccgcgcgccasaccatgctcttctattcttttttcaagtcccttgtgggcaaggatgtggtcgtggaactaaagaatgacctgagcatctgtggaaccctccattctgtggatcagtatctcaacatcaaactaactgacatcagtgtcacagaccctgagaaataccctcacatgttatcagtgaagaactgcttcattcggggctcagtggtccgatacgtgcagctgccagcagatgaggtcgacacacagttgctacaggatgcggcaaggaaggaagccctgcagcagaaacagtgatggctcctcct

SEQ ID NO: 17847 - DNA, 343 bp, Homo sapiens
agaactcggtcccgcctccagagcggagagccacttggcggggagggagtggcattgagctgaggcaggaggcgtgggctggcccgagaaaccggcgctgaagtctcagtttgcgttttgctcttggttatgccccactgtcccacgcctcactcgcttctgcccccgcggacagcgttcactctctgggtcttagtcttttatctcagggcagatcaggtcagcagctaggaatgaagacccttcactgacccgtccccagkcccacctcatccctgctgttgcaacatccctgctgtttcttaatcacagagtcccctaaaagacccagaatcaagaacca

SEQ ID NO: 17848 - DNA, 608 bp, Homo sapiens
aattacttctttaaacaccctatctcaaatgtagtggcattctgaggtgctgggagttaacccttcaacaaatgaatttgaggaggaagaggacacagttcagcccatagcaggaaccagaaaggataaagaaaatgatactgaaattaagaagccactcagaaaaagaaaacacaggagagaaatgtgaggagcctcaattttcatgaaagatgtccagaataatccatttaaccctctcttccacgatctcattgtgtttgtgtaactccaggccaagtatcaataacatccaagttgatttatggtggtgaaaggtttttccgtgagaactctgatgatggaagtcaataaatgastattaggaagatagaagtctctctacaaacccaaactggtggggctagtttatgtcaaaggaatgaaaaatgaggctggtctgtgaatgcctagtaccctgcgtgaaagccaagctaaaaaccagatcttgggtgaatttttattctccatcaaaaatttgcatttgtacacccactttttgtaacagattctttttatgctaactcctcaacgaagtgcttctactgcttttgaagactggacagtgt

SEQ ID NO: 17849 - DNA, 269 bp, Homo sapiens
taaagcctgttctttaaggtgtctcgttagagcccaaagtggaatccggaaggcagccagagctgaggctgccccaagactcagacttgctaagaattacgcsgccgacttcaaacccagagagcatctttcttttaggcgaaaacgcatatatttattttttgtaagttataccattctttcacattagataaactaagttttgggggatccttttgtaatgacttacactggaaatgcgaacatttgcagtaaaaaaatatatatat

SEQ ID NO: 17850 - DNA, 347 bp, Homo sapiens
aacttccgggctcggcagctagactagcgggggcagcctcagagcgggccgtccagcatcaaacactagcctccacacgtggaaaagaccctgactcccacagtagactagtcttatgggagtcctggctcttgggccaggctgcattaggaaaatggaaaccagactgtcttcaaattcttctgcctagccttagccattagagagaggtcctgctaaagatggactgcaaatgcgcttgatggaaggagatgtcaattccactgaagtcctcatttctgctgtaggtgatattatgtcgtgactttaggagaagtaatggtgataccaaaaaaaaaaaaaaaaag

SEQ ID NO: 17851 - DNA, 355 bp, Homo sapiens
acttccgggctcggcagctagactagcgggggcagcctcagagcgggtgagcttggggacgcacggagaggtgcagctgggccgtccagcatcaaacactagcctccacacgtggaaaagaccctgactcccacagtagactagtcttatgggagtcctggctcttgggccaggctgcattaggaaaatggaaaccagactgtcttcaaattcttctgcctagccttagccattagagagaggtcctgctaaagatggactgcaaatgcgcttgatggaaggagatgtcaattccactgaagtcctcatttctgctgtaggtgatattatgtcgtgactttaggagaagtaatgg

SEQ ID NO: 17852 - DNA, 585 bp, Homo sapiens
aatcacctacaagtacaccctcttaaaataacattctgttaacactttagtgtctgtgttctaactgtagatgtctcscgtagtgttsttagtggttmtgtagctatatgcttgaaactttaacaaattccctatttttgaacattaggttagtttttcttgtttttgcttttataaacaatactatgttgcatgtctttgtagataaatcctgatagtttcagttctaaactaatattaattggtatagaatcggccctatgttgtgttttgcattgggaaagttttattttatatcaactaggctttcatcttctgctaataactgaagtgtgaactcaaaaacagacacttagctaatccatttgagccttagttgtctcattaataaactgccttggctaggcacagtggctcaggcctgtaatcccagcactttgggaggccgaggtgggaggattacttgagctcaggagattgaaaccagcctgggcaacatagcgaaacatcatctctactaaaagtcaaaaaaattagctggatgtggtggtgtgcatctgtggtcccagctacttgggaggcaga

SEQ ID NO: 17853 - DNA, 562 bp, Homo sapiens
agttccgttcattctgaacatgtcaccggggactttggaatgtgtatccataactccctgattttcaaccacattccagcctgcctgactcatgaagcgtggagsvacccaggaacatcccagctcctcatgtcccacattcttcaggctttctcttagttttggcatgtgcatgtaaatgtcaacagtgcccagatcagcgcctgatatatacttggcacacaataaccactcttgaaattcatgaaggaatctggacatttagggggttcatcagaatccgccgcttttagggaagattctctgcctgatgtgtgagcgctctaacctcttcatctgtgttcagtccccttgcaatgcttctctaagatcaataaaggcaaaaaccaggagatcccataaatcccgctgagcctgtcatagctatcaaattakacccagataaagcttctggtggctaatgacatggccatcacccagcgtggacgtgggcakgaggggctctccgggagcatctggtctgctgtggagacacttgtcatctggaggctctgtgctctaa

SEQ ID NO: 17854 - DNA, 711 bp, Homo sapiens
agttccgttcattctgaacatgtcaccggggactttggaatgtgtatccataactccctgattttcaaccacattccagcctgcctgactcatgaagcgtggagcgacccaggaacatcccagctcctcatgtcccacattcttcaggctttctcttagttttggcatgtgcatgtaaatgtcaacagtgcccagatcagcgcctgatatatacttggcacacaataaccactcttgaaattcatgaaggaatctggacatttagggggttcatcagaatccgccgcttttagggaagattctctgcctgatgtgtgagcgctctaacctcttcatctgtgttcagtccccttgcaatgcttctctaagatcaataaaggcaaaaaccaggagatcccataaatcccgctgagcctgtcatagctatcaaattatacccagataaagcttctggtggctaatgacatggccatcacccagcgtggacgtgggcaggaggggctctccgggagcatctggtctgctgtggagacacttgtcatctggaggctctgtggctctaatggagggtgatgctttgaacgcgactwtytcccccataaaaaaataaataaataataagtataatttaaaaaaaaaaaaaaaaaaaaaaaaaaaaaaaaaaaaaaaaaaaaaaaaaaaaaaaaaaagaaaaaaaaaaaaaaatgcgaa

SEQ ID NO: 17855 - DNA, 182 bp, Homo sapiens
gacgcgtttttatttgaaaaggtgaaacatactcaacataaataatttggacagtaggaggagaatgggaagagtatacagtggcaagcaaggtccttcctcatccttatccccaaataccccttctcagaagcagcgatcactgtcaccattttcagtggtttttttttttttttttttaa

SEQ ID NO: 17856 - DNA, 436 bp, Homo sapiens
  misc_feature 405: n=a, g, c or t
aggacgacgcgggctcttgaggggcagagcagcgcatcatgcaggatcccaatgaagatacagaatggaatgacattttaagagatttcggcattcttcctcctaaagaagagtcaaaagatgaaattgaagaaatggttttacgtttacagaaagaagcaatggtgaaacatttgaaaagatgactcttgcacagctaaaggaagctgaagatgaatttgatgaagaagatatgcaggctgttgaaacatatagaaagaagcggttacaggaatggaaagctcttaagaaaaaacaaaaatttggagaattaagagaaatttctggaaatcagtatgtgaatgaagtcacaaatgcagaagaagatgtgtgggttataattcatctatacagatcaagaacttnaatggaagctagcagaagttggagcaataca

SEQ ID NO: 17857 - DNA, 405 bp, Homo sapiens
acgtcaacaggccggaaaggcagacagaagggaaaaggccccgcgcgtctccacgtcaacaggccggaaaggcagacagaagggaaaaggccccgcgcgtctccacgtcaacaggccggaaaggcagacagaagggaaaacgccccgcgcgtctccacgtcaacaggccggaaaggcagacagaagggaaaaggccccgcgcgtctccacgtcaacaggccggaaaggcagacagaagggaaaaggccccgcgcgtctccacgtcaacaggccggaaaggcagacagaagggaaaaggccccgcgcgtttccacgtcaacaggccggaaaggcagacagaagggaaaaggctccgcgcgtttccatgtcaacaggccggaaaggaagacagaagggaaaacgctc

SEQ ID NO: 17858 - DNA, 334 bp, Homo sapiens
aaacaaagttgtggagaaggccccagtgcagaatgaagcccccgctttaggaggtggtgaataccaggagcctggaggaaatgttaaaggggtttgggctccacctgccccgggttttggagaggatgtgcccaataggcttgtcgataacattgatatgatagatggagatggagatgatatggaacggttcatggaggagatgagagagctaaggaggaaaattagggaacttcagttgaggtactctgcgcattcttataggggaccctcctcaccatgatcatcatgatgagttttgccttatgccttgaatcttgaggttaataatcat

SEQ ID NO: 17859 - DNA, 397 bp, Homo sapiens
gttgaggaaacggaaatccagcgcacacgtgaaaacgccccggactgcggctgcgcctttaacccgcacacagacggttggcagaggaagaaagccttgtcacactaaaggagagacagcggatgttctgaacagtcctgtcgtgaaacgttagacaacgtggacgaaacaggcacattcctaagcatcacacattactgaaactcagtcaagaagaaatagaaaatctgaatacatccatggcaagcacagaaactgaactaggggattcgaaatcttcccacaaagaaaagcctaggcccaactggcctctatgctttgaagatggaagtggggacatgagccaagcagtgtgacaggctctaagaagctgggaatgtctgtcagctgacagtca

SEQ ID NO: 17860 - DNA, 307 bp, Homo sapiens
gcagagctacgcagccttcggtgcagtcgtcactcgtgtctcgctaccagctccccgctgccctgcgctcggcgggctggcatccggcccgggggaaagcggaccagcccttctgcaggtctgcggggccaagtgtcccggcggcgcacctcgtggcgagaatcgggagaaggaggagactacaaggataggcccaggagtaatggagtccaaagagaaacgagcagtaaacagtctcagcatggaaaatgccaaccaagaaaatcaagaaaaggagcaagttgctaataaaggggagcccttggcc

SEQ ID NO: 17861 - DNA, 435 bp, Homo sapiens
  misc_feature 64: n=a, g, c or t
agagctacgcagccttcggtgcagtcgtcactcgtgtctcgctaccagctccccgctgccctgngctcggcgggctggcatccggcccgggggaaagcggaccagcccttctgcaggtctgcggggccaagtgtcccggcggcgcacctcgtggcgagaatcgggagaaggaggagactacaaggataggcccargagtaatggagtccaaagagaaacgagcagtaaacagtctcagcatggaaaatgccaaccaagaaaaatgaagaaaaggagcaagttgctaataaaggggagcccttggccctcsctttggatgctggtgaatactgtgtgcctagagggaaatcgtaggcggttccgcgttaggcagcccatcctgcagtatagatgggatatgatgcataggcttggagaaccacaggcaaggatgag

SEQ ID NO: 17862 - DNA, 414 bp, Homo sapiens
  misc_feature 105: n=a, g, c or t
atcctgatgcgatccccctcccccctccggttcatgtagggagtcgggccccgggcgccaccgtcacctcggccgctgcgctgtcgccatcgccttgtttcccsntcccccgsatggccgaggacctctctgcggccacgtcctacaccgaagatgatttctactgccccgtctgtcaggaggtgctcaaaacgcccgtgcggaccacgyctgtcagcacgttttctgtagaaaatgtttcctgactgcaatgagggaaagcggasacattgtcccctatgtcgtggaaatgtgactagaagagagagagcatgtcctgaacgggccttagaccttgaaaatataatgaggaagttttctggtagctgcagatgctgtgcaaaacagattaaatyctatcgcatgagacatcat

SEQ ID NO: 17863 - DNA, 127 bp, Homo sapiens
agagctacgcagccttcggtgcagtcgtcactcgtgtctcgctaccagctccccgctgccctgcgctcggcgggctggcatccggcccgggggaaagcggaccagcccttctgcaggtctgcggggc

SEQ ID NO: 17864 - DNA, 395 bp, Homo sapiens
  misc_feature 63..64: n=a, g, c or t
agagctacgcagccttcggtgcagtcgtcactcgtgtctcgctaccagctccccgctgccctnngctcggcgggctggcatccggcccgggggaaagcggaccagcccttctgcaggtctgcggggccaagtgtcccggcggcgcacctcgtggcgagaatcgggagaaggaggagactacaaggataggcccaggagtaatggagtccaaagagaaacgagcagtaaacagtctcagcatggaaaatgccaaccaagaaaatgaagaaaaggagcaagttgctaataaaggggagcccttggccctccctttggatgctggtgaatactgtgtgcctagaggaaatcgtaggcggttccgcgttaggcagcccatcctgcagtatagatgggat

SEQ ID NO: 17865 - DNA, 401 bp, Homo sapiens
tcagcacatacaaaaaaattataaggtagaatgtgctataaaaaatgattaggtacagtggaagttagaaaggcttcactaaagatgtcgtatttgaattgggtctgagcatgaattagtcttcaggtgagggagggggttaaagaaaactctaatgaaggaactctagtatgtgtgaaggcaaggaggctggtgtgtttaggttgcagcaaaccaagtacaaccaggcttggacttgagtgactggaaagacaggaagatgccatgctgagaaaaactgcccatgccaagctgagaaatgttcagcagaaacataaggtgagctgcatatgtcatttaaaatgttctaggagccacatttttaaaaaatcaaaattaacaagtcaaaaaaaaaaaaaaaa

SEQ ID NO: 17866 - DNA, 361 bp, Homo sapiens
atccggcccgggggaaagcggaccagcccttctgcaggtctgcggggccaagtgtcccggcggcgcacctcgtggcgagaatcgggagaaggaggagactacaaggataggcccaggagtaatggagtccaaagagaaacgagcagtacacagtctcagcatggaaaatgccaaccaagaaaatgaagaaaaggagcaagttgctaataaaggggagcccttggccctccctttggatgctggtgaaatactgtgtgcctagaggaaatcgtaggcggttccgcgttaggcagcccatcctgcagtatagatgggatatgatgcataggcttggagaaccacaggcaaggatgagaraaga

SEQ ID NO: 17867 - DNA, 408 bp, Homo sapiens
agagctacgcagccttcggtgcagtcgtcactcgtgtctcgctaccagctccccgctgccctgygctcggcgggctggcatccggcccgggggaaagcggaccagcccttctgcaggtctgcggggccaagtgtcccggcggcgcacctcgtggcgagaatcgggagaaggaggagactacaaggataggcccaggagtaatggagtccaaagagaaacgagcagtaaacagtctcagcatggaaaatgccaaccaagaaaaatgaagaaaaggagcaagttgctaataaaggggagcccttggccctccctttggatgctggtgaatactgtgtgcctagaggaaatcgtaggcggttccgcgttaggcagcccatcctgcagtataagatggggatatgatgcata

SEQ ID NO: 17868 - DNA, 223 bp, Homo sapiens
aaaaaaagcgtcgcaagccatgagtgcccacaaggaagcatggcactctggcgggcataccagcgggccctggccgctcacccgtggaaaktacaggtcctgacagctgcagctggtggagaggcggggtctgcaggaacaccagaraggccggaytctgaccatggtgtccctgggctgtggctttgtgggccctgtggtaggaggctggtacaaggttttg

SEQ ID NO: 17869 - DNA, 349 bp, Homo sapiens
taaactaccctagagaattagataatttttacgtaggcctattagaaaatgctacagtgtcggccgggcgcgttgtatcaagcctgtaatcccagcactttgggaggccaaggcaggaggattgcttgggtccagaagtttgagaccagcctgggcaacatggccagaccttgtctgtacaaaaaatacaaaaattagccgggcatggtggcacacatctgtcccagctactcaggaggctgaggtgggagaattgcattagctcaggaggtcgaggctgtagtgagccatgattgcaccattgcactctagcctgggtgacagagtgagaccctgttccaaaaaaaaa

SEQ ID NO: 17870 - DNA, 122 bp, Homo sapiens
gacgatttcaactgaagtaatgaaggcagtgtcgtgctgtcgagagaaaggtggatcccaacaacaggaaactacctaaatcaccgaccagttctggtgctgcccgcgaagggstgcctcgc

SEQ ID NO: 17871 - DNA, 283 bp, Homo sapiens
attagagatctaccttcatatatcaaactaccttatatattaacccactgggttatttagtatccaaataacataggtctctgccttatgcgggatttcatacttcaggaaatacagcattgtgcaagtttgctgtgtctgagatcccaattttgtgctactttattgtcaactttagaggaatatagaatttactatgatgttcccctccggttgcattggggaatgggataaaatgataatccttggccttcccaggattctttttttttttttttttttt

SEQ ID NO: 17872 - DNA, 275 bp, Homo sapiens
attagagatctaccttcatatatcaaactaccttatatattaacccactgggttatttagtatccaaataacataggtctctgccttatgcgggatttcatacttcaggaaatacagcattgtgcaagtttgctgtgtctgagatcccaattttgtgctactttattgtcaactttagaggaatatagaatttactatgatgttcccctccggttgcattggggaatgggataaaatgataatccttggccttcccaggattctttttttttttt

SEQ ID NO: 17873 - DNA, 470 bp, Homo sapiens
catcttaaactactggagcatagcagttatctcaagcagataattagtgctagtttttctctttgtccctaacatgatgaatataagttctactcaacagagtataaactgcacaagagcagaaaattttgtctttcctgttaaatgatacatctttaagccttaaaaagtatttcttggaaaaaaaaagaatgagtatcagacaaattcattgcttatatctgctcacatagagtattctctacattagaatccaggtactcttgatcctcttttagagaataaggattgagctgaggaccaagtacttagcattgagaagtgtggctgacattacattacacagatttttttttttgacagggcctatgagattttgttttctcattcataagaaaggttctattctagtatgcatgtggggaaataaattaagaacttgtgtggtgttactcattatagccactgaa

SEQ ID NO: 17874 - DNA, 379 bp, Homo sapiens
gttgttttcagtgatttttgatagctcccattaatgggttctttgcaccacccagcatcctaactcatgatgtgtactgttatgtataatcttggcattgatctcattagctataaaggttgtcctgattttttttcctcaacttccaccttgatttctctcaccagtgccacagccaggaataaagaacaagagcgttttaattagatcagatttacattctgactggctcttaaactagcaaggtgacctagggaaaggggccagggtttccctctatcattcataaatgtaattcagggcccctttttatccccaataccagcatacagaaactgctgtaaaagaagaagttgtgggtattttttttttttttttt

SEQ ID NO: 17875 - DNA, 357 bp, Homo sapiens
  misc_feature 323: n=a, g, c or t
atattttgctgactggcaaggttatatgaagtgcttttattgaagcaccattttaactaatagctcctggtattttctgcttcccttcgtagggaatttagttattttattttattatttagctaatttagctattttaaaatagctaaattttagctactttkttttcaattgacaaagaaggatgtctaatcaaagactaccgctgattttttctctgttgtttatctgcttcttcggggagagtttctgcatttgtgatggaactgtctggacaaaggttggatgggagattcttccagaagaagtacattattggaaankgktgtttatatctcatttataatttattacaag

SEQ ID NO: 17876 - DNA, 442 bp, Homo sapiens
catttcattgccgcccagaaaaaggagggattaaaagttcttttaagatatatttccaggggagacagagtaagatggctccaccaattgttcccctgacaaggacaccaatttaacaatcatctacacagaaaaaacaccctcgtaaggataaaaatcaatacatttgctcttggatcccatccaccacgctgtgaggaagccaaattacctcatgaagatgccctcaaggagctgaaccaaaggctctggcccatagccttacggatctccaagttgaaagtcagcaccaacctgctagtcataagagtgagtcatcttgacagtagatcctccagcctccaacagatgccctgtggagcagagaggagtcattcctatcaaaccctgaaaaattctagatctctaataaaataaattattgatactaaaaaaaaaaaaa

SEQ ID NO: 17877 - DNA, 201 bp, Homo sapiens
cagttaaacttcagttctgtgttcaggtcacttgaacaacattccaaactatggaaataattttttggctctgcggagatgtgtggtatttttagctttctttcccttatgtcaccagtgtgagatactgatatctgaggtatgtttcactcagtcagcctcactatttcttaaactacataggaaaaaaaaaaaaaaaaa

SEQ ID NO: 17878 - DNA, 512 bp, Homo sapiens
accaccttccacatcgtatacatcaccagatggagtcttgctctgtcgcccaggctggaaagcaatggcgctatcttggctcactgcaacctccgtctcctgggttcaattgattcctctgcctcagcctcccaaatagctggaattacaggacactcagaaaaaaaatgaaattatgagaattgttttctcaaatccttttctactgcaaccttcccaccattacgagcataatgaaactcaaatgtgagtccaaggaattattatcttcatttttctactgaggagaactatcaagacttctaatcacatggaataactcattcaggaaatgaggctgggttgctgatgatggaatgagggagttggagggattagaaatgacgtatccataatagacaatggaatcggtgacagacttccactagtggcagcaacctgtgcctcactcctgcacaaatccaaaagggtttttgaggcatttgatggcatgtgctgtgaamaagtagata

SEQ ID NO: 17879 - DNA, 420 bp, Homo sapiens
attgtaatgatagagaaaaaaacaaggaaaactatttaatgaaagcacgatatttatctttggtaaatgactttagagcagttaaagacattgcttaaaaaactcagaatcagaaaaaacactgaattatttaagaacacatatattttaaagtataacatatttattataatttatttgcacccttgggaagattgctttggcattctgccttgattccttctcattgatgtccaggtcatctggaggccgggggttctcagacctaccagtttccctttagaagaacaaatttccagttcctctagggcctcctgcctttcctttctttctgtcaattttgttgttgtttttgtttttcattttctttttttctcttgactcctccttttaggatgtccagatgtaaaaaaaaaaaaa

SEQ ID NO: 17880 - DNA, 114 bp, Homo sapiens
attgtaatgatagagaaaaaaacaaggaaaactatttaatgaaagcacgatatttatctttggtaaatgactttagagcagttaaagacattgcttaaaaaactcagatcagaa

SEQ ID NO: 17881 - DNA, 504 bp, Homo sapiens
actctgagatgaacactttgagcaaacagggccaggacatcacagtgacccaggctgtgaaaacacttcaggccagtccctgagtaggaatggacaacaaggtggtcaccatgctgacagctattccctgtgtgatttactttattatgaagtctaaatttgatgctgaagtgctagcctaagctcactaacctgccaacttagagaagaaggtaaccatggctaggatgactgggaatctgatggactcaattaagaatttctacagatgggaaaaccaaaactccttagtggcaagaggccaaagatggtcagcgaattgttgtttccggctgttggaagttgactgcagttgaataacagaacaaaaacggagcttcaaaatcatggcgtgcctgcttcttctgggttcttttaactgcaagcaatcagctttgaagagcacgtagggaacttctgatgtgatacaaacttttgtcttttttttttttttggcctttwaag

SEQ ID NO: 17882 - DNA, 636 bp, Homo sapiens
actctgagatgaacactttgagcaaacagggccaggacatcacagtgacccaggctgtgaaaacacttcaggccagtccctgagtaggaatggacaacaaggtggtcaccatgctgacagctattccctgtgtgatttactttattatgaagtctaaatttgatgctgaagtgctagcctaagctcactaacctgccaacttagagaagaaggtaaccatggctaggatgactgggaatctgatggactcaattaagaatttctacagatgggaaaaccaaaactccttagtggcaagaggccaaagatggtcagcgaattgttgtttccggctggtaggtgacatttcttctattcgctaagcccattttgtgataacacagttttccatattgacaggattgttttcatcaccaaaggaaaaccgtgggtccatgttcctgtgacaatctctttgtctcattcccaacaccctctgttctgtgtttaaacctctacaaaccaggcaaactggggactatgtgtaggacccagacatggaggagaaagcaggcattgtttctacttaccttatctgcccctcccactaaggtaccagttagtacaaccacgtaacactcacaagtcctacacttc

SEQ ID NO: 17883 - DNA, 472 bp, Homo sapiens
gaaaaaacacttcaggccagtccctgagtaggaatggacaacaaggtggtcaccatgctgacagctattccctgtgtgatttactttattatgaagtctaaatttgatgctgaagtgctagcctaagctcactaacctgccaacttagagaagaaggtaaccatggctaggatgactgggaatctgatggactcaattaagaatttctacagatgggaaaaccaaaactccttagtggcaagaggccaaagatggtcagcgaattgttgtttccggctgttggaagttgactgcagttgaataacagaacaaaaacggagcttcaaaatcatggcgtgcctgcttcttctgggttcttttaactgcaagcaatcagctttgaagagcacgtagggaacttctgatgtgatacaaacttttgtcttttttttttttttggcctttaaagrcctttcaaaamcaaaaaaaaaaa

SEQ ID NO: 17884 - DNA, 386 bp, Homo sapiens
  misc_feature 340: n=a, g, c or t
cagaacaaaaacggagcttcaaaatcatggcgtgcctgcttcttctgggttcttttaactgcaagcaatcagctttgaagagcacgtagggaacttctgatgtgatacaaacttttgtcttttttttttttttgtcttttaagagcattcaaaaacacttggtctggctgtttcaattttctctttctctcctattcctagctcaagaataacatttacatatgaaagaaaataggagatggctcagaataatatgtccaaggccacgcccaggcgtcagggattcatgaattttgtatacagtgtatgatgtttctagattaaaatattttcaaaggtnaaaaaaaaaaaaaaaaaaaaaaaggaaaaaaaaaaaaaaatgcgaa

SEQ ID NO: 17885 - DNA, 432 bp, Homo sapiens
  misc_feature 424: n=a, g, c or t
aaacacttcaggccagtccctgagtaggaatggacaacaaggtggtcaccatgctgacagctattccctgtgtgatttactttattatgaagtctaaatttgatgctgaagtgctagcctaagctcactaacctgccaacttagagaagaaggtaaccatggctaggatgactgggaatctgatggactcaattaagaatttctacagatgggaaaaccaaaactccttagtggcaagaggccaaagatggtcagcgaattgttgtttccggctgttggaagttgactgcagttgaataacagaacaaaaacggagcttcaaaatcatggcgtgcctgcttcttctgggttcttttaactgcaagcaatcagctttgaagagcacgtagggaacttctgatgtgatacaaacttttgtmttttnktgggttt

SEQ ID NO: 17886 - DNA, 508 bp, Homo sapiens
aaacacttcaggccagtccctgagtaggaatggacaacaaggtggtcaccatgctgacagctattccctgtgtgatttactttattatgaagtctaaatttgatgctgaagtgctagcctaagctcactaacctgccaacttagagaagaaggtaaccatggctaggatgactgggaatctgatggactcaattaagaatttctacagatgggaaaaccaaaactccttagtggcaagaggccaaagatggtcagcgaattgttgtttccggctgttggaagttgactgcagttgaataacagaacaaaaacggagcttcaaaatcatggcgtgcctgcttcttctgggttcttttaactgcaagcaatcagctttgaagagcacgtagggaacttctgatgtgatacaaacttttgtcttttttttttttttkgcctttwaagrscwtycaaaamcaaaaaaaaaaaaaaaaaaaaaaaaaaaaaaaaaaaaaaaaaaaaaaaaaar

SEQ ID NO: 17887 - DNA, 433 bp, Homo sapiens
caatcctgctagtaaacactggtcttcggtgagcaacgaacactcgcctggcctgggaaactgcatgcccactttctgggaggggttagtgcaggtgccgtggacaaaggacaacatttctctggggctttttaacttttattcctaagactctaaaggcgttgatttcaaccctccttcactctggctacttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcaaaaaaaaaaaaaaaa

SEQ ID NO: 17888 - DNA, 494 bp, Homo sapiens
atcagtgaatgcttctcgtctgagagtcacttatcacgtagtcagtcttcttgagtctctaagatttaccctgttggagcagtctctccccatctcacagcgaccagtgcatgtacatttctcacttctttcatagtcttgtccccacgctcaagaattactttatgttcatcttgattgttctgttgtcttcctatacaagttatgctggctatccagattctgtgattaaaaataaagtatagccgaaatacagaaagatgtggaatacagattgccattcaccataaacaacctgacaattaacattaatatattgcttcctccacagtttcctcaggaaaaaccagtgatcagtgtttatccaccaatacgacatcacttaatggataaacaaggagtgtatgttacctctccattagtaaacaattttacaatgcactcagatcttggaaaaattattcagagtctgttggatgagttttggaagaatc

SEQ ID NO: 17889 - DNA, 478 bp, Homo sapiens
agtcacacctctatctctcatctttccgctcttagctgggagtgctccgcctagtcacttttcttaaggtggctcgtcgaagcctgacttcttccccgaaatcacgtccctagacagcctcctattttaccactaactttactcctgcagttattcagcggtaggaaactgaaaccaaaaaccagtgtaagcaagtaaacatctaaactgtttcaggagccgcgtagaaggaacgcggcggtgtgcccggaagcggaagtagattctcctatagaaaggctggactacgcggagtggtgacgtttcctcattgggcggaaggttcgctggcactccgttggtcttccagctggtgggagttgacgacgtggtgctgggcgttgggaccctactttatctagttcgggaagttgggttgtggggtcatacctgtctgtctgctcccagctttcttgggtttcttccgacggcgtggggc

SEQ ID NO: 17890 - DNA, 462 bp, Homo sapiens
atacataaggaactgaagactgcctccacttagtagcaagagaggaactgaaccactctgcccaacaatcctcaaggaaacggatcctgccaacaatcaagttacataagctccaaagcctagtctgtcccaggtttgtcaaagagacaagatggccgaataggaacagctccagtctacagctcccagtgtgagcgaggcagaagacgggtgatttctgcatttccaactcaggaagccaatgaagaaggaagcaaatatagaggaggaaaggggataaaaggaagaataatctcagaaaaggaagatagagatgctggagagaagacacctctgtatttgtaggctctccccacatcttgtgagtcactaaagaaaaaccagttgttccaattgttttaacaaaaccaggaactgagattctaaatttacatactctcataccattttatgtttatgaga

SEQ ID NO: 17891 - DNA, 183 bp, Homo sapiens
  misc_feature 161..162: n=a, g, c or t
gaaatgggctgagtccctcttgctcacccttgacttggaaaaaccagtttctcttttattgtctgttactaatctctattctaaaaattcagctcaattctaaaccatactccaaactctctcttttccagctacctttactccctctccttcaattccdnnttcctctgcttactttttttt

SEQ ID NO: 17892 - DNA, 426 bp, Homo sapiens
  misc_feature 417: n=a, g, c or t
aaataaccgcgcgcgcstcggcgttcccgcaaggtcgctttgcagagcgggagcsgcttaagtaactagtccgtagttcgagggtgcgccgtgtccttttgcgttggtaccagcggcgacatgacggggtacactccggatgagaaactgcggctgcagcagctgcgagagctgagaaggcgatggctgaaggaccaggagctgagccctcgggagccggtgctgcccccacagaagatggggcctatggagaaattctggaataaatttttggagaataaatccccttggaggaaaatggaaaaaccatatggcatagttgaaaagaagtccagaatattccctggtgatacaattctggagactggagaagtaattccaccaatgaaagaatttcctgatcaacatcattaaagnttatgtaaa

SEQ ID NO: 17893 - DNA, 399 bp, Homo sapiens
accaattaattcgactgctctctgatccacttgaagaactcagctggaaatcaaacaaagccaacctaaaaaaaaacgtctaacactagagtattcctgtatcctggagaaggcagcactcgagccaccatcttggaagtgaagatcaggccctcagcagacacaaaacctgccagtgccatgatcttggatttttcaacctgcaggactaggaagaaacaccagggatggaaaccacagagaaaaaaaggccatggtcatgtgaggatgcagtaggaagatgatcatctgcaggtcaaggagagatgtgtcttgagaaccaaccctgctggcaacttgattttggatgtccagcctccagaactgtgaagaaaataaatttctgctctttaagtcaaa

SEQ ID NO: 17894 - DNA, 519 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtgamactgtgcctagcctgagccaccacgccggcctaatttttaaattttttgtagagacagggtctcattatgttgcccagggtggtgtcaagctccaggtctcaagtgatccacctgcctc

SEQ ID NO: 17895 - DNA, 315 bp, Homo sapiens
  misc_feature 12: n=a, g, c or t
agakcgggasgngcttaagthactagtccgtagttcgagggtgcgccgtgtccttttgcgttggtaccagcggcgacatgacggggtacactccggatgagaaactgcggctgcagcagctgcgagactgagaaggcgatggctgaaggaccakgagctgagccctcgggakccggtgctgcccccacagaagatggggcctatggagaaattctggaataaatttttggagaataaatccccttggaggaaaatggtccatggggtatacaaaaagagtatctttgttttcactcatgtacttgtacctgtctg

SEQ ID NO: 17896 - DNA, 424 bp, Homo sapiens
aagctgcccgcaatacgtcatggcgaccaaacgccttttcggggctaccggacgtgggccggctggggggcctgggagctcctaaaccccgccacttccggaagactcctggcccgggattatgccaagaaaccaggtgagctgggttaagaggaaccaaatggggacggtgggtgcactgaggaattgacagtgcgcaggcggtggttggggaggtggtgctagaactgatgcgcaacgcagagaggcggatgcaggctgtatgcgcaggcgcagtttgagggacccagcgccttggagctcgggcgtctggctcggagatactgtagcgattggacccagggcgcaggcgccagcttggggcggasggcctkggaggaggatgtggttacgtggagaccacgcgtttcactgcgcaggcgcg

SEQ ID NO: 17897 - DNA, 448 bp, Homo sapiens
ctgacgtcttccggaaacgtgcacttgcaagctgcccgcaatacgttatggcgaccaaacgccttttcggggctacccggacgtgggccggctggggggcctgggagctcctaaaccccgccacttccggaagactcctggcccgggattatgccaagaaaccagttatgaagggggccaaatcgggaaaaggtgcagtgaccagcgaggccctcaaggaccccgacgtatgcacagatcctgtccagctcaccacatatgccatgggcgtcaacatctacaaggaagggcaggatgtacccctgaaaccggatgctgagtaccctgaatggctgtttgagatgaacttgggtcccccaaagaccctggaggagctggaccccgagagccgggagtactggcggcggctgcggaaacagacatctggcgccacaaccgggctgaagca

SEQ ID NO: 17898 - DNA, 484 bp, Homo sapiens
taaatttatcttcagaccggcgaccgcgccagccgcgaatcggatctctatggagatggcctaggcgatatccctgagctgagagcatcaccctgtccccgaatccttctttcctctctgttttgtttttcattcccctccctctctcccctccccctccagtccacgacgactggctgttgaccctgttcaggcctcggtgaaggcttttggttactccccttcccaccccatcccttaattttattcttttgaagagtgcatttcaagctgccaaggtggagagagggattacagaaaggagaacaccttatttcagaaaaggtgtaccatacctgagagcaccaggaagtcgcatgagagatcacctgatacatgaacgtatgatgttccatctgcgcattgatgaataggcagcatttacaaattaactgatgtgttgctgtatatcatctctttgatgattgctcctcttctttgtatc

SEQ ID NO: 17899 - DNA, 501 bp, Homo sapiens
catttcactatcaggctaacctctcttaattctctgaattaataggattttattttaaataatgtttgtaggtattggtagattctttattaagtacatttccatttttgtttagaaattttaattatatatttttatatgttattaggttcaatcttatgatccagaaaccaattcttggctacttcgtgcagctatcccaattgccaaaaggtgtataacagctgtatccctaaacaacctgatctatgttgccggtggactgaccaaggcaatatactgttacgatccagttgaagattactggatgcacgtacagaatacattcagccgtcagtaataacataaagcagtacaaaagaaaaataaatctaagagggaccaagtacataatcattattaatacactggaatttcaattttaaaatatttcaggctgggcgtggtggctcacgcctgtaatcccagcactttgggaggccgaggtggatagatcacttg

SEQ ID NO: 17900 - DNA, 288 bp, Homo sapiens
cagatttcctgcttgcatggtatttgagacttgaattttgtggtttgtacagcaaaaggttaaatgtcatgaatggtaamccactctcaaaacaagtattttttacagatgtttaaaattttgggttagaaaggatttttgaaaattgcagttgacatttggacaaattatttagcagtgtacacctctggagagtaatgcttgggtttatgctagtgattggaattaaattttgcgtaaaaacattgtagatgaaacagattttaaaatagtttattttcctgtttt

SEQ ID NO: 17901 - DNA, 402 bp, Homo sapiens
attgtgacctgggagccctgcatgatgaagggatgatgggtgagctaccaaggctaacattttcccgaggacattgagttagggaagtggcctctccttgagggaaggagccagatgacttctcagagaacaacaaccatattcaaaatattctcaagtttcttttgtttcttcttgtctgcatctgaatccaggacattattccacaggaaaaggttaacaggaaatcaagatcggcccgctcctacagcaaaagaagtactaagaggaaagtttatagtgataagcacctacataacaaaaaacttcaaataaacaacctaatgaggcatcttaaggaatgagaaaagagcaaactgaatacaaaattagtagaagaaaagaaataataaagttcacagc

SEQ ID NO: 17902 - DNA, 380 bp, Homo sapiens
aacattttcccgaggacattgagttagggaagtggcctctccttgagggaaggagccagatgacttctcagagaacaacaaccatattcaaaatattctcaagtttcttttgtttcttcttgtctgcatctgaatccaggacattattccacaggaaaaggttaacaggaaatcaagatcggcccgaagtctggctcttatcacctctgaatagcatgccattctcttagcctcatctaagaaacagactgtaggggaagagaagatctagaatgttggtcaccaaccaatggcagacattatcagacaatttgtgagcaaggaagtcaggaactgtgagccacctgccatcttaatttgacatctagtctcactacttt

SEQ ID NO: 17903 - DNA, 483 bp, Homo sapiens
aaatatatgttctttctacatcacccctctttctactaaaaataatctcagtaagattattattattattattatttttgagacagagttccactgcactctagcctgggtgacagagtgagaccctgtctcaaaaaaaaaaagamctagttcacacccatgtttcctcctgctgccccaaattgccactctcctggagcagcccctgaaggtggagaccaggcacctgctggagcaggaactcttccttcaccggcttctgttggggccccaggatcctgcagctgtggcatccacagggagtaaggccagccacggaggtcctttcatgtcaccaagctgcaggggaggaaaagtgacatcagacagatcaacaggagaaaacccattttaatgatatgtccacgaatgggagtccacacggagatgaaactgggggaaggggccaratggcggaggcgtctgcgtcatcctcagctgcag

SEQ ID NO: 17904 - DNA, 258 bp, Homo sapiens
  misc_feature 253: n=a, g, c or t
ttccctctcacggttagcgctacggctccaaggctggcgcctgctcttcttcatctccctccccggcccttggcaggagcctcgccctacattggctcttcaagtccgggcgtccccttcatgtgggagacacagcccagaccattccatcgccctggattctgcccggaccagcgacctcgccggactgaagatttctccagcaagattgttttaaataaagtttttgccatcaaaaaaaaaaaaaattccnaaaag

SEQ ID NO: 17905 - DNA, 453 bp, Homo sapiens
agaagcgaaagatgactgcgagttaagtcacgggagggcgtaaccgaagtgggagagagctgcggctccggaacgcccggcaggcccagagacgcagcagatggtgcctgaagagagagggcgttgctgcaasgccctggctggagagcatgcctgcccggcaccgtgctgccctgaggagccgcggacagccccggagctcccttccggagttctttctgctgcctccaccgccaccgtctctctctagccccagctgaaatgaaggccataccgcggccacagaacttggttcagtttcaaaggctaatgtagtccctgggttttctgctcaatgtgaattacgctgcctgtgccttagaggaagccgcggastcttcgttgctgcaattgcctcaggtggaataagccttcctaaggaggaccagataagaatctttggaaatggctttt

SEQ ID NO: 17906 - DNA, 435 bp, Homo sapiens
  misc_feature 352: n=a, g, c or t
aagtcacgggagggcgtmsaccgaagtgggagagagctgcggctccggaacgcccggcaggcccagagacgcagcagatggtgcctgaagagagagggcgttgctgcaasgccctggctggagagcatgcctgcccggcaccgtgctgccctgaggagccgcggacagccccggagctcccttccggagttctttctgctgcctccaccgccaccgtctctctctagccccagctgaaatgaaggccataccgcggccacagaacttggttcagtttcaaaggctaatgtagtccctgggttttctgctcaatgtgaattacgctgcctgtgccttagaggaagccgcggantcttcgttgctgcaattgcctcaggtggaataagccttcctaaggaggaccagataagaatctttggaaatggcttttttttt

SEQ ID NO: 17907 - DNA, 299 bp, Homo sapiens
accgtgctgccctgaggagccgcggacagccccggagctcccttccggagttctttctgctgcctccaccgccaccgtctctctctagccccagctgaaatgaaggccataccgcggccacagaacttggttcagtttcaaaggctaatgtagtccctgggttttctgctcaatgtgaattacgctgcctgtgccttagaggaagccgcggastcttcgttgctgcaattgcctcaggtggaataagccttcctaaggaggaccagataagaatctttggaaatggctttttttttttt

SEQ ID NO: 17908 - DNA, 464 bp, Homo sapiens
  misc_feature 441: n=a, g, c or t
agatgactgcgaagttaagtcacgggagggcgtmrccgaagtggtagagagctgcggctccggaacgcccggcaggcccagagacgcagcagatggtgcctgaagagagagggcgttgctgcaasgccctggctggagagcatgcctgcccggcaccgtgctgccctgaggagccgcggacagccccggagctcccttccggagttctttctgctgcctccaccgccaccgtctctctctagccccagctgaaatgaaggccataccgcggccacagaacttggttcagtttcaaaggctaatgtagtccctgggttttctgctcaatgtgaattacgctgcctgtgccttagaggaagccgcggastcttcgttgctgcaattgcctcaggtggaataagccttcctaaggaggaccagataagaatctttggaaatggnttttttttttttttttttttttt

SEQ ID NO: 17909 - DNA, 295 bp, Homo sapiens
  misc_feature 240..241,243..244: n=a, g, c or t
accgtgctgccctgaggagccgcggacagccccggagctcccttccggagttctttctgctgcctccaccgccaccgtctctctctagccccagctgaaatgaaggccataccgcggccacagaacttggttcagtttcaaaggctaatgtagtccctgggttttctgctcaatgtgaattacgctgcctgtgccttagaggaagccgcggagtcttcgttgctgcaattgcctcaggtnnrnntaagccttcctaaggaggaccagataagaatctttggaaatggcttttttk

SEQ ID NO: 17910 - DNA, 447 bp, Homo sapiens
  misc_feature 24: n=a, g, c or t
aagtcacgggagggcgtmrccganagtgggagagagctgcggctccggaacgcccggcaggcccagagacgcagcagatggtgcctgaagagagagggcgttgctgcaacgccctggctggagagcatgcctgcccggcaccgtgctgccctgaggagccgcggacagccccggagctcccttccggagttctttctgctgcctccaccgccaccgtctctctctagccccagctgaaatgaaggccataccgcggccatagaacttggttcagtttcaaaggctaatgtagtccctgggttttctgctcaatgtgaattacgctgcctgtgccttagaggaagccgcggastcttcgttgctgcaattgcctcaggtggaataagccttcctaaggaggaccagataagaatctttggaaatggcttttttttttttttttttttt

SEQ ID NO: 17911 - DNA, 93 bp, Homo sapiens
tttctctctcacagatagtgagggtctgacatgcccatgccacctatgccacagtgcctaagggctaggccacccagagactgtgcccggagc

SEQ ID NO: 17912 - DNA, 500 bp, Homo sapiens
ttccatcttacttttaccaactcagattcttcagccatttgcattgatagccactccccagcatctgctccctcaaaggtgaaaaccagaaattggcagtagatgatatgcaactattaaatataatgtgaagctttagtctcaataggtttggacaaataataaatgaaagtaattttcaaaactgaagggaagtaataccaagaaagtcagcagagtgaaaagaacactggatagaatgaagagacaagactcttagtctctggccaactttgggagacttaattcactttccaggcctcagtttcctcaatcaagaaattggattttaggcatcttttatcagtaattctaaatccgagttgcgaggacagagaacctggaggactgacactgggaagattacagaaggcagagctccagagggcaaagcaagaaaatgttacaaatctatttattcaatccttgaatctgagtatatctgttccactaccaaaaaa

SEQ ID NO: 17913 - DNA, 117 bp, Homo sapiens
ctagtaggccaagggcttcgcccggggcgaatgggacgcccgttccggggtaccagccgcttgcagccagaagttcctcggatcccttggaagcgcaaaaaaaaaaaaaaaaaaagc

SEQ ID NO: 17914 - DNA, 107 bp, Homo sapiens
ctagtaggccaaggrcttcgcacgggcgaatgggacgcscgttccggggtaccagccgcttgcagscagaagttcctcggatcmsttggaagcgcaaaaaaaaaaaa

SEQ ID NO: 17915 - DNA, 481 bp, Homo sapiens
agaaaggcagcttcaactcatgcactgagccctgaggttactgggaacggcaggtgcaaatatctcatgaggagatagaaagttggcataatttggatgagaaaggctactatggctgcaatatggtgagggaggaggttggagcttcagaagcaggtggaggacagatgtgcatgatttagagaaccaagggaaggarttgggtttttatctgaaatctgatgagaaattatgtttgcaattgatttctcatcagattttactaaaatacagagaatcagtaggaagggtactagctgtactctgatagatttctaagtactgcaaatggtgctaagtgctttgtagctgttctcttatttaatccttagaacaatcctgtgaagaaccttctaaatctgatggtatttatggctgtaagttgctggcaatgttttaatctctttgtataaataaagtcattttagccttacaaaaaaaa

SEQ ID NO: 17916 - DNA, 546 bp, Homo sapiens
atcactctttagaatccctgcaactttgagcaagttcgtgaatctcactaaggctcagtttcctccataaaattaatcaatatcagggcctctgcattggacaactccagagggcaccattggggttataccttgtgtttgcctaaccttcattgcagtgggcaggtgcatgctttctacaatgtcctaaggtctaaaggggtagagttctgtgtgtggcattttaggcctggaaaggatgagagtctacaaaaccagagaaatactgcagagctcctaaagtccttggaatgtcctaagtgcaaatggtcaaacccaggagggaatggtatgaacctctggtttacagccattggtaagaagcacacatgacaacctggactttccatcaacatttgaagcgggacagtcttgtgggatcaagctcttaacctgtggggtctgctactaactctgaatccaatgaacacatggacccaacactcctttggccaagttgatgattctccaccatttatttgcctgsctcactatacacttctagca

SEQ ID NO: 17917 - DNA, 512 bp, Homo sapiens
  misc_feature 288,442: n=a, g, c or t
atcactctttagaatccctgcaactttgagcaagttcgtgaatctcactaaggctcagtttcctccataaaattaatcaatatcagggcctctgcattggacaactccagagggcaccattggggttataccttgtgtttgcctaaccttcattgcagtgggcaggtgcatgctttctacaatgtcctaaggtctaaaggggtagagttctgtgtgtggcattttaggcctggaaaggatgagagtctacaaaaccagagaaatactgcagcaaatggtcaaacccangagggaatggtatgaacctctggtttacagccattggtaagaagcacacatgacaacctggactttccatcaacatttgaagcgggasagtcttgtgggatcaagctcttaacctgtggggtctgctactaactctgaatccaatgaacacatngacccaaacactcctttggccaagttgatgattctccaccatttatttgcctgcctcactatacacttct

SEQ ID NO: 17918 - DNA, 293 bp, Homo sapiens
rtyawtckdkkagarkccctgcrrctttgagcaagttcgtgaatctcactaaggctcagtttcctccataaaattaatcaatatcagggcctctgcattggacaactccagagggcaccattggggttataccttgtgtttgcctaaccttcattgcagtgggcaggtgcatgctttctacaatgtcctaaggtctaaaggggtagagttctgtgtgtggcattttaggcctggaaaggatgagagtctacaaaaccagagaaatactgcagagctcctaaagtccttggaat

SEQ ID NO: 17919 - DNA, 207 bp, Homo sapiens
aagaagccacagtagctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaa

SEQ ID NO: 17920 - DNA, 215 bp, Homo sapiens
aagaagccacagtagctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaataaacata

SEQ ID NO: 17921 - DNA, 246 bp, Homo sapiens
aagaagccacagtagctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaataaacataaaaraaaaaaaaaaaaaaaaaaaaaaaaaaa

SEQ ID NO: 17922 - DNA, 218 bp, Homo sapiens
aagaagccacagtagctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaataaacataaaa

SEQ ID NO: 17923 - DNA, 266 bp, Homo sapiens
aagaagccacagtagctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaataaacataaaaraaaaaaaraaaaaraaaaaaaaaraaaaaaaaaaaaaaaaaaaaaaa

SEQ ID NO: 17924 - DNA, 241 bp, Homo sapiens
aagaagccacagtdgctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaataaacataaaaaaaaaaaaaaaaaaaaaraaaaa

SEQ ID NO: 17925 - DNA, 262 bp, Homo sapiens
aagaagccacagtagctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacytcmagctatgcactttttctaatcttaataaattttaataaacataaaaaaaaaaaaaaaaaaaaaaaaaaaaaaaaaaaaaaaaaaaaarr

SEQ ID NO: 17926 - DNA, 259 bp, Homo sapiens
aagaagccacagtagctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaataaacataaaamaaaaaaaaaaaaaaaaaaaaaaaaaaaaaaaaaaaaaaaa

SEQ ID NO: 17927 - DNA, 270 bp, Homo sapiens
aagaagccacagtagctccagtgcatggagcagactcccctttcctactctatgctgtagtgctgagctgacatgaaacaaatctttagtagtagaatattacattttgggtctacttgtttagactaatttagcccatcttatctttaatgcaaagcatttttattaacttcagctatgcactttttctaatcttaataaattttaataaacataaaaaaaaaaaaaaaaaaaaaaaaaaaaaaaaaaaaaaaaaaaaaaaaaaaaaaa

SEQ ID NO: 17928 - DNA, 217 bp, Homo sapiens
aagaagccacagtwgctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaactttcagctatgcactttttctaatcttaataaattttaataaacataa

SEQ ID NO: 17929 - DNA, 235 bp, Homo sapiens
  misc_feature 219: n=a, g, c or t
aagaagccacagtagctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaataaacataaaanaraaaaaaaaaaagaa

SEQ ID NO: 17930 - DNA, 225 bp, Homo sapiens
aagaagccacagtagctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaataaacataaaaraaaaaa

SEQ ID NO: 17931 - DNA, 248 bp, Homo sapiens
aagaagccacagtagctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaataaacataaaaaaaaaaaaaaaaaaaaaaaaaaaaaaaaar

SEQ ID NO: 17932 - DNA, 225 bp, Homo sapiens
aagaagccacagtagctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaataaacataaaaaaaaaaa

SEQ ID NO: 17933 - DNA, 226 bp, Homo sapiens
  misc_feature 14: n=a, g, c or t
aagaagccacagtngctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaataaacataaaaaaaaaaaa

SEQ ID NO: 17934 - DNA, 218 bp, Homo sapiens; identical to SEQ ID NO: 17922

SEQ ID NO: 17935 - DNA, 228 bp, Homo sapiens
aagaagccacagtagctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaataaacataaaaaaaaaaaaaa

SEQ ID NO: 17936 - DNA, 241 bp, Homo sapiens
aagaagccacagtagctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaataaacataaaaaaaaaaaaaaaaaaaaaaaaaaa

SEQ ID NO: 17937 - DNA, 242 bp, Homo sapiens
aagaagccacagtagctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaataaacataaaaaaaaaaaaaaaaaaaaaaaaaaaa

SEQ ID NO: 17938 - DNA, 247 bp, Homo sapiens
aagaagccacagtagctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaataaacataaaaaaaaaaaaaaaaaaaaaaaaaaaaaaaaa

SEQ ID NO: 17939 - DNA, 243 bp, Homo sapiens
aagaagccacagtagctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaataaacataaaaaaaaaaaaaaaaaaaaaaaaaaaaa

SEQ ID NO: 17940 - DNA, 243 bp, Homo sapiens
aagaagccacagtrgctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaataaacataaaaaaaaaaaaaaaaaaaaaaaaaaaaa

SEQ ID NO: 17941 - DNA, 237 bp, Homo sapiens
aagaagccacagtagctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaataaacataaaaraaaaaaaaaaaaaaaaaa

SEQ ID NO: 17942 - DNA, 236 bp, Homo sapiens
aagaagccacagtagctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaataaacataaaaaaaaaaaaaaaaaaaaaa

SEQ ID NO: 17943 - DNA, 248 bp, Homo sapiens
aagaagccacagtagctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaatkttaataaacataaaaagaagaaaaaaaaaaaaaaaaaaaaaaaaa

SEQ ID NO: 17944 - DNA, 214 bp, Homo sapiens
  misc_feature 14: n=a, g, c or t
aagaagccacagtngctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaataaacat

SEQ ID NO: 17945 - DNA, 245 bp, Homo sapiens
aagaagccacagtagctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaataaacataaaagaaaaaaaaaaaaaaaaaaaaaaaaaa

SEQ ID NO: 17946 - DNA, 216 bp, Homo sapiens
  misc_feature 136: n=a, g, c or t
aagaagccacagtagctccagtgcatggagcagactcccctttcctactctatgctgtagtgctgagctgacatgaaacaaatctttagtagtagaatattacattttgggtctacttgttagactartttagccnatcttatctttaatgcaaagcatttttattaacttcagctatgcactttttctaatcttaataaattttaataaacatar

SEQ ID NO: 17947 - DNA, 225 bp, Homo sapiens; identical to SEQ ID NO: 17932

SEQ ID NO: 17948 - DNA, 229 bp, Homo sapiens
aagaagccacagtagctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcacttttttctaatcttaataaattttaataaacataaaaaaaaaaaaaa

SEQ ID NO: 17949 - DNA, 219 bp, Homo sapiens
aagaagccacagtagctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaataaacataaaav

SEQ ID NO: 17950 - DNA, 520 bp, Homo sapiens
acagaggaaaggccatgtgaagcaagaaggcagccatctgcaagccaaggagagaaatttcagaaggaaccaaccctaccgacatcttgatcttggactttaagctgccagaccttttatacattttctacagaaaatgcaccccatcattgcttatagcccacccacgtggactgctcattctgtgaatcatgttttacagatttgtttatgtggcattcctcgtttgaataaagcagaaccaaatgtcttcgtttgaagagagagatgaaatgggagggccacaaatagtaatttatctttgagcatcgtatagataaacatgtaacctgatactaaacaaaagtaaatgctcatggactgtcagtgatgtggtgggatatgccagagggaagtgatttgtggactcactggagagagacttctactagaaggaaagatttttgtaagagaaaatgaakgagtagagaaaattaccaacaagaaccatgttgcacaatgttaaaacacagttctgcta

SEQ ID NO: 17951 - DNA, 444 bp, Homo sapiens
aaaccctaaatttgaaggtcactgaagctgtccctccaccccctgtcaatttactaagagagggttagaggaaaagtaaccccttcacaacaacgtccagagatgtgtgtgtggtccttggtcaggaaccaaaatggttctgttatctcatgtaatccttataacaacaagagaagataggtgctattaagatttcaaacccaggtctactccaagcccctggctcatgaggatctctaggtgacttctctgttctctgccctctgctcatgccaatatcattgaagcataatgggaagttacctactgcctcctaatgagtcgatttaccagtctgtaaaatgggcataatgttgccgcttctccctggggccttgtgaggattaaatgtggggaagcaggtgctcccagaaagtgtagtttagactgtgtcctctcctcctc

SEQ ID NO: 17952 - DNA, 489 bp, Homo sapiens
gttaaacaaattcttggagagggcgagagtggtgactaaagagaggagcctttcctccccttttgcctgcgctccggcggcggagagcctttggaaggaattgggccatgagaagagccctcatgaatgggattagttcccttataagaagagacaccaaggaagtgatctttctctgccctctgctatgtgaagacaaggtcatctgcagttttttgttgttgttgatgatcttcctgtcatagacaatgctgtaacaaacagactaattgttcactgttgacatatagaagtactactgattggccagacatagtggctcatgcctggaatcccagcactttgggaggccaaggcaggtggatcagttgaggccaggaggtggaggttacagtgagctgagatcatgccactgcactccagcctgggtgacagagtgggactctgtctaaaaaaaaaattgtattatctgtaaacggaaatataaat

SEQ ID NO: 17953 - DNA, 495 bp, Homo sapiens
atgctgtagcaagttattgttaaaattttcatctgaagtgaactgtaatagtacccagaggaaagagaaccattttgaagaaggttcaactagtcttacatattttatatggcaaaatattcttatatattctgtgttcccaggtgaatttagatgaatgcagagggcatttgggggtgcaaaagtaactgagcgatgagatgcttataaagcagatatcagttatcctctgttcttggaatgatatctcataaaggcaaagaaatgacactggataatgcaaggcggtaagaggagaggagacagtggttccgtttgctgctggggaaatctttcctgtggaatggagacagaagaagaagcagagggctttctctctgtgaggtcatacactctggagccagtggtacaagtctccatctgactggccaggaagaaggtagcatctgcccattcatatacagaagaccagtggtgggaacacaacgcatttgt

SEQ ID NO: 17954 - DNA, 437 bp, Homo sapiens
  misc_feature 315: n=a, g, c or t
agtattctgtgacatattttgtgggaatgaagtggtcagtgaaggagagaggagttatctggtgactgggaagatggaaattaaacattgagaactcaggtcttcatcatgggaagatctagattatcagagagccttgatcattgaagaaacaacaaataataagtgtggctgttatgcaaagagagaagcaggaaggaccaggctgtagatcatgggatttaataaaggaactatgacagtgtaaaatagagactccatcatatcttggtcatcagcccgttgggatgcagagcccacatacatgaaggcgangggccatagtataaagatacagaactaatcaagctccagatggtgctgcaaactaaacaacacaaggacaagctgttcttccaaggaccttagatcacccccaggwggagccctagtgctgt

SEQ ID NO: 17955 - DNA, 538 bp, Homo sapiens
atcctgatggggctgataaaatcacctcaagatggctctaggccaccccaggttcttaagacaatggtcagctctttcttaagcagtccaagaccctctgacctgagatgtgactggatgattacagacctcttgtccagtgtttagagcctagctgtctgcatattttataaagatatctgccttccagagactggaagtgaaagagatccaatgactgggtgagtcaccctttctccacctagaacacagtccttgatggaactcatgctttatcaattgttgttgagtagaagaaacaaatacatcctccaatcttcacttggtggacctggcatcaaaaaataatcatattaagtgcgtttattagtacacttttctggcttatctgcctttccaagtttctatttgagttcttgcctttgaagggtttgcaggctgtgaaaagtaacttaactttttaacaactttctttgcttggccttgaggcagcttcagaagataagacgccaaaaggractatgtgtgcctggagaga

SEQ ID NO: 17956 - DNA, 219 bp, Homo sapiens
ctattatttttctcaggaatctggttaggaattgcaggcaatgagattttttgcggggcagggatgggaatgtttgttcataaataattagacattttctatagatatttgacattctgcgaaacaacaagcaaactgaagaccaactcctatgagaaatattatgatgtttatgtaataaagacatgtaactgtctcaaaaaaaaaaaaaaaaaagct

SEQ ID NO: 17957 - DNA, 487 bp, Homo sapiens
aaaaccagagccccgtgggctggaacgcgccggaatctgaggtgtgagtagagcctgggggagagtggatccaggtgaagggggcagaggactgggagttttcgtcctcttgaataagaactcgacaacagagtgggaactttctgtcttgtgatccattgcctggtgagtcacagctcacaccatggatttaacctgagagcttcaacttctgctttggccctggagttcccatgccctggtgtcttctaccagttcttaggtagggttttgtatccagagagggttcagctttctcccgtgggctgggggaagaggtcaaagtagaactcaggtaccaaatttgaaaggaaacactcagaaraaacttctgagcgcagagcggaaaacaccctctcagtccccaccaaagagaaaagctttgggttctaaatttccagtttccattaagggactctgggactggacatttctgaaaattaatgac

SEQ ID NO: 17958 - DNA, 400 bp, Homo sapiens
attattgcgggatacttgtgaaatatacataggattctttcttatggctgcatcccggatctggaaattttacttggggaccaggaggatttgaaaggctgcatgtactcagaagatttgcaagcaacactccaattcttgtcatagatctcgcagacttctcacttatcggcttwtttccttccttattttttaagaattattcttattttcccctctctttttctgctctctcctctctcagtctctccttttctatctgcctcttcatttttctcctagtctgttttttktttttcctgctctgcacctggattgtatcttcagcaaacaatcgggcactttgagaactaactggagaaagtcttgtagggaagatctgtatggaattatctgcttt

SEQ ID NO: 17959 - DNA, 440 bp, Homo sapiens
tgtagtgtttgcagtagcgtttctcaccttccctgatgaagggtcttttcagttgcaaaccaacttgccacctcagcggcagaagttgagtgttgttcgtgtcaccacagagtctcgttctgtcacccagcctggtgtgcagtggttcargccattctcctgcctcagcctcccaagtagctgggattacaggcgcccaccaccaagcccagctaatttttgtatgttcggtagagacggggtttcaccatgttggccaggctggtctcaaactcctgacctcaagcgacccacccgcctcggcctcccagagttttgcgattacaggcgtgacaccacgcccagcggaatttcttattctttttgatctatcaaaacaacctcattgttctcaatgactgaccttataataagtaaatgttatagaacataaaaaaaaa

SEQ ID NO: 17960 - DNA, 478 bp, Homo sapiens
agtttctggtatttagaagtcatttatccttccgagagaaataataaagtttcatctactgagaaatgttttaatgattctcctcaaattttaataagtatgagaatcagctgggcaactagttaaaatttacttgctgatttaagttccactctttttgtcgacaataatatggcgcccaaacacgtggggcctcagagaagactctggatccggaaggagtatcccaaaaccagagctaaggtaccagctggagcccactgaagcctcaccgagtttgggcttctcctcctgtggaactggaaaccaaaatcatggtattttgaaaaccagaggtatgaatctccctcgtttggcatcccactgggcctggacctgtttcactgctaatgttctgctgccaaaactatacaagctgcctggactattgcagaagagagacagagtcttgctctgttgcccagaatggaaatgcagt

SEQ ID NO: 17961 - DNA, 427 bp, Homo sapiens
ttaaaagtaagggttgtgctattgacactttaaatttgttggcaattcataaaagttaaaatgattctgttaaaagcctggagtgtgctaacgaagggatctggttacaagaattatttcttacattggctatatgcaattcgtgatatttcactgacattttgggtttttttttaactgtaggttttatttttaacttgttttttaaactttctccagctttatggttccataatgtaatttctgaagagtttggagtgggagtgaatatcttttggaagcaccttccatctgaatgctatgataaaacagatacctatggaaacaaagatcctacagcagcatcaagagctgcacaaattctggacagagccttgaaaacactggccgagttaccagaggaatatagggacttctatgcacgacg

SEQ ID NO: 17962 - DNA, 385 bp, Homo sapiens
acttactagccatgtgaacttgggcaagtgacctaatcctctgcatttcatctctaaattggggagaatagaagcatctacttcatgtagtagccaggattagaaggaggaggaataactgggccctggatagaatgtgatgaatgtatattcttaatgagaagtggaaataatttgtggttgagagctgtgcctcagatcagtgacaggatacatggctaggctatattttccagcagattaagagctgcagcccaagactctgaaatatgaagaaaaaaggagaagatgacagcatatctttttaaagaaatattttccagccaaatggtgcagcagaggacttccaggaatttgttcttgttctgtatcaaaggtgaagagt

SEQ ID NO: 17963 - DNA, 364 bp, Homo sapiens
acttactagccatgtgaacttgggcaagtgacctaatcctctgcatttcatctctaaattggggagaatagaagcatctacttcatgtagtagccaggattagaagagatggggccacttgagggaaaagacctacccaagggcacataatctgtacatgagagagagccagatgtaacagactgagtactggacttggggttaaacagactgtgaatctttccaccccattggcaagttaccttggacaagttactttaatctccctgagcctcaatctgctcatctttaagatggaagtcttaataatctcctcataggggattaaacaagaacatgagcacaccttttctaaaaaaaaaaa

SEQ ID NO: 17964 - DNA, 360 bp, Homo sapiens
acttactagccatgtgaacttgggcaagtgacctaatcctctgcatttcatctctaaattggggagaatagaagcatctacttcatgtagtagccaggattagaagagatggggccacttgagggaaaagacctacccaagggcacataatctgtacatgagagagagccagatgtaacagactgagtactggacttggggttaaacagactgtgaatctttccaccccattggcaagttaccttggacaagttactttaatctccctgagcctcaatctgctcatctttaagatggaagtcttaataatctcctcataggggattaaacaagaacatgagcacaccttttctaaaaaaa

SEQ ID NO: 17965 - DNA, 378 bp, Homo sapiens
acttactagccatgtgaacttgggcaagtgacctaatcctctgcatttcatctctaaattggggagaatagaagcatctacttcatgtagtagccaggattagaagagatggggccacttgagggaaaagacctacccaagggcacataatctgtacatgagagagagccagatgtaacagactgagtactggacttggggttaaacagactgtgaatctttccaccccattggcaagttaccttggacaagttactttaatctccctgagcctcaatctgctcatctttaagatggaagtcttaataatctcctcataggggattaaacaagaacatgagcacaccttttctaaaaaaaaaaaaaaaaaaaaaaaaa

SEQ ID NO: 17966 - DNA, 516 bp, Homo sapiens
  misc_feature 503: n=a, g, c or t
acttactagccatgtgaacttgggcaagtgacctaatcctctgcatttcatctctaaattggggagaatagaagcatctacttcatgtagtagccaggattagaagagatggggccacttgagggaaaagacctacccaagggcacataatctgtacatgagagagagccagatgtaacagactgagtactggacttggggttaaacagactgtgaatctttccaccccattgggaggaataactgggccctggatagaatgtgatgaatgtatattcttaatgagaagtggaaataatttgtggttgagagctgtgcctcagatcagagtgacaggatacatggctaggctatattttccagcagattaagagctgcagcccaagactctgaaatatgaagaaaaaaggagaagatgacagcatatctttttaaagaaatattttccagccaaatggtgcagcagaggacttccaggaatttgttcttgttctgtatcaaangtgaagagttcgt

SEQ ID NO: 17967 - DNA, 468 bp, Homo sapiens
tgaatgattccttaactcgttttaaaaatgaacgaagcatattcgtgtgtgtgtgtgtatatactaagctcttgttaattattgtatacattttagcttataattaaaccattgaatcatggttatatggtgaaaagtaatattaagccattatgtggaatatttgtgagtaaactagtttttaccgtgaaattgtagaaagtactaaatcagaacttttgcttttttccatttgtgagcttgagccactcatttcatctcttttgtcctcttgttcttgatctataaaatcagaagattggatcaggttatctcttagagttccttgaaactccaaatgttcttatttttttacgtaggaattactggattgaataatggggttagaactgtgtgtatatatgtatatatctttgaaaactgggggtaaatcttttttcttttttgtttttggttttggtaaattta

SEQ ID NO: 17968 - DNA, 519 bp, Homo sapiens
tgctgattgttttgctttattttaatttaatgctacatattaagttacggacttgtatattccagggatctggatctgaagaagccaatttatcagaggactgcagcctatggccactttggtagggacagcttcccatgggaagtgcccaaaaagcttaaatattgaaagtgttagccttttttccccagacttgttggcgtaggctacagagaagccttcaagctctgagggaaagggccctccttcctaaattttcctgtcctctttcagctcctgaccagttgcagtcactctagtcaatgacatgaattttagcttttgtgggggactgtaagttgggcttgctattctgtccctaggtgttttgttcaccattataatgaatttagtgagcataggtgatccatgtaactgcctagaaacaacactgtagtaaataatgctttgaaattgaacctttgtgccctatcacccaacgctccaaagtcataattgcattgactttccccaccagat

SEQ ID NO: 17969 - DNA, 412 bp, Homo sapiens
acagatgtctgttcagcaggtgtgtgggcctagaggagagagcagagcccagaaatgtcttttgcaggcccacgttctgacttgaagctttcgtgggcatgttgccattgggttttgcccttgcaaaggcttcctaggtctccagtggcccctcaggacccagggtccagctgctgcttggggatgtgcactgctggccgccggcttgcagtctctctaccctggggaggaacagtggcttctcagagcctggggcatacagaagaaggcaggagttgatttttgtgttgggtttggggtttctttgtcctcaaggtactgttctgtttctctttacccctctgctttatttattgtaagcattcccacgttaaataaactttggctgttgtctaaaaaaaaaaaaaaaaaa

SEQ ID NO: 17970 - DNA, 232 bp, Homo sapiens
attgcttctgatttttggactctgttttccatcttgcagttggaatgctccttccgagccaaagctataggaaggagaaggagatgctgactgacaaacaaggaaacataaggatgatggaaacttcatggctcaaaaccagatggtttgtctcttgaataaaccttatcttccctatgtaataaataaaatcattttcaggtctcctcccaaaaaaaaaaaaaaatgcgaa

SEQ ID NO: 17971 - DNA, 68 bp, Homo sapiens
atcgatctcgggtctaaggtccggccgggtcatcattcctgccatttccacagcattcgaggtaccac

SEQ ID NO: 17972 - DNA, 336 bp, Homo sapiens
atttttggtgcgagagaaacaataggacggaaacgccgaggaacccggctgaggcggcagagcatcctggccagaacaagccaaggagccaagacgagagggacacackgacaaacaacagacagaagacgtactggccgctggactccgctgcctcccccatctctactaaaaatgcaaaattagcccggcgtggtggcacatgcctgtaatcccagctacttgggaggctgaggcaggagaatcgcttgaacacaggaggtggaggtttcagtgagccgagatcgtgccatggtactccagccggggcaacaggagtgatactccatcccaaaa

SEQ ID NO: 17973 - DNA, 503 bp, Homo sapiens
cattttggtgcgagagaaacaataggacggaaacgccgaggaacccggctgaggcggcagcagagcatcctggccagaacaagccaaggagccaagacgagagggacacackgacaaacaacagacagaagacgtactggccgctggactccgctgcctcccccatctccccgccatctgcgcccggaggatgagcccagccttcagggccatggatgtggagccccgcgccaaaggstccttctggagccctttgtccaccaggtcggggggcactcatgcgtgctccgcttcaatgagacaaccctgtgcaagcccctggtcccaagggaacatcagttctacgagaccctccctkctgagatgcgcaaattcactccccagtacaaaggtgtggtatctgtgcgctttgaagaagatgaagacaggaacttgtgtctaatagcatatccattgaaaggggacatggaattgtggacattgtagataattcagactgtgaa

SEQ ID NO: 17974 - DNA, 472 bp, Homo sapiens
  misc_feature 418: n=a, g, c or t
cattttggtgcgagagaaacaataggacggaaacgccgaggaacccggctgaggcggcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggstccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggggacatcagcagccaccagcatggtgtgngtctttgttggggagtgggggagtcttttgtaatcaagacaaagccaaaggccc

SEQ ID NO: 17975 - DNA, 478 bp, Homo sapiens
aattttggtgcgagagaaacaataggacggaaacgccgaggaacccggctgaggcggcaggtaaagctcgcgtcctatggccctagtgcccgaggagctttgagggagattttttcaggctactgggaaacgggatctctgatcattggagtctcccaggttatttgggaaagacttcttccgtggtcattgtgggggaaatctcccggggtccctgtggattcgatttccctgggtcatttgggaggagggtttttcttctgatcattgggggagggatttccgtggttttgggggtccagcatcctccccggtcattggagggggtctcccgggtttgggggagggcaggatctttcctggtcattgagatctccccgggtcttgggaagcgcaagatctacggtgtcattgaggggtctccccaggtcattggcggccacgatctccccagatatttggcgggtggaggggtctt

SEQ ID NO: 17976 - DNA, 480 bp, Homo sapiens
aattttggtgcgagagaaacaataggacggaaacgccgaggaacccggctgaggcggcacttcctaggtgacagacaggtacactgtatgctagccctgtatctgtctgagcagtggaatgtgccaggaaagaaggagcaaccactgactgatgaacctttgccagtctcccttccaagagggatgccagagccttctgtaagctcctcagatgtcactggtatctaggcaacagggatgagcctgaacctccctgaggccagcttacttagcagagcatcctggccagaacaagccaaggagccaagacgagagggacacacggacaaacaacagacagaagacgtactggccgctggactccgctgcctcccccatctccccgccatctgcgcccggagatgagcccagccttcagggccatggatgtggagccccgcgcaaaaggcgtccttctggagccctttgtcaccaggtcgg

SEQ ID NO: 17977 - DNA, 435 bp, Homo sapiens
cattttggtgcgagagaaacaataggacggaaacgccgaggaacccggctgaggcggcagcagagcatcctggccagaacaagccaaggagccaagacgagagggacacactgacaaacaacagacagaagacgtactggccgctggactccgctgcctcccccatctccccgccatctgcgcccggaggatgagcccagccttcagggccatggatgtggagccccgscgccaaaggstgccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggtaagtcccagctgctggaggggttgccaaactgggcgagga

SEQ ID NO: 17978 - DNA, 427 bp, Homo sapiens
gatttcgactccagcagaagttctgcaagatgacctgggaataaagttggccaagaagcctccgaggggagatcggcgtgtgaggtggagagccccacgtctacatgaggtgtgagatcccaacaggttgacaatggaagcagagctgagaatccggtcatcttatattaagccagatgctaaaaaggtttgaaaaaatcaatggactcaggctggtctccaactcctgaccttaggtgatccgcgtcggcctcccaaagttcttggattacaggcgtgacaccgcacccagccaggcagactgatttcaattcttttggttatacacccagtagagagatggcgggatcacatggtagtcctctttttaatttttttgagaaaacttcatactgttttctataatggctgtactaatttacatttc

SEQ ID NO: 17979 - DNA, 508 bp, Homo sapiens
ctaatccttaccctgttactgagttacagtttgattgtgaccacaaaagtaatcacagtcaacaggaatggctggcacaagaacagctggcatcaggtgcaactttctctctcctccatcctagttaagtgccattacttatgcccttacccttggattgtaccagcactgtctagccaagatagttttcctgtggctgatgaatcacatggtaagagggatgagggtggaagttgagggaagataagcagaacagtgaagatcctagccctggggagaataactgtctggcaaattaaagataacgagaatgactttcttccctgcctaggaaattgcctccaaaggtaggtacagaagtgttctaagttgggatagtatcactgggakaagaacaaggcttctagtgaagtgctgtgaaggcctaagtctttttaaatgatcctctgtttcacttgttgttgaaagggaaagttaaaattataaatgcctaaatatatgcacaaag

SEQ ID NO: 17980 - DNA, 510 bp, Homo sapiens
ctatcatgtgaccacttgtcacacttccatcaaacagtacctgccccttaggtgtgctagggaataaatgaaatgcctgrgacatcatcgttaagtggcatctgatgcataagcagtgccctaggaatggggttgcctgccttggtctctaaaggatgggttcaaaaggcaagagcagcacacaagaagatagcttcaagcaggagaaaaagcttggcccagggccaaaggggatacgacccttcagcaaactgacatgctgaaastgccctatggagaggctcatgtggcaaggaacagagggtggcttctggccaacacccagtgaggaactcaggccctcagtcaaacagcctgcaaggaactgaaccctgccaataaccctgggttgaaagcttccctttggagaagaactkagggctgtctctggtcaatagcactkaggaactkaatccagcaaacaattatgtgaagaaacttkgaagcttgtcctcccctctagttgagctt

SEQ ID NO: 17981 - DNA, 464 bp, Homo sapiens
ctatcatgtgaccacttgtcacacttccatcaaacagtacctgccccttaggtgtgctagggaataaatgaaatgcctgrgacatcatcgttaagtggcatctgatgcataagcagtgccctaggaatggggttgcctgccttggtctctaaaggatgggttcaaaaggcaagagcagcacacaagaagatagcttcaagcaggagaaaaagcttggcccagggccaaaggggatacgacccttcagcaaactgacatgctgaaastgccctatggagaggctcatgtggcaaggaacagagggtggcttctggccaacacccagtgaggaactcaggccctcagtcaaacagcctgcaaggaactgaaccctgccaataaccaggcagtgtcagcccccggccaatgaccaccatggacctccctgtagttgaacaaagttgggtttgctgactggtggcagt

SEQ ID NO: 17982 - DNA, 442 bp, Homo sapiens
aacacaagccttgccaccatcttggaagcagcccaccaccatcttggaagtggcccaccaccatcttgggagctctgggagcaaggaccccccagtaaaagtaatgcttattaagtgtggctatcttgagattttaggactgacatgtcattacagctgtcttacttcagattggcacactccactaacacttgaagtaagcaatatgaaatgtttaagtaatttcgtattgatgtgaagatctttgaggacaaatgagatgccctgaatgacaacacatccatagcccactccccgtgtcctaggcaagcccagctgttaagatcccctaaaagtctgctccagtgattgacgcttagtgtggattatggacactgtctcccacttgcagataggtatgataaaatataaatttcaaaattcaagaaaaaaaaaaaaaaat

SEQ ID NO: 17983 - DNA, 178 bp, Homo sapiens
ggatgtaagttactagcaagtaaggtctatgtatagttttacgtatgtttgtcacctgcaaaacaaccaccatggagcttttggaaaatatcagtaaaatgttattagacaagtaccactgcttgctgccattcctggttgcttgatggcagtagggtgtcttggctaagtgctccgc

SEQ ID NO: 17984 - DNA, 532 bp, Homo sapiens
actggacccagcccttagcaacggcctggcgacggtttccctgctgctgcagcccccgtcggctcctcttttccagtcctccactgccggggctgggccggccgcgggaaggacygaagggrwtacagcgtgtccctgcggcggctgcaagaggactaagcatgratggcagccggagagtcagagcaacctctgtccttcccagatatggtccaccgtgcctatttaaaggacacttgagcaccaaaagtaatgctttttgcactgactcctcttctctcagactaagcactctccagctggtcaagaatcacatggctgttcactataataaaatcctttcagccaaagctgcagtagactgctcggttccagtaagcrtgagtaccagcataaagtgtctagaagtacttgtatgaatctgggtgctccagtgttgggtgcaaatatacctaggatagatgcagaccaacaacgaagagagaaactcaaaaaggaattagcacaatgtgaaaaagagttcaaattaact

SEQ ID NO: 17985 - DNA, 456 bp, Homo sapiens
catcctgatttaggctgtaasagattgcatcatggcgcggataccargagaggaacatcwgaggctgcgcaatctctaaggaaaagaggtttatttggctcactgctctgtgggctgtacaagaagcatggcaccagcatctgctcctggtgagaggctcaggctgcttccactcatggcagaagcttgctctggctaacaaccactatcatcaaagttgtctgaggaagacctcctgttgctgtgactgacgggactcttggtggaagccctattcccatgtgcccatggctgcagctccccaaggaagcaggacattgttggattctctaagaagctcagaggaagttacttctcactgtggtgccatatgggatttgaagtcgttctactcatgctctgtttttcaataaagctgcttctgcctctgtaaaaaaaaaaaaaawtgcgaaaagc

SEQ ID NO: 17986 - DNA, 63 bp, Homo sapiens
attttctcgagccgcctgtttcgggtgccgccatgttggtgaggagaaatcaccgtaaccacc

SEQ ID NO: 17987 - DNA, 138 bp, Homo sapiens
aaggtgttgcggccggcgccattttctcgagccgcctgtttcgggtgccgccatgttgagaagatggcgaattagaagatggtgaaatagacgatgcaggatttgaagaaatacaagahaaaaaaaaaaaawtgcgaa

SEQ ID NO: 17988 - DNA, 304 bp, Homo sapiens
cattgctgtcttataactttaaacatatttctttcctatttgtaataacaccaactttttgaatagtctgctaaaaagctttaagcagaaaatgttcttattagagagcaaacgtataaaattgcaaaggaatgcatcatgatgattagggcattcagattcaagaagagttttatgacagcttattctttgggagtgtaagagagcccttaatccattcaagagatgaagaaatttctaagaaagatataattcttagttgcttataagagcatgagatgaagcttttttttttttttttttt

SEQ ID NO: 17989 - DNA, 381 bp, Homo sapiens
ctgcatagctgtttgagaaattcaggcccaaatcatgcagcctatccaataagtaagtttatttccaacattagctctaattagttcatttccaatcccagaacacatggagggaatcggacaggtgatgccagcagttcctgctcctctgtcagggaagccaggcagagccacagagcatggtccatccagagtgttccctgagccccctccaccatactggaacccctcttcagtgtaggaagtctgaaatgggtgctaattcccttcttcatgaaaccagggccctcttccttcatctaatgcagccactcctaggtgaagaagtgggaataattggaaataaacaacagttctaaaacaaaaaaaaaaaaaaaaagg

SEQ ID NO: 17990 - DNA, 212 bp, Homo sapiens
gtctgtcggagtctgtcctcggagcaggcggagtgaagggacttgagcgagccagttgccggattattctatttcccctccctctctcccgccccgtatctcttttcacccttctcccaccctcgctcgcgtacgcatggcggasgtctgcggccactcagtcccattccatctcctcgtcgtccttcggagccgagccgtccgcgcccggc

SEQ ID NO: 17991 - DNA, 387 bp, Homo sapiens
  misc_feature 276: n=a, g, c or t
gaaaacaagcgcgtggaaagcttggtcggggcttctcacagccgcgcgcacagactggttctccccccgcgtctcccgggagcgtcgccgccacctgcacgcgtccggcacacaaacgtcggtctcaccccttagtttctggaagagaaaaaggaaaagccaccgagaggcctgaccctgaggggtcggggggagatgcgggcgcgtagtagagggaagcgactgaggagcgkggactgggcagcatttgaatggatgcgggtgccgctggcmvgnaaagacgcctgggagccggcgctggggagccgtkcatgggctgggatgtgtttggattccaatctgggcctgacaccagttcagtgacctcgggaagttccccaaccctgc

SEQ ID NO: 17992 - DNA, 419 bp, Homo sapiens
tattgcacgattttgggcagttacacaataaggttattctattggggagtacacagatttggctgggtgaaaaaggctagcagagaaaaaggccattttgaaagctgttggaaatagtcctgtgagaaataataagaaaacctatcaaataggccaggcacggtggctcacgcttgtaatcccagcactttgggaggccaaggtgagcagatcatgaggtcaggagttcaagaccagcctggtcagcatggtgaaaccccatctctactaaaaatacaaaaattacctgggcatggtggtgtgcacctgtaatcccagctactcaggaggctgaggtcggagaatcgcttaaacccaggaggcagaggttgcagtgagccgagattgtgccactgcactccagcctgggcaacagaaaa

SEQ ID NO: 17993 - DNA, 439 bp, Homo sapiens
  misc_feature 431..432: n=a, g, c or t
atcctgatttaggctgtaasagattgcatcatggcgcggataccargagaggaacatctgaggctgcgcaatctctaaggaaaagaggtttatttggctcactgctctgtgggctgtacaagaagcatggcaccagcatctgctcctggtgagaggctcaggctgcttccactcatggcagaagcttgctctggctaacaaccactatcatcaaagttgtctgaggaagacctcctgttgctgtgactgacgggactcttggtggaagccctattcccatgtgcccatggctgcagctccccaaggaagcaggacattgttggattctctaagaagctcagaggaagttacttctcactgtggtgccatatgggatttgaagtcgttctactcatgctctgtttttcaataaagctgcttctgcctctccnnytttaaa

SEQ ID NO: 17994 - DNA, 469 bp, Homo sapiens
atcagttgtggttgttgcccaggctggagtgcagtggcgccatcttggctcactgcacctccaccttccgggctcaagcgattctccagcctcagcctcctgagtagctaggactgcaggtgctccaccacgcccggctaatttttgtatttttagtagagatggggtttccccatgttggccaggctggtctcgaactcctggcctcaggtgtgatccgcccgcctccgcctccccaagcgctgagattacaggtgtgagccacggtgcccaggccctcagtaggttttaaggagtccccagccctcctcccttctgggcccgaccagcttatactgctccatcttccccggccacatgccccgccaagtactgcacagggaccccccacccaggggccctgctccgtgagataatgtgaaatacgactgtggaccaaacgcaataaaacctctgttttgtacgagca

SEQ ID NO: 17995 - DNA, 461 bp, Homo sapiens
atgttgcatctatgagtcagttcttcactgctgttattggtatgtctatttactgaacaccctgcatggctttgtaagtaaactgaataggaccctgcattctctacttaaatagagccatctttcagaagagtgataacaaatgacttaatttggaagattcactcaagatccaatttgattcatcgcggacatgcctgcacctaagttcctggggccaaagtgaggaggcagcagttctccacccaatcagaccatcatcctctttttgtaactagtatctttaacactccccttactatcctgaaagctgagcgagtactgggaaaaaggaaatacccagacatttgagggatcactgacactgcttctgaattaatgctaattcctgaggattgcaaacaccactggatccaccaatcaaaatggggatctatgagtgaagttattatggtwagaca

SEQ ID NO: 17996 - DNA, 352 bp, Homo sapiens
gacttgaattttcataagtagactcttagaggttccttctgatgcttcagcacatttccttttctccaaagaaatgcttcagggccgagtgcagtggctgacgcctgtaatcccagcactttgggaggcccgggcgggcgatcacgaggtcaggagatcgagaccatcctggccggcatgatgaagcccagtctctaccaaaagtggaaaagttagacgggtgtggcggcgcgtgcctgtggtcccggctgcttgggtggctgaggcaggggaattgcttgagcccgggaggcagaggctgcagtgagccgagatcatgccactaacgacggagcaagactccgtctcaaaa

SEQ ID NO: 17997 - DNA, 287 bp, Homo sapiens
attgcagtgagcagtgcagtggaagtcgggcacagaggtagcagacagatgtgaagcagtggtgaaggccatgtagcaagtggggaaatacatccaaagggcctgggagttggggggtgcccaacgcaatccttgggggtgcagggtggagcagaaagtgaaggagggacacgtgcaagagtggtgtgccaaggtgggcgggtcatgaggtcaggagattgagaccatcctggctaacacggtgaaacccgtctctactaaaaatacaaaaaaaaaaaaaaaaaaat

SEQ ID NO: 17998 - DNA, 147 bp, Homo sapiens
  misc_feature 52: n=a, g, c or t
gagtcatatggttcatcctgatttaggctgtaasagattgcatcatggcgsngataccaggagaggaacatctgaggctgcgcaatctctaaggaaaagaggtttattttgggctccactgctctgtgggctgtacaagaagcatgg

SEQ ID NO: 17999 - DNA, 317 bp, Homo sapiens
agaactgtggcgctttctgggtaaagatggacgtccacgatctctttcgccggctcggcgcgggggccaaattcgacacgagacgcttctcggcagacgcagctcgattccagataggaaaaaggaaatatgactttgattcttcggaggtgcttcagggactggacttttttggaaacaagaagtctgtcccaggtgtgtgtggagcatcacaaacacatcagaagccccaaaatggagagaaaaaagaagagagcctaactgaaaggaagagggagcagagcaagaaaaaaaggaagacgatgacttcagaaatt

SEQ ID NO: 18000 - DNA, 446 bp, Homo sapiens
agtacggcgcgtgcgcagatcagggatcgcgattgcgaatcctccgctgaggtgatttggatatccctagaacgttgagggcacgagtcgggtcctgagaccaggtcctcagccagcagagccacgttccttatgagcaccgtgggtttatttcattttcctacaccactgacccgaatatgcccggcgccatggggactccggctttgggagaagctgacgttgttatccccaggaatagctgtcactccgktccagatggcaggcaagaaggactaccctgcactgctttccttggatgagaatgaactcgaagagcagtttgtgaaaggacacggtccagggggccaggcaaccaacaaaaccagcaactgcgtggtgctgaagcacatcccctcaggcatcgttgtaaagtgccatcagacaagatcagttgatcagaacag

SEQ ID NO: 18001 - DNA, 417 bp, Homo sapiens
  misc_feature 376: n=a, g, c or t
gatttggatatccctagaacgttgagggcacgagtcggtcctgagaccaggtgctgtgggtcggtsstggggmtgttcaggcactcagggcagcggaagagagagagactaccgtcmtggagataacggttccacggaggcccaaggmgaaacggaaggatmctcatgtacaaaamtgagcggaatggagctagtgagcacgcatcaggtcctcagccagcagagccacgttccttatgagcaccgtgggtttatttcattttcctacaccactgacccgaatatgcccggcgccatggggactccggstttgggagaagctgacgttgttatccccaggaatagctgtcactcsggtscagatggcaggcaaganggactaccctgcactgctttccttggatgagaatgaactcg

SEQ ID NO: 18002 - DNA, 514 bp, Homo sapiens
gactttggggcttagttttcagtagaagtgttgtcctgctctgctgctgttactgcgggactgctaattcaggctaactcaggcggcgggcgctgtgtgctctgaacatcaaaccgcgggtgaggcgtcaacccaggagtttattttgtgatcagagtggaaccactacacttcactttcccctcacctccacctctgagggagcaacgaatacaaaggtgtatgtggaatttgatgatcttgaatgggataaacgagagtgggttaaagtttatgaagatttttcaactttcttggtggaataccacttaatctgggccaaaaggaatgaccctagccagactcagggatcaaagagcaaacagattcagtggcctgcattggtaagatctattcctgtttcattaagcattttcatttgttcgtttaaaacaaagaacaacaacaacaaaacaaaggccaggtttggtgactgacacctgtaaaactagcactttgagaggctgaagcggga

SEQ ID NO: 18003 - DNA, 293 bp, Homo sapiens
gtgagtggagcggggcggtccccagcacactagaggaagtcgtgctacccccgcggagttgtcgtgtgttctggattcattccggcaccaccatgtygaaggtttyctttaagatcacgctgacgtyggacccacggstgccgtacaaagtactcagtgwtcctgaaagkacacctttyacagcgmstcttaaagtttgcagcasawgaatttaaagttcctgctgcaacamgtgcaattattrccaatgatggaataggaataaatcctgcacagactgctggaaatgtttt

SEQ ID NO: 18004 - DNA, 510 bp, Homo sapiens
acactagaggaagtcgtgctacccccgcggagttgtcgtgtgttctggattcattccggcaccaccacgtcgaaggtttcctttaagatcacgctgacgtcggacccacggctgccgtacaaagtactcagtgttcctgaaagtacacctttcacagcagtcttaaagtttgcagcagaagaagtaagtacagaagttggaacaacctttatggaatgcggtttgccaatatgcttcaaatgtctttaagagttgcatgcactttgacccatcatttccatgtggcttcattactaggtttatgttatcaaaaagtaggatgatagttaagacttactttcagatataagaagcatgagttaaacaaattgacatatctgattaatgcaaccattgaaaattataagaatttaatgaatttttatgagaatttttatgaaaactaaaaaggtgctgatttttaaatgttttttaaaatgcaacattatatcacattatattctatatact

SEQ ID NO: 18005 - DNA, 302 bp, Homo sapiens
aagtgggagccacataccccgagctggaggcttgagctgtggtatctaggctcscctcactggggttggtggaggtgatggaggttgcagcttggccagcatggtagaaaggtggcagggcacgtctggcttttaccacccagttgcttcgagccaggagatggaggagtcatctgttgcacgctggaggctggagcctgcagatggcatggttctgtggctcasctcgctgcagttggtggcagagacagagactgcagcttgaccagagtggtggagtgatacgtatctcaagagcactc

SEQ ID NO: 18006 - DNA, 322 bp, Homo sapiens
agttagtcccggcaaagggctccgcgaagacagtgccgtcgttgggcgcgcgcgcgggcgggagctgtcggggcggggcggcaccgccgagctccgagctgcaggactttgaaatgaccctgtcctcagcctggaggatgcggtattctgattgtctggtgctgtgtcaactgggcctgcctctgggatagtgttgtggctgcctcacgagaaccctatatgccagttccagaagcaaaaacaaaaaaagttcgggtacagcggctcacacctgtaatcccagctcttagggagatggaaactggaggatcacttgaggcca

SEQ ID NO: 18007 - DNA, 431 bp, Homo sapiens
agccgccgccgccgtcgcagccgcagtcgccgcagctaggccctcggcgtcgcagggagctccgcagcgacgtggaccaaggtgtatgtggaatttgatgatcttgaatgggataaacgagagtgtgttaaagtttatgaagatttttcaactttcttggtggaataccacttaatctgggccaaaaggaatgaccctagccagactcagggatcaaagagcaaacagattcagtggcctgcattggtaagatctattcctgtttcattaagcattttcatttgttcgtttaaaacaaagaacaacaacaacaaaacaaaggccaggtttggtgactgacacctgtaaaactagcactttgagaggctgaagcgggacgattgcttgaagccaggagttggagatcagcctgggcaaaaaagcgagacccc

SEQ ID NO: 18008 - DNA, 484 bp, Homo sapiens
acagtggctggcaccaygtaggaggacaaatcatgcttgtggagtgagtgaataatcagaaagcgtaggtcctgawaatagaagttaatgactgaagtatctacactwatttattccctaacatcccttgggcacttaactcttagttagatactgtttaaaacacttaaaaagtattacctcacaattactctatcctaaggtagcaactctatgatcccaggtttatcattgtgccacaggcttaggagggaggtctgaacaaaaatgcaagaaaaaggaacttctgtcctccaagccacgtcgtgtaaagatgcagcatacctctcagaaatttaagttaatagaaacaagcactacatgctaatgtacatggaatgtgtgactaacagagaaaaagtgatactgtgaggatgtaaaaagtgagctaactcgaaaagtcctcaagaagtagtgttaatggagtgcttcaagttggaaacaa

SEQ ID NO: 18009 - DNA, 472 bp, Homo sapiens
acagtggctggcaccacgtaggaggacaaatcatgcttgtggagtgagtgaataatcagaaagcgtaggtcctgataatagaagttaatgactgaagtatctacacttatttattccctaacatcccttgggcacttaactcttagttagatactgtttaaaacacttaaaaagtattacctcacaattactctatcctaaggtagcaactctatgatcccaggtttatcattgtgccacaggcttaggagggaggtctgaacaaaaatgcaagaaaaaggaacttctgtcctccaagccacgtcgtgtaaagatgcagcatacctctcagaaatttaagttaatagaaacaagcactacatgctaatgtacatggaatgtgtgactaacagagaaaaagtgatactgtgaggatgtaaaaagtgagctaactcgaaaagtcctcaagaagtagtgttaatgtaatacaaag

SEQ ID NO: 18010 - DNA, 198 bp, Homo sapiens
ctcattggctctgctggtaagtggtctattcctgcccacccccgggtgactagcttggccagtagtcgaccccacccggggaccgactctgggggttggagagactcttggggccggggtcgggcactccagctttcttctagccccgagctgggattccctggcctgcgccastgcgtacacggcgagtacaccgca

SEQ ID NO: 18011 - DNA, 497 bp, Homo sapiens
acatctttaataaactaaggaaataaaattctgtctttcgtcagcctgccttgactgtcaagaaatggcatgtgtccactgtaaagcaggtatatctgaacattgagaaggtttctgtgttataatgtaaagcaaactgggaccacacacatcaaggaaagtgaggtggagtggctgtgtctctaacttgccatgagacctcgagcgaaccacttcacttctctgggtttctggtgcatggtgtaactgtcacttaaaatgaggtgtcttcctctccgcaacatctgacttgccttagatgcttcagttcccacttctgtgagcagctagcatctttctcttctgctcctggcccactggagctccagctctacgctgcaactctctcaacatttccccttaaatgtccccttgtcatctccaaccactgtgtctaaaaccagcataaattccgtatttccaaaaacctaaccattagtcacccaggtttgaaaatt

SEQ ID NO: 18012 - DNA, 189 bp, Homo sapiens
attttcatctgcattttgcagttaggaaactgaggtccacatgtacacagctggtacctacagagccaagatccaaactcagctctgtcagagtggaaaaccagcatccctctccagcatgatgcctacacgagtaactagaggagactgtggaagcctgaggaattatctgccacttttttttttttt

SEQ ID NO: 18013 - DNA, 375 bp, Homo sapiens
tcaagaaaatcggcaaagaccacccttccctaaacccaagcacccaatgatgcaaaaaacaaaaacaaaaaaaaaccaccaaatccccaaattcattccagatctatttttctaccagagagaggagcaaagtcctcctcccctgcgcccttacattctgcacttcatagttggattctgagcttaggatcatctggagaccccatggagggacttggaaaggggaactgggatttggggaggggctggaggacttccgcacgcttccacctccttcgacctccactgcgccccacctccctgcctgtgtgtgttatttcaaaggaaaagaacaaaaggaataaattttctaagctctcaaaaaaaaaaaaaaaa

SEQ ID NO: 18014 - DNA, 500 bp, Homo sapiens
agaagtccttcttgtcctggtcgttgttcccgtctgagtaccagctccccactgccctgagggcgggacggcctgcggcggagggaaaaaggaagaggagaaggaaattgtcccgaatccctgcagtctttctgtaggttgcggcacaacgccaggcaaaagaagaggaaggaatttaatcctaatcggtggaggtcgatttgagggtctgctgtagcaggtggctccgcttgaagcgagggaggaagtttcctccgatcagtagagattggaaagattgttgggagtggcacaccactagggaaaagaagaaggggcgaactgcttgtcttgaggaggtcaacccccagaatcagctcttgtggccttgaagtggctgaagacgatcaccctccacaggcttgagcccagtcccacagccttcctcccccagcctgagtgactactctattccttggtccctgctattgtcggggacgattgcatgggctacgcaggaa

SEQ ID NO: 18015 - DNA, 484 bp, Homo sapiens
aatcggttggggtgtttttcaagtgtgtgggtggtttagttttttcgctgtttggggccatattgcttttatgagctgtgacactcaccgcgaaggtctgcgaasttcattcatgtaagcccccgagaccacgaacctgccgagaggaaggaacaattgtagacgcgccgccttaagagctctaaactcaccgcgaaggtccgcaacttcactcctgagccagcgagaccaggaacccaccagaaggaaaaaactctggaacacatcggaatatcagaaagaacaaactccagacacgccgcctttaacaactgtaacactcacagcgagtgtctgcacttcgttcttgaagttagtaaggtcaagaacccaccacttccggacacaaaagtaaggggattacaggtgggagcccccgcgcctagcccaaactggcgctsgattcttcatttgtatatcgcagttagtaaaaggggctcctgac

SEQ ID NO: 18016 - DNA, 442 bp, Homo sapiens
agtcaccacagccgcggcggcaactgccgagtcggttccgcggccacggtaatgagggggatgtctggagacaccccgtccactgttgccctcgccctttactctaaaggggaatgaggagccctgagcagcgaacacagtaattgggattcccgcaactgcaaatcccgccccttccccgagcgctggccgacagtagggcggaccgacgctgagcaagggattacatcccaagatttacaggtgtgcagaacgtgggacaskkggggggcaggcacagacggccggcagagctgggagggatggattctatgttttaagggcccactttggctgcagtggagccagattatcgtctcgcagtaattcagactttacattgtttttttcattttcccatcacccagaaatacattaaattcttaatgtaaaaatgttaaaa

SEQ ID NO: 18017 - DNA, 71 bp, Homo sapiens
catatctttgcatttgtttctcgaatgtgatcaagttacttggaaactgtgtggtccttttttttcaggca

SEQ ID NO: 18018 - DNA, 167 bp, Homo sapiens
gatttaaaggggcagtaccggcaagagcggcagccacaccggcagattgcagaccgggcaaggtcccccaggccaggatgtcaggcctggtgttggggcagcgggatgagcctgcaggccaccggctcagccaagaggagatcctggggagcacacggctggtcagc

SEQ ID NO: 18019 - DNA, 174 bp, Homo sapiens
  misc_feature 111,163: n=a, g, c or t
gatttaaaggggcagtaccggcaagagcggcagccacaccggcagattgcagaccgggcaaggtcccccaggccaggatgtcaggcctggtgttggggcagcgggatgagnctgcaggccaccggctcagccaagaggagatcctggggagcacacggctggncagccaagggc

SEQ ID NO: 18020 - DNA, 278 bp, Homo sapiens
attcattcttcccacctctttgctgggctgactgctgctcgttcttgtgtctcagcttccamactccctcttcagggsctccctgtctaccctcactccagagtggccgttgccgcggcccacagttccccacctaccagtcttcccacacaggttgagagaggaggggatccaattgcctgtgaggaggacacggctcctgggtggamcctgcagattgtgaagttcaagtcacagctcctgggaargtctctgtgtgtaaagatcatgggggtgar

SEQ ID NO: 18021 - DNA, 502 bp, Homo sapiens
agcgccgcaccccgccggccagagccaccgtctctccagacgcggccccagcgcccactggggatggcaaagacgacatccggtgcgccgaggctgctcacaaaatcttcccacacaggttgagagaggaggggatccaattgcctgtgaggaggacacggctcctgggtggaccctgcagattgtgaagttcaagtcacagctcctgggaaggtctctgtgtgtaaagatcatgggggtgagacagattcagggaccacactctgctctgctctgtacctctgagtgtcgatccagctgccttgtgaccaggacacttagaagaagcatggaccctgcaagaggatgggctcaaggacagcttgcctgactgcagccataagggtgaagcctcttcaggtagagaaggactccaggtggggcctgtgcagagggttcttacgggcgcadtaggattggggctataaaatcagtaaatggaaaaggagccaggtgaaaaaaa

SEQ ID NO: 18022 - DNA, 59 bp, Homo sapiens
agcgccgcaccccgccggccagakccaccgkctctssagacgcggccccakcgcccack

SEQ ID NO: 18023 - DNA, 267 bp, Homo sapiens
agttttcaggcggattgcctcagatcacactatctccacttgcccagscctgkggaagattagcggccatgtattccaatgtgataggaactgtaacctctggaaaaagcgtggggaattgagcacataatactccaaataaccatcagatgattctaattccaacatgaccacgtccaggcaactgaactgtcccctggcaagaagtctaggactgaacctgtcccgggcccctgtacttggttcaaaggatttagcctttctctt

SEQ ID NO: 18024 - DNA, 505 bp, Homo sapiens
agtgcaatctgggcgatcgcttcctggtcctcgcctcctccgctgtctccctggagttcttgcaagtcggccaggatgtctcaggtacagcgcgtgcacagccaggctgcgaaggtgcagcgggcgggaggccgttgggggctcagccggctgccagaagctctcgggctctttccttccgtgcccctcacttgctcatgggcccatgcctagccctgattcgttggacagagccttgtgagcgggattttccgtttggggatttctaaatctgctgcccaccccgcaactgccggaaagttgcccatggggtggacttcgctgtgtagcgggagaggggtgggagtcgagggtgcttgatggagagatgggggaaggggttgcacggattggaggaccgaggagactcagtccccatcccgaagcacagggcaggacgtcgcggcggagtggggaagcgaggagtccgtggccggggagcttggaggtcaggggaagtacgggg

SEQ ID NO: 18025 - DNA, 341 bp, Homo sapiens
tattataatattgttttaatggaagttcagcaattacaaagtagtatgtatgttcttgcaataaaatggccatcaagagaggaaaactaacgctgggtgtggtggctcatgcctataatcccagcactttgggaggccaatccaggcggatcatttgaggccaggagttcaagacaagcctggccaacatggcagaatggtggtgcgggcctgtcatcccagctactcaggaggctaaggtgggaacttgaactcaggaggcagaggttgcagtgagccaagatcatgccactgcactccagcctgggcaatggagcaagactctgtcccaaaaaaaaaaa

SEQ ID NO: 18026 - DNA, 451 bp, Homo sapiens
  misc_feature 425,437: n=a, g, c or t
atcatcttgtagctgctcccagtggcaaagagcaaccaaasractacatatttatcagtgatgaaattggacacactcgattttcctcccactggtaatatttgcagtcagcatgaatagactttctcagtacagttttcaactcctggcacaacagtatcctttttccaaactatagcataaatcacagaaaagtatctcctcatttgtttgggatgagttttaattcagaaacaatttatagtaatattctaagagactgactgaatttgctttcccaactgaaaaaggaatcaactatttgttattatttaatgaagctttgaagcatgaggragtcaattattcttcagtgcagtgatgtacaaaggggactcctgcattttccctgttccctgaagagattaagaacttctgagtggagncaaacgggaaanatattgtttgtgga

SEQ ID NO: 18027 - DNA, 181 bp, Homo sapiens
aagttctacctagttctgccgctttcactggctgtgtgacctcaggatacttagtctctctgggcctcagtttctctacctataaaatggaaataatgatacccacctcctagggctggacatggaatgaaatgagttatacaaataaaaatttaaactataaaaaaaaaaaaaaaaaaaa

SEQ ID NO: 18028 - DNA, 187 bp, Homo sapiens
aagttctacctagttctgccgctttcactggctgtgtgacctcaggatacttagtctctctgggcctcagtttctctacctataaaatggaaataatgatacccacctcctagggctggcatggaatgaaatrgttatacaaataaaaatttaaactataaaaaaaaaaaaaaaaaaaaaaaaaaaa

SEQ ID NO: 18029 - DNA, 425 bp, Homo sapiens
ctcatgggtgcagctgccgccacccagccctggctgcagacccaggcatccctgcactcttggaggtccgggaagacccctttcccccatagtctcagaagtgcctgctcccactgcctggactctccaagctcccggctcctgctctgattttggagcaaagtcgaagctgagcctgggcactattgcaamctggstgggkttkgcamaccttggggtggtgctgccatgccagcttcctaccatcttggccccctctggactttgggtgccagtgagcacaggagggaggccaaaggggtgctgagggtggctcagcatgggcctgcaggtgcccctgggcacagaacaactgggcgtcatggacaacatgattgatggtgacaagaggcagacaggctcctgggtggaaaggggcaggtctc

SEQ ID NO: 18030 - DNA, 131 bp, Homo sapiens
caaacaagttaagggcaagattcttgccaagagaattaatgtgcgtattgagcacattaagcactctaagagccgagatagcttcctgaaacgtgtgaaggaaaatgatcaaaaaaaaaaaaaaaaaagct

SEQ ID NO: 18031 - DNA, 521 bp, Homo sapiens
acaagcatcgtagagcatatcatactatttataccgataataaaggtacatatgttgtcattaataccacaagaggttgtcagaagactctagaactgtgctaatatggtaaccacatgcggcttagtaaattgaaattaacagattagataaaatttaaaattcagtttttcaagtgtataccagacacgtttcaagcactcagtagtcatgaggcctgtggctaccgtattaatagagacacagaacatttccatcatcatagaacattcttttggatagcactgttctacaagtgttttgttaacagtatcgtcttggacctcatgttcatagccacttttgtggttcctaagtcaacaccttttttgccctgagtgtcattaaaggggttgttaagaagtacttttgggtcttctattaaaactaaaaaacaaaatgagaaaaataatgggagaagaggaaaagttgaccagagaagggtaagaaagtttgcatagtggagatgggtagaggagcac

SEQ ID NO: 18032 - DNA, 424 bp, Homo sapiens
cactcatttcagacaattgccattttagatattgctatcgccatcttttgcaattaagtttcaaagttatcatcatggcatttttaatatttagaaatttctttttttatctctggctttcagttgaagactattcaccccggtggactcatcatgttggggactttcaattgctactttaaaaagaacgcttcactgaaataggtctcatcccatcaggaacatagaaaaacaagcagcaggccgggcgcggcggcacaggcctataatcccagctacttgggaggctgaggcagaagaatcgcttgaacccaggaggcggaggttgcagtgagccgagatcgcgccactgcactccagcctgggcgacagagagagactctgtctcaaaaraaagyaaaaaaaaaraaaaaaaggaaaacaa

SEQ ID NO: 18033 - DNA, 474 bp, Homo sapiens
  misc_feature 16: n=a, g, c or t
tttctccykscyysgncyyccmarkwrsykggrmyksmrgssscykscmmcmmskycsgsykkttttttwawwwttttkgkwarrrmsgggkttymmcskkktkscmagrwkgkyyysrwyyycykgacyymwkrwycssccmmytkgggsmwtttwmmrrrkksykrwtkgkkkkkttwmmaamcyttwrsywmmmmrraaaaktyyycmmsktmccmacccmmccmrrarsccmrscmrsytymmcyyyymmykggrmywwwrggmwkrmywmykkksmwkgscmwkrawwarkttyytwawyyttyykrmccyymrkttycmmmwysrwwrgsmwtargawwmcywwyyymaarkkkymwwaaaarggwtwaawactktctgtgaaaatgtctcatgtctgtaatcccagcactttgggatgcmarkyykgrrgrwycyttkragscmrgrrktcgagagcagcctgggca

SEQ ID NO: 18034 - DNA, 191 bp, Homo sapiens
attgcatgcattaggaagttttttttgggttttattcatcctgtagtgatgtatctgtgacctcaacgagtaggcacttctgtactgtactggtttcttaaagtttcttttatcccgcccccacccccaacctcagcctcaagtatgtaacaccatgcctggctaatttttgatttttttttttttttttt

SEQ ID NO: 18035 - DNA, 206 bp, Homo sapiens
agagcaatggggacgggcagggacagagctgcgggctgaggttcctccgttcggcgaasccttctctctgcccccgcctgctctgggctttcttggctatgtctgctcctgacaggagggatgtgtgttgccaggggtgggggcttggcgtgtgtgcgtgtgagaatatgtgtgtgtgtttaaaatacaaaaaaaaaaaaaaaaag

SEQ ID NO: 18036 - DNA, 381 bp, Homo sapiens
agtctgggtgttgagttccgggaccggagttcccgggccttttggcttctgtagtctgtacctttttaagcagtggaagtgcctgggtggattctccaatgctttattgttttcttgttacaattatttattttacttcccgtgatgtttcagcctcatcccttcaccatttgttgttgttgttgtttttgagacggagtctcgccattgtactccagcctgagcaacaagagtgaaactccatctcaaaaacaaaacaaaacaaaacaaaaaacaaagaagccatgtttacccactacctagcttctgtcttttcttttaatggcacttattcttccctctgctccttaaaggtaagcaaccttctagtttcagtgtggg

SEQ ID NO: 18037 - DNA, 208 bp, Homo sapiens
agtagagtccagagcggggaagcggcgcctgcgcagagacatagtgaccgtccgctcgccgccccgcctctgccaagccgcgccagcagtgaataacgagccagcagagacagcgtctgcgcascgtggctgaggagcctgtgsgcasggcgatggaaccagcggasagccgagckwgttagtgtcagccgaggggccgaaaccggaa

SEQ ID NO: 18038 - DNA, 67 bp, Homo sapiens
ataattcgaataccagggcaggccgagccagccgtgcgccgcgctccagggcccagggcgccgcaca

SEQ ID NO: 18039 - DNA, 145 bp, Homo sapiens
cgattctaaatttgttagtaatatattttattcatgcactctacttacaatagatttcctgcttgacatttcttagacatatcactcatgatcccacagttgctctttgaatgggtgcgaaacctgtgcaaaaaaaaaaaaaaaa

SEQ ID NO: 18040 - DNA, 389 bp, Homo sapiens
atttacacagggcggtggcgacggcggtggtggtgatggtgacggtgctgtgctacaggtcaagcgattctcctgcctcggcctcccaaggaactggaaccacaggcgcgcgccactgcsccaaggattttcacttttaactgtacagtgaagcacagacttctgagccagactgcttggtctgaactctggtgtcaccacttaaaaacaacaacaacaacaacagaagagaaaacccaaaagagtgaaaaataagaaagaaaaaaaaagctcccgcaagaggttcttctccctcccccccaccatgcgaatttgcacaccacgggaccacagcaggtttacagaatgcaatatacaatccacgatttataataaaacagtatatacaa

SEQ ID NO: 18041 - DNA, 245 bp, Homo sapiens
ttaatatcccatttctagttcgttattatttaagtaatttgcaagtacattctcattttaaaagattaaacgaaaggaacatgtaaagaataaagctgggggctgggcttggtggcttatactggtaatcccagcactttgggaggctgaggcgggtggattacctgaggtcaggagttcaagacccgcctgaccaacatggtgaaacctgagtctactaaaaatacaaaaaaaaaaaaaaattt

SEQ ID NO: 18042 - DNA, 406 bp, Homo sapiens
actgcaagctctgccttccgattcacgccattctcctgcctcagcctcctgagtagctgggactacaggcacccgccaccacgcccggctaactttttgtatatttagtagagaaggggtttcaccgtattagccaggatggtctcgatgttttgaccttgtgatccgcccacctcggcctcccaaagtgctgggattacaggcgtgasactgcgcccggccaaaaatggttgagttcttaatttaggattctttgccattagcccacagatgtctgtgacatatttggcgsctcaccttcaatcactggggggattctgagccttccctattattgaaatggtgagtatcatatgttccagaattaaccaggagacacaagctgtacatgctcatgcacgtatct

SEQ ID NO: 18043 - DNA, 462 bp, Homo sapiens
  misc_feature 382,425: n=a, g, c or t
actgcaagctctgccttccgattcacgccattctcctgcctcagcctcctgagtagctgggactacaggcacccgccaccacgcccggctaactttttgtatatttagtagagaaggggtttcaccgtattagccaggatggtctcgatgttttgaccttgtgatccgcccacctcggcctcccaaagtgctgggattacaggcgtgacactgcgcccggccaaaaatggttgagttcttaatttaggattctttgccattagcccacagatgtctgtgacatatttggcgccctcaccttcaatcactggggggattctgagccttccctattattgaatggtgctttgcttcagtgaataagccaactggagcggtggcnaatggtgggtgctactggcacccccttcgactacatcagcacnaagacatgcttttgtttgttgtgtctttaaaaatctt

SEQ ID NO: 18044 - DNA, 91 bp, Homo sapiens
  misc_feature 63: n=a, g, c or t
gcttagtcattgtcttccaggaaacagctccctcagtttggaatcagctctcccgctgcggsngcagtagccggagccggagccgcagcca

SEQ ID NO: 18045 - DNA, 86 bp, Homo sapiens
acacttcctgccacagtggtggctagagaagtacagacagagtataatggagacctctagcctctaatcatgggcactaaagggga

SEQ ID NO: 18046 - DNA, 433 bp, Homo sapiens
agatgggggtaggagctctccagacagtgtcccctcactcacccccgcggcgcctggcgtcttctcctgggtgttgaagtacaagatttgaagagatttcctgggtgtggagtgtgactttccaaaaccagcttttccttgagctgtatttgttgcagcaatgtttaggagattgacttttgcacaactgctttttgccactgtccttggaattgctggaggagtatatatttttcaaccagtatttgaacagtatgccaaagatcagaaggaattaaaagaaaagatgcagttggtacaagaatcagaagagaagaaaagttaatactacatggagttaggcctggcgcagtggctcacgcctgtaatcccagcactttgggaggccgaggcgggtggatcaggtggtcaggagttcaagaccagcctgacc

SEQ ID NO: 18047 - DNA, 400 bp, Homo sapiens
agctcccacccgacgtggtggcctccttgcggtttcctttcgccgtttccgaaccgagggattgctactcgcctttggcttggcggtctctgtgctcgggggtccgaaaactgctggaaggcccccggtctctggaggggagcaggcggtasgagtttagtgacgtggagcaggcgcagaacagtcggaggtgcctgagtggttattaaaaacgatttgaagagatttcctgggtgtggagtgtgactttccaaaaccagcttttccttgagctgtatttgttgcagcaatgtttaggagattgacttttgcacaactgctttttgccactgtccttggaattgctggaggagtatatatttttcaaccagtatttgaacagtatgccaaagatcagaag

SEQ ID NO: 18048 - DNA, 106 bp, Homo sapiens
cggatactttactcaataagcatttcccctggagtgtccgtgccctggtgttttttatcgatacgttgattaaaacgcgtggttccccgtgtgcctgaagcagaaa

SEQ ID NO: 18049 - DNA, 318 bp, Homo sapiens
ttcatttggttttttacatgccgttcctcaatccatttggaattcatttgggttgtaatataaggcaaggtcttgcttttgtttttttatttcctgtacagctggtttccccaacatttgtggccttttgctatgcgatctggtcatttttttttaaataatgcaagtttttggccgggcacggtggctcacgcctgtaattccaacactttgggaggccgaggcaggcagatcacctgaggtcaggagttcgagaccagtctggccaatatggcgaaaccccatctctactaaaaatacaaaaaaaaaaaaaaaaag

SEQ ID NO: 18050 - DNA, 363 bp, Homo sapiens
agtctggcgtcatctaggtcgctgctcagggaaatgcggaggccagtaggcttacgtgtttaccgcgtagggcaaagccttgccaaattcccggccagcggaggccgagggtggggactcacgggaagttaaacagcctcgtcggcgtcctcgaggctccaaaaccaggctctaggcggggacgactgcagccgttatggaggccaccgcggctacggccgsktttgaggcctccccaggtggagcggtggcctggagggkaatcttgatcctgggccagccacctgtcaagaggaggcggasgtcatgcctctggaagactggatgaatattctccaggagccctgacgaaggcgtgagtaa

SEQ ID NO: 18051 - DNA, 235 bp, Homo sapiens
  misc_feature 104: n=a, g, c or t
agtctggcgtcatctaggtcgctgctcagggaaatgcggaggccagtaggcttacgtgtttaccgcgtagggcaaagccttgccaaattcccggccagcggasncgagggtggggactcacgggaagttaaacagcctcgtcggcgtcctcgaggctccaaaaccaggctctaggcggggacgactgcagccgttatggaggccaccgcggctacggccscttgaggcctcccca

SEQ ID NO: 18052 - DNA, 454 bp, Homo sapiens
cagatataatccccttcttggtggtctcattgagccttagctcaatgtaaaagtgatgcatcttaaaacctattttaataaattttatataaatataactatatataaaaaactataattttatataaaaattcgttttaaaaaagttaactaggctgggcacagtggctcacgcctgtaatccaagcactttgggaggccaaggcaggcagatcacatgaggccaggagttcgagaccagcttcgccaacatagtaaaaccctgtctctactaaaaatataaaaaattaaccgggcgggtgttgcgtgcctgtaatcccagctactcgggaggccgagacaggagaatcgtttgaacctgggagacaaagatttcagtgagccaagatcacgccactgtactccagcctgggtgaccgagtgagcttctgtctcaataaataaatcaataaat

SEQ ID NO: 18053 - DNA, 477 bp, Homo sapiens
aagaaagaaagaaagaaagggagagagtgtagatgtcttgatgagtccctaagtagaaacacgaagagaaaaggaactaaaagaggaagccacggccaagagtggagcattacaatgttaagacttctagtatggagcagcacagttaggggtatggacaagtgcaagtcttggagtagaaagcaaagaactctgttgaatggaacgtggccacaccataccttggtgtgatctcaggttttggataggttggctgtagatagtcattgaatgtgggagaacagcctagagagctattaatgacagaaactgacaaatagaatgtagaatattagcttgtgaggaggaagggtttggagtaacaggaaagtagtcattgagtatgtgaggagctaggagaacatggaaatctttcttctcctacagcagtctctatctgaaaaaccatcagggagatagtttattcagaaaatagtt

SEQ ID NO: 18054 - DNA, 179 bp, Homo sapiens
cggatactttactcaataagcatttcccctggagtgtccgtgccctggtgttttttatcgatacgttgattaaaacgcgtggttccccgtgtgcctgaagcagaaaaaaaaaaaaaaaaaaaaaaaaaaaaaaaaaaaaaaaaaaaaaaaaaaaaaaaaaaaaaaaaaaaaaaaaaaaa

SEQ ID NO: 18055 - DNA, 74 bp, Homo sapiens
aatccggtttccgctttcggtgcgctcacggggccgtgccaccgtctctacgtgagcgagacagctccgtaacc

SEQ ID NO: 18056 - DNA, 125 bp, Homo sapiens
ctgttgcccagcgcgggcccgttgaggcggacctcagttcccggccaggacacggtctgggccgccgaatctccggccgaagagcggcggcggcasggamccgtgagcagaggagccttgtggaa

SEQ ID NO: 18057 - DNA, 167 bp, Homo sapiens
attattgaaagagtctgggacccttgttggggagtgggtggcaggtgggggtgggctgctggccatgaatctctgcctctcccaggctgtccccctcctcccagggcctcctgggggacctttgtattaagccaattaaaaacatgaatttaaaaaaaaaaaaaaaa

SEQ ID NO: 18058 - DNA, 153 bp, Homo sapiens
  misc_feature 153: n=a, g, c or t
cggatactttactcaataagcatttcccctggagtgtccgtgccctggtgttttttatcgatacgttgattaaaacgcgtggttccccgtgtgcctgaagcagaaaaaaaaaaaaaaaaaaaaaaaaaaaaaaaaaaaaaaaaaaaaaaaaan

SEQ ID NO: 18059 - DNA, 477 bp, Homo sapiens
accacgcaggggaagagaaagcaggagccgtccagcacggaggaaggcgaccatggccaaggagtggggctacgcagtcacaacggtcctgaccactggcatgaacttttcccaaatgccaagggggaaaaccagtcgcccrttgagctgcatactaaagacatcaggcatgacccttctctgcagccatggtctgtgtcttatgatggtggctctgcaagaccatcctgaataatgggaagacctgccgagttgtatttgatgatacttatgataggtcaatgctgagagggggtcctctccctggaccctaccgacttcgccagtttcatcttcactggggctcttcggatgatcatggctctgagcacaccgtggatggagtcaagtatgcagcggagttcatttggttcactggaacccgaagtataacacttttaaagaagccctgaarcagcgcgatgggatcgctgtgat

SEQ ID NO: 18060 - DNA, 552 bp, Homo sapiens
ctctctctctgcctgtcctagtcctctagtcctcaaattcccagtcccctgcaccccttcctgggacactatgttgttctccgccctcctgctggagtgatttggatcctggctgcagatgggggtcaacactggacgtatgagggcccacatggtcaggaccattggccagcctcttaccctgagtgtggaaacaatgcccagtcgcccatcgatattcagacagacagtgtgacatttgaccctgatttgcctgctctgcagccccacggatatgaccagcctggcaccgagcctttggacctgcacaacaatggccacacagtgcaactctctctgccctctaccctgtatctgggtggacttccccgaaaatatgtagctgcccagctccacctgcactggggtcagaaaggatccccaggkgggtcagaacaccagatcaacagtgaagccacatttgcagagctccacattgtacattatgactctgattcctatgacagcttgagtgaggctgctgagaggctcagggctggctgtcctgggcat

SEQ ID NO: 18061 - DNA, 436 bp, Homo sapiens
tttggctcttcgggtaaagatggcggacgrcgggtacagcttttcgctgactacattcagcccgtctggtaaacttgtccagattgaatatgctttggctgctgtagctggaggagccccgtccgtgggaattaaagctgcaaatggtgtggtattagcaactgagaaaaaacagaaatccattctgtatgatgagcgaagtgtacacaaagtagaaccaattaccaagcatataggtttggtgtacagtggcatgggcccgattacagagtgcttgtgcacagagctcgaaaactagctcaacaatactatcttgtgtaccaagaacccattcctacagctcagctggttacagagagtagcttctgtgatgcaagaatatactcagtcaaggtggtgttcgtccatttggagtttctttacttattttgtggtt

SEQ ID NO: 18062 - DNA, 195 bp, Homo sapiens
cggatactttactcaataagcatttcccctggagtgtccgtgccctggtgttttttatcgatacgttgattaaaacgcgtggttccccgtgtgcctgaagcagaaaaaaaaaaaaaaaaaaaaaaaaaaaaaaaaaaaaagaaaaaaaaaaarraaaaaaaaaaaaaaaaaaaamccaaaaaaaaaaaaaaaaar

SEQ ID NO: 18063 - DNA, 364 bp, Homo sapiens
agtacggcaaatatggcggasatcstgttgaatcttcaagtccaggaggttcagcatcatcagatgaccatgaatttgatccatcagctgacatgctggttcatgattttgatgatgaacgagcattrgaaagaggaagmaatgatggaaggrgaaacaaacttcagstctgaaatagaagatctgtcgtctgttcaggatttgaaaaagwagaggmwgaaaaccttawcacggaagtctgcatcaaagtaaagttcttctgaagtgctgctccatgtttcyaccaaatgaattttttttatcctcctgactcttcaggccaggtagcagcaaatagcamatgaaaaagtcagctacaaaagtt

SEQ ID NO: 18064 - DNA, 443 bp, Homo sapiens
atcagaattgtgtccattttccaggaacagaaaccaatgaaacagacttaagaaaaagaaaagaaattatggaccagtgtaactgagatagggagtcggaggaggttggcagaatcttcccttccaccatttttccaggtggctgtgttctcatggggccgccttgagcgtctgtcctccctgccaggcagtcccagtagaggagtctgttctgacccctggctccagcagaagtcccaggattctgaggccgggcatggtagctcatgcctgtaaccccagcatttcgggaggccaaggcgggcggatcacttgaggtcgggagttcgagaccagcctggccaatatggtgggacacatctctactaaaaaatacaaaaatcagcagggcgtggtggcacacgcctgttaatcccagctactcgggaggctgaggcaggaga

SEQ ID NO: 18065 - DNA, 109 bp, Homo sapiens
cggatactttactcaataagcatttcccctggagtgtccgtgccctggtgttttttatcgatacgttgattaaaacgcgtggttccccgtgtgcctgaagcagaaaaaa

SEQ ID NO: 18066 - DNA, 160 bp, Homo sapiens
cggatactttactcaataagcatttcccctggagtgtccgtgccctggtgttttttatcgatacgttgattaaaacgcgtggttccccgtgtgcctgaagcagaaaaaaaaaaaaaaaaaaarraaaaaaaaaaaaaaaaaaaaaaaaaaaaaaaaaagr

SEQ ID NO: 18067 - DNA, 393 bp, Homo sapiens
ctacaatgcccttatttcactctgcctgtgggagtcctgtgaatctctccaaagccaactcagttcatctttctgcttgaaaccttccctgaataggccaggtgcggtggctcacgcctgtaatcccagcactttgggaggccaaggcaggcagatcacaaggtcaggagatggagaccatcctggctaacacagtggaaccccgtctctactaaaaatgcaaaaaattagctgggtgtggtggcgggcgtgtgtcgtcccagctacttgggaggctgaggcagaagaatctattgaacccgggaggcggaggttgcagtgatctgagatggtgccactgcactccagcctgggtgacagagcaagactctgtctcaaaaaaaaaaaaaaaaa

SEQ ID NO: 18068 - DNA, 162 bp, Homo sapiens
cggatactttactcaataagcatttcccctggagtgtccgtgccctggtgttttttatcgatacgttgattaaaacgcgtggttccccgtgtgcctgaagcagaaaaaaaaaaaaaaaaaaaaaaaaaaaaaaaaaaaaaaaaaaaaaaaaaaaaaaaaaaa

SEQ ID NO: 18069 - DNA, 54 bp, Homo sapiens
agaggagctcrgcctgcgctrsgcsacgatgtccggggagtcagccaggagctt

SEQ ID NO: 18070 - DNA, 427 bp, Homo sapiens
ccaattagagaatgctgagaatgtcccctgcatatcggctctgttggagagcccctgatttttagcagacctgtttcattcaacatgggttacccaggaggtggtcttcataaaaatgtttcttggaggccaggcgccgtggcccacgcctgtaatcccagcactttgggaggccaaggtgggcagaccaccttaggccaggagttcgagaccagcctggccaacatagtgaaactccgtcgctactaaaaatacaaaaaattagctgggcgtggtggcgggcatctgtaatcccagctactctggaggcagaagcagggagaatttcttgagcccaggaggcagaggttgcagcgagccgagatcatgccactgcactccagactgggcaacagagcaagattccgtctcaaaaaaaaaaaaaaaa

SEQ ID NO: 18071 - DNA, 160 bp, Homo sapiens
cggatactttactcaataagcatttcccctggagtgtccgtgccctggtgttttttatcgatacgttgattaaaacgcgtggttccccgtgtgcctgaagcagaaaaaaaaaaaaaaaaaaaaaaaaaaaaaaaaaaaaaaaaaaaaaaaaaaaaaaaaa

SEQ ID NO: 18072 - DNA, 450 bp, Homo sapiens
tttctgttctatttttttttaaccccaattatccttctctctctcctgcccccgcatcccactcccagggtgtcacgagccctgagctgcaatggcccgggcctgcagggcggggtaggggagggcaggggctcagcccgarakccagctcagtacctgaggggctgctctatgctgtgtatgcgcctctctggcatccgagacatcctcttggctggcgcttgctgcaggggggaccccccccagtccccaggtgaaccaagggtctgctccggggcccatttccagcttggccgccgtctgtgaccttgggcaagtcacttgacctctgtgtgcctcaacttcctcctctgtaaaacggggacagtccctgcccctccctacctcacaggcatgttgtgagaataaatgaggtaacgtgtaaaaaaaaaaaaaaaaaaaaaaaaaaaa

SEQ ID NO: 18073 - DNA, 518 bp, Homo sapiens
gcgggacccgcgcggggaggggaaaccagcctcaaccgcctggcagcggcggtttcttctcttcgtgaaaatcgtgatctcatctctccgtccatgggcgaaaaaacagccatcaccaggccattcacgctttgtgcttttgttagcagagcccaggcagccctgcagcccacatctagggtacaaacggaacggcggcgttttccttgtatcatttagaggaaatttttgagctgaacagtattttttttctccctctctctctctctgaaatattgctgagatttaaaggaggacgaagacaacagattcatagctgggtcttgctgttttcctgacgctgaccacagcggatctaggtggctatttcgttggtgcacaggcgttcacagaggcagagaggggagaaagttgtcaaacagattcacagactgtcaaagtgcggcwtaaaccgagttcctgggctcctcactggcttcgtccacttaaacttttaacgtacacatgtagagagctga

SEQ ID NO: 18074 - DNA, 198 bp, Homo sapiens
atttccggttccggtgtcagttcgaggcgccgccgccgccgccgcagccgccggagccgcaatgcctaaaggaggaagaaagggaggccacaaaggccgggcgaggcagtatacaagccctgaggagatcgacgcgcastgcaggctgagaagcagaaggccagggaagaagaggagcaaaaaaaaaaaaaaaaagct

SEQ ID NO: 18075 - DNA, 120 bp, Homo sapiens
cggatactttactcaataagcatttcccctggagtgtccgtgccctggtgttttttatcgatacgttgattaaaacgcgtggttccccgtgtgcctgaagcagaaaaaaaaaaaaaaaar

SEQ ID NO: 18076 - DNA, 209 bp, Homo sapiens
  misc_feature 99,184: n=a, g, c or t
atttccggttccggtgtcagttcgaggcgccgcgccgccgccgcagccgccggagccgcaatgcctaaaggaggaagaaagggaggccacaaaggccgngcgaggcagtatacaagccctgaggagatcgacgcgcmgtgtsaggctgagaagcagaaggccagggaagaasbaggagcaaaanaaaaaaaaaaaaagyttatggatac

SEQ ID NO: 18077 - DNA, 304 bp, Homo sapiens
  misc_feature 209: n=a, g, c or t
aatgtagctttttttttcactttagcaacatgttggccaaaatgttgaaatactgcctagtagagacatcctttcaatgacgatgaagtgtaattttatttagtgatttagacatgtgacttacgaatttattttattttatttttttatttttttattttttggaacagagtttcgctcttgttgctgaggcaggagaatggcgtganccgggaggcggasttgcagtgagccgaggtcgtgccactgcactccggcctgggcggcatagcgagactccgtctcaaaaaaaaagaaatgtttt

SEQ ID NO: 18078 - DNA, 483 bp, Homo sapiens
aaaaatactatggatgtagcaataccaagaaggrtgttgcttcagaatgtctcctatgcacccaagaatcccaagttgcagatgaagcatcatatcattaaatattgggcttaagaagcctacaaatatccagaaaattctgtatgaatatagatcaagtgaacccttaaggaaatatttattctaaagggtcactttgaagaaatatccaatctatctgagtattcctaaactgagaaaagtagtttaactatatagaaatgtcaattgtagcaaaaactctataatttcaaaggggtatctatctccctattctttctggacatacagccagactacatttctcagccgtccttgcaattaggcatcgccatgtgctgaatttcagccaatgaaaggagagaagaacgtaataggagttacttctgaaaccgtgccccaaagagttaaagaaaccagtaactaacagaaattcttgagttt

SEQ ID NO: 18079 - DNA, 88 bp, Homo sapiens
cctcccggcgcagtcaccggcgcggtctatggctgcgacttctctaatgtctgctttggctgcccggctgctgcagcccgcgcacagc

SEQ ID NO: 18080 - DNA, 458 bp, Homo sapiens
ttcatgttttttctttcctttcctttagtatatagagaatagcatattcaatagaatgtatagctatctccataaagattaatgktatgttgaaatatatataactttaagggtgaaggatttttatcccatagaattatgatagtctttatctttctgtcaatccctttagaatatagttgttgcaacattttgcttctttttatctatttcccaattgagaatgtttctttatcatgttagaatcaagattttaaaaaaggccaggcgcagtggctcacgcctgtaatcgcagcactttgggaggccaaggcgggcggatcacgaggtcaggagatcggagccatcctggctaacatggtgaaacttgtctctactgaaaatacaaaatattagccgggcacggtgggcgcctgtagtccagctactcgggaggctgaggcaggagaatggcgtga

SEQ ID NO: 18081 - DNA, 512 bp, Homo sapiens
aaaatacccttggtaataaaaggcagtcaaggcaattcaccataaggaaagagtgtacaagatgttgcctcaagacctgaaaatgaatgagcatcatcccttaaagtgttaacacggaagcattaataaaccaagaacaatgagataaatcctgtttgcacatcatttccactgcgtcactcttccttgtctacattctgaagaaatcgcactgaaaacatgtctaaatattcatactctttttgagcttaaatttcagtggccaatttcatactatattggaaagttctgtctaataagagcctgacctgtgtatcctgtatagattttcgccagcaaagggtattgtcctgagtgccagcattttgggggatggtgaactgtatcagctgaggagctatagtctatcagttaggagcattattcctttgtcttggatatacttatgttcaaaagcaatttcttctccctcaagaactcattaaatgtattcaccraaaaaaaaaaaaaaa

SEQ ID NO: 18082 - DNA, 217 bp, Homo sapiens
  misc_feature 149: n=a, g, c or t
aattcctcggctcctggcgggagtgccggtggcgccccgcagtccgcttgtccgtccttccctctctgactctcctaccccgggcctgtctctgcagaggtcaggggaggcgggggcccagcacacgtccccagtggcagcgggagcgncagctacgggttcgcggavmcccgaccccccaagggctagaggagcgctcggcggaccaaagaaagcc

SEQ ID NO: 18083 - DNA, 475 bp, Homo sapiens
tcttccggttgctaacggttcccaaacagcccccgaaaacgctacgtgagctgggccctgggcagaggagaaaacggacggaagaaaaggtctggccggctggagcgcattggtgcggtctcgggctcactgcaaccttcaccttccaggctcaagtgatcctcccacctcggcctcctgtgcagctgaactataggaatccctcagactgggttctccccctcttattctcctaaaggaaaagaagaatgatcatcaaaggcaaatggcagttgctatgcagcaacaccaagaactggcttcacgctccagagaaaatgctgtgcctcctcctggtggtttccggtgctccacatgttcaaagaaattacccggaaatgtagaaatgatccctgaaagtatagtcttccagtaatgtttcttttagcaaaaggatccaatctaagatctcatgtgttttagttttcttcaatgt

SEQ ID NO: 18084 - DNA, 114 bp, Homo sapiens
agcgamdttcctcagagtggaggcgggattcttaggggagagctcctcagcaattggttacatttgacggctttagtccagggacccagacgctactggataaggggtgaaatt

SEQ ID NO: 18085 - DNA, 220 bp, Homo sapiens
atgtctcccagaggaggcggagtcgaaacgtcatcttacggggcagaaaaatgtgaaaagagagactggcctagcctcccagcctacatctttctcccatcctggatgtttcctgcctttgaatgttggactccaagttcttcagttttggaactcggactgtctctccttgctcctcagcctgcagacggcctattgtgggaccttgtgattatcgata

SEQ ID NO: 18086 - DNA, 456 bp, Homo sapiens
  misc_feature 421: n=a, g, c or t
acttccggttgctaacggttcccaaacagcccccgaaaacgctacgtgagctgggccctgggcagaggcagaaaacggacggaagaaaaggtctggccggagatgggtctcactctgtcacccagactggagtgcagtgagtggtgcgatcatagcttactgcagcctgaaactcctgggctcaagtgatcttctcgcctcagcctcctgagtagctggagctacaggtgtgagctacccagcatggctcatttgagatttctgagtagagaagtaacatgattaaacttgggtattgagattattattttggctgctatgttaacagtagacttgaatgtgaaggggttgggcaagggcagaagcagggagacaggttggaaagttggagtgggaagggcctttttaagaataacacaancccctaaagacataaaactgaaaaggccatggagg

SEQ ID NO: 18087 - DNA, 335 bp, Homo sapiens
tttttgtttttmagctsacttsaagggtacctgaagcgaattggcaccaaagcagsagctgtattgccgcagttctagcttsaccttcmacgatgtttcccttggtsaaaagcgcactaaatsgtctcmaagttsgaagcattcagcaaacaatggcaaggcagagcaccagaaacgtacacctgattttcatgacaaatacggtaatgctgtattagctagtggagccactttctbtattgttacatggacatatgtagcaacacaagtcggaatagaatggaacctgtcccctgttggcagagttaccccaaaggaatggaggaatcagtaat

SEQ ID NO: 18088 - DNA, 407 bp, Homo sapiens
taattattcatattctcactattccacaaatgtctgtgattaacagattcattgtcaactttagttctcattctgcacatatgtaagttatgtttgtatctaatgtgaaattgtaatacagtcatccctcaatatgtttagggaattggttccaggacccccatgggtaccaaaatctgtgaatgctcagctctctgatatgtagaatggtgtagtatttgcatgtaacctatgcacatcctcctgtatactttaaataatctctagatttcttataatacttaatacaatgtaaatagttgttttattgggccaggcacggtggctcacacctgtaatcccagcactttgggaaatcaaggcaggaggattgcttaaacccaggrgttagagaccagactggacaa

SEQ ID NO: 18089 - DNA, 259 bp, Homo sapiens
caccttgttatctaggatggtttcaatctcctgatctcgtgatccgcccacctcagcctcgcaaagtgctgggattacaggcgtgasactgggcccagcccaattgcttactttaaaagtgtagagtggcatcaaatcagtaacctaatttactacctcaagaacctagaaaaaggagagcaaaatcagccaaagcaagcaaaagaagggaataataaagagcagaaattaatagaattaaaaataggaaaacaaaaaa

SEQ ID NO: 18090 - DNA, 87 bp, Homo sapiens
aatttcagcagcgggagaagatggacaagagaaagctcgggcgacggccatcttcatccgaaatcatcacaaaaaaaaaaaaaaaaa

SEQ ID NO: 18091 - DNA, 320 bp, Homo sapiens
acttccggttgctaacggttcccaaacagcccccgaaaacgctacgtgagctgggccctgggcagaggcagaaaacggacggaagaaaaggtctggccggagatgggtctcactctgtcacccagactggagtgcagtgagtggtgcgatcatagctcactgcagcctgaaactcctgggctcaagtgatcttctcgcctcggcctcctgagtagctggagctacaggtgtgagctacccagcatggctcatttgagatttctgagtagagaagtaacatgattaaacttgggtattgagatcaaaaaaaaaaaaaaaaa

SEQ ID NO: 18092 - DNA, 480 bp, Homo sapiens
aatttcctttggtctaaagtccaatttaagtccaacgtttctattgatgttctctcttggtgatctgtctagtgctgtgagtagggtgttacagtcccctactattattgtattggcgtcaaattctttctttcggtctggtaggatttgttttaggtgttccaaagttgggtacatatatatttagaattgttatattctcttgctgacaattgttatatcttcttgctctcaaatgatctctttatcattatataatgaacttctttgtcttttattacctttttgtatttaagtatattttatctgatatacatatatctacatctcttggttttgtttctgtttgtgtggaatatctttttccacccctctgcattcaatgtatatgtctttacaggtgaatttcttataggcagcatatagttgaataatgtttttaatcaattctgccaatctgcattttttaagtgggggatt

SEQ ID NO: 18093 - DNA, 426 bp, Homo sapiens
ttgtttgttactacagaatagagatgactgttttttgccacagccctatggaatttgcaatctgtgattgccttgtaaaaaggagagtgcatatggcactgcattaaacgtgtggtgtttctagtcaatgatattggtgagcacaatgtattcatttaatggcatagaccataccagacctaatttgcaagtattgggtcttaaacttcaagtgcaatgtatatgaaaaccaatctgagccttgtatctcttaaatatttattttttttaacgtgtgagatgttcgagagaaggttctccattcatttcagtgctgcctggaggaaactcggcaatgatttctttcagttgtgaagttcctttcgtgttacaccctccactgaaccctcaaccttcgaaatactccagttttgtgggtttggtcaa

SEQ ID NO: 18094 - DNA, 473 bp, Homo sapiens
gacaagcgtggccgcattagctctttctgcctcccacgcagccttatttttttttattgttgttttcttgttgctgttgttgttgttctcggagacggagtcttgctcttgctctgtcgtcgcccacgatagagtacagtggcgtgatctctgctcactgcaacctccgcctcctgggttcaaacaattctgcctcagcctccggagtagctgggattacaggcgcgcgcctgtaatcccagcactttgggaggccgagatgggtggatcacctggggtcaggagttcgagatcagcctggccaacatggtgaagtcccgtctctactgaaaatacagaaattagctgggcgtggtggcgcgtgcacctgtagtcccggctactcgggaggctgaggcaggagaatcgcttgaacccgggargccaaggttgcagtgaaccaagatcgtgccactgcacttccagcctggcaa

SEQ ID NO: 18095 - DNA, 448 bp, Homo sapiens
actaagcggccttggatacctggccgcgggatgctgggcggcgtcaggtgagcggtggtcgctgggcctcaggtaaccaaggagaaagagctgcggasaccattcttttcaatgcctacaaaaaggagatatttaccaccaacaatggctacaaatccatgcagaaaaaacttcggagtaattggaagattcagagcttaaaagatgaaatcacatctgagaagttaaatggagtaaaactgtggattacagctgggccaagggaaaaatttactgcagctgagtttgaaatcctgaagaaatatcttgacactggtggagatgtctttgtgatgctaggagaaggtggagaatccagatttgacaccaatattaactttttactagaagaatatggaatcatggttaataatgatgctgtggttagaaatgtatatcacaaatattt

SEQ ID NO: 18096 - DNA, 193 bp, Homo sapiens
tacagaaaaagttggttccgtcccctcctccctcagacccagcggtccaatgccacctagactctccctgtacacagtgcccccttgtggcacgttgacccaaccttaccagttggtttttcattttttgtccctttcccctagatccagaaataaagtctaagagaagcgcaaaaaaaaaaaaaaaaaagct

SEQ ID NO: 18097 - DNA, 189 bp, Homo sapiens
aggggtgcaaagagtgtgggctgggagatcagctggtctgagttcaagctccaacaactgtttttcttagaaagaaaaaggagcaaatggagaaggaattattaagcagtatatttgacattgtctttttatataaatgttccactgaatttataataaatccatggagtgagcgaaaaaaaaaaaaaa

SEQ ID NO: 18098 - DNA, 411 bp, Homo sapiens
agtagtgagtcctacctgcgtagttctcaacccacctgccgaggactccacataattctgtttcgtctgaaccaaattacttgttccacatatgcacagagggtggtgctccagaaacttctcccagcttaatttgtactcacaggagatcaaaaaggagcaattttccagattattcaaagtatcaggatgggcatgtgaagtgactgaccttaagatgtttccattctcctgtgaattttaacttgaactcattcctgatgtttgataccctggttgaaaacaattcagtaaagcatcctgcctcagaatgactttcctatcatgcttcatgtgtcattccaaggtttcttcatgagtcattccaagttttctagtccataccacagtgccttgcaaaaaacacsacat

SEQ ID NO: 18099 - DNA, 103 bp, Homo sapiens
gcacccctggacaccagaccggactgttcccgacccggagacgcggggccacagccccagctgaccctaatttattctcagcaccacyccctcccaggtcatt

SEQ ID NO: 18100 - DNA, 312 bp, Homo sapiens
ttacaccatttgttcttgctcttgtagttatgcaatttaattaaatattatattgggaggctaaggagggcggataactaggtcaagagatcgagaccatcctggctaacatggtgaaaccggtctctactgaaaatacaaaaaaattagcagggcgtggtggcgggcgcctgtactcccagctacttgggaggctgaggcaggagaatgaggtgaacctgagaggcggasttgcagtgagtagagatggcaccactgcactccagcctgggcaacagagcgagactccatcccaaaaaaaaaaaaaaaaag

SEQ ID NO: 18101 - DNA, 441 bp, Homo sapiens
aaaacagcccccgaaaacgctacgtgagctgggccctgggcagaggcagaaaacggacggaagaaaaggtctggccggagatgggtctcactctgtcacccagactggagtgcagtgagtggtgcgatcatagcttactgcagcctgaaactcctgggctcaagtgatcttctcgcctcagccwcctgagtagctggagctacaggcctctgacaatatgatactaagccatcatagcccctgtgaccgccacgtatacatccagwtgacctggagcaactgaagaaccacaaaagatggcattccaccattgagatttgttcctgccccaccccaactaatcaatcgaccttgtgacattscccctgcccccggacagtgagtctcatgatctccccacccagcaccttggcaccttgtgacccccgcccctgcccacaa

SEQ ID NO: 18102 - DNA, 63 bp, Homo sapiens
tctagccccgccaccttccggaccagacacctccccgctgctggctccagcccttccccgcgt

SEQ ID NO: 18103 - DNA, 396 bp, Homo sapiens
agttgcaccacgagcgctgcggacactcggggcggcagtcggtctgtcagtcctcccgccaggtttacgtggggcttatcaagtatttactaargcaacktycwagaagcttggaaagggctacaagccatggtccctgagcccaagacacttacaggtttgctttctgggaggattrgggtggattagagactgccttccagtcagtgaccacaggatgggccatcttggtctctgtccgtatctggtttgggggttttcgcaggactaggcctaggctaaggacagggagggcacaagttctggctgggtacgaatgcaaccccatggcctacgtcatggagaaggctgggggaatggccaccactgggaaggaggccgtgttagacgtcattc

SEQ ID NO: 18104 - DNA, 64 bp, Homo sapiens
aaatttgacacctccgggcttggaakcagctctctcctccttccccgctgsttataaacctcar

SEQ ID NO: 18105 - DNA, 458 bp, Homo sapiens
  misc_feature 250,254: n=a, g, c or t
atcgaccacggaaatttgacacctccgggcttggragcagctctctcctccttccccgctgcttataaacctcagccctgatgctccagctcactctaccccatctccttgccgggtcagccctgacaaaggtcagctagccccttgaggacatcagctttggcctcagggtcctaatggcagcagaascrctgacagagctagaggagtccattgagaacgtggtcaccaccttcttcacctttgcaangcangagtggccggaatgatagcctcagcgtcaacgagttcaaagagctggttacccagcagttgccccatctgctcaaggatgtgggctctcttgatgagaagatgaagagcttggatgtgaatcaggactcggagctcaagttcaatgagtactggagattgattggggagctggccaaggaaatcakgaagaagaaagaccttaa

SEQ ID NO: 18106 - DNA, 459 bp, Homo sapiens
tttttttaaagaatgtccaaaccagagcgagtggctttccaattactctccctgaactaggccttcctactcctccgacccccaactcaccattgatcgcgatcctggcccttcccaagtcaacagattcattctcatagaagggcatcagaggaagataaagaaggatcctcaatgtcagacatctgagcccaagctaagccatcataatccctgtgacgtgcacatatacatgccccactccaactaatcaatcgaccttgtgacattcctcccctggacaatgaatctcatgatctcccaaccctgcaccttgtgacccctcccctgcccacaamgagataaccacctttaagtgtaattttccactasctacccaaatcctataaagctgcsccaaccctatstccctttgstgactctttgtggactcagcccacttgcacccaagtgaaataa

SEQ ID NO: 18107 - DNA, 620 bp, Homo sapiens
atcatgacactgaaaagtgcttctattgatcaagaatgggattgaagattactaaaattgaaataatatcaaatggttatgaacttctgaatctacccaactaaaccctcctactctcttaaagaaaatagtggatggctacatatttggatgcacaagtcaaccaaccacagtatcaatgtttgatttactctcccactatgatcacccatcttcatagcctcatggtcactgctccaaatctagacttgtggtttggctgcatctcaagacttgaaccataaatgtcaatataaatgcacattttctagaaggatgacaaaattcaaaacattctattttcaggaaaataatgtgcaaacatatcattataatatccttttatctacaatttataaaactctggtcaaaatgtttgtctaaaaaaattcctggcaggatgctgatatgagcctccaggctctctcatctttaacataggcaattcatcaggctacacacaaaagcacccaaaagtctgcaatggttctctttaaataaaggcttgaagcacgcaggggccttttgtagaaagagaaatagaggagatcccaaggtcggggtgctgtacacagaagaag

SEQ ID NO: 18108 - DNA, 825 bp, Homo sapiens
gagaggatcaacaatctccccttattctaaaaaagcatattggaatggtatggcaaaccttgcctcgctgcttctgcatctggtttgtgtgcttctaggaagtgctttttttgtcaggacctggtctgatttacccttgggaagtttgatcttgtgggaaacctcaagatgctgagctgatatgcatttcctatgctttttataggatcagattggtatcatgcaaggtgttttaaaaattaggaaattatactatttattttgcttatgcaaccttgtataagggataaatggaactcagaattttggttattgaagaatgagcctcactccacttactaaatgtaagactgagtaaggaagacttaaaaagtgagtgaaattgctgtgaaaaatagagatctggaaaaaaaaatagaagttactgaagagcttacacacttaatttgatcacactgccttttctcagtggaaaaaaatgaattaagtaatccttatttgatcatttttcggtgtttcgaatggagctttagaaagtaatagtttaggccgggcgcagtggctcactttgtaatcccaatactttgggaggccaaggcgggtggatcatgaggtcaggagatcgagaccaccctggctaacacggtggggccccatctttactaaaaatacaaaaaactagccagttgtgtgcctgtggtcccagctgcttgggaggctgaggcaggagaatgccatgaacttgggaggtggagcttgcagtgagtcaagatcgcgccattgtgctccagcctggccgacagagcgagactccatctcaaaaaa

SEQ ID NO: 18109 - DNA, 96 bp, Homo sapiens
gtttgttactttcacactgttttctggtctacagcaaattgtatctactatcattccgttgtattaagaatgggtctcactttgttgctccaggat

SEQ ID NO: 18110 - DNA, 553 bp, Homo sapiens
acactgttttctggtctacagcaaattgtatctactatcattccgttgtattaagaatggtaaattattcttcctcctttccctctttccctaatcaaacacttaagtctgtaaacatcttcatgaagttccttctgtgagttttaactggagattaaacctgaagaaggggattagaatgatctcaggaagtctttcagtggaaggttgattcaaactccgaactttctgtctgcttcccttcattgtgggccaccgtcgataaaataagaaacatgtgccctagttaaatgtgaatgcctcagtgtaacagcgaaccccctgctgctggacagccctaaactgtttaagcctgtgtgtcccttgatttcatgggagactctgcgagacacaatcctgctgatggccaaaccacagcgacagtctctccaacaaggtagacgttggatttatggtcagaacagtgctcttgggggccattaaagtggcaaggtaccagttttggctcttcacttttaagtcagtacaaattatggatgatcccatctatgat

SEQ ID NO: 18111 - DNA, 482 bp, Homo sapiens
tagcattcatttaatcttcatataaagcatataaaatactatccccattttaccgatgagaaaattgaaatttagaatgttgagtaatttcccaagctattaatctgggattcaaaccagatttatctgatttccaagtccagatattcatttattcattcaacaattattcagtactacctatgtgccagatgctgttccaggcccaaatggccatggttataaactaatcagacaaaataatgccctcatgaaacttatagtctagtggaaaaggtagataataatgaagtaaattaattatacatatatttaaatatactgtataataatgtatgaattttacacatatatcatgttaaataatgaaaagtactggccgggcgcgatastcacgcctaatataccagcactttgggaggctgaggcgggtggatcgcctgaggtcaggagttcaagaccagcctggccaacatggtgaa

SEQ ID NO: 18112 - DNA, 424 bp, Homo sapiens
attttgttcgcgcggaasgscggtagggtgggaaccaagcgggagagccgcgggatttgcggccgccgccatgccgtcgtccccgctgcgggtggcggtggtgtgctcgagcaaccagaaccggagcatggaggcgcacaacatcctcagcaaacggggattcagcgtccgatcctttggaacagggactcacgtgaagcttccaggaccagctcccgacaagcccaatgtttatgatttcaaaaccacatatgaccagatgtacaatgatcttcttaggaaagacaaagaactgtatcccagcggttgccctttaaaaaccccccgtgtggtcctccctggaagtgttacgtgtggctcgggcacaggaggcgtgtcaccctgtgcagtgcacacactggctcctctgtctttgcaaaaaaaa

SEQ ID NO: 18113 - DNA, 507 bp, Homo sapiens
  misc_feature 452: n=a, g, c or t
atctcggagttcttcccatgtgcaaggcagggtgctgagcctgtgatgcgtatgtatgaagccgtgtcatgctcaccactcccctattgagcagtgtgcgatccccaacctctgatgttacacggaaccagctacccaacgagttgttttttacatttcccttttggtgttctatttatctggccttaaacaggcctggctgagaatatttaaaatcagagaacgcacggctggacacaaggcaaaccgtattccacacgcgcatttgcttaggagcagagttcagcaacgtgacgctgcctcccaagggcttgggttgttcccccatcctctctccacgactccgtcccaccttcccagtacttaaaagacgacggcagtaaccaacaatgaatgccccagctcaggagagcagctttgtgaccgcaagccacggcttccaggagcctgangagggaaggtcagccctgaggagggaacagcacaagccaggctcgcgtgttgaca

SEQ ID NO: 18114 - DNA, 374 bp, Homo sapiens
aaaaaaaaagtcctagctagggtcccaagtgacagccagcatcaactataacatgtaaaggagccagtcttcagatgattccagcctcagccttcaggccactcagctggtgccaaatagagtagggatgagctgtccccacagagacctgcccagtgcacattgtgagaaagccccagaatgttgacagtcgctctcctagcccttctctgtgcctcagcctctggcaatgccattcaggccaggtcttcctcctatagtggagagtaaggaagtggtggtggaaagcgattctctcattctggcaaccagttggacggscccatcaccgccctscggtccgagtcaacacatactacatcgtaggtcttcar

SEQ ID NO: 18115 - DNA, 497 bp, Homo sapiens
aaacaaaataaaaattagcttccaggcagcctgtttttaaagaaatgggactaatgggagaagctgtttgtcactctaagagcatccaagccctggcccgtctgtgcactcttggctcctggggagatatatctgccttctaagaaggcaggccaggtcttgggcacagacctgcatttgttgaccttgcactccaactatagtgccttgcaagtgctcaacagtacatattggaatgaagtccctatgagagccatttctggccatgttctatacctcaaagtgaggctggcaggtacagagatgaactgtacacatgtgatacatttaagccactggaaaaacccctgtgcttgaaaatatttcctctatatcatgcctggagttccatcatagcccttcatttccttggctttagcatttaccttctcttaagaataccagctttcccctttccctgagaggwagagcacatgttggtctcctcttagtgtgaa

SEQ ID NO: 18116 - DNA, 467 bp, Homo sapiens
ccattggagaaatggctggtagttactcttttttccccccacccccttaatcagactttaaaagtgcttaaccccttaaacttgttattttttacttgaagcattttgggatggtcttaacagggaagagagagggtgggggagaaaatgtttttttctaagattttccacagatgctatagtactattgacaaactgggttagagaaggagtgtaccgctgtgctgttggcacgaacaccttcagggactggagctgcttttatccttggaagagtattcccagttgaagctgaaaagtacagcacagtgcagctttggttcatattcagtcatctcaggagaacttcagaagagcttgagtaggccaaatgttgaagttaagttttccaataatgtgacttcttaaaagtttttattaaaggggaggggcaaatattggcaattagttggcagtggcctgttacg

SEQ ID NO: 18117 - DNA, 226 bp, Homo sapiens
caggataatcagaccaccacaggtttacagtttatagaaactagagcagttctcacgttgaggtctgtggaagagatgtccattggagaaatggctggtagttactcttttttccccccacccccttaatcagactttaaaagtgcttaaccccttgaaacataatgtgatcatgctctaacttcaatataccaataaaataatcagcttgcaaaaaaaaaaaaar

SEQ ID NO: 18118 - DNA, 394 bp, Homo sapiens
  misc_feature 169: n=a, g, c or t
aacatttcaaatggcatgtttctgggctttgggatgtgggaagctggtgagaaggcacactctctccacagttagatttgggaggaggcctgacttgggagagggatccaggctcacaccgccctgtcctgtgtcctgactgcagacagaggaactgaaccgcgagtgnccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagc

SEQ ID NO: 18119 - DNA, 509 bp, Homo sapiens
acattgctcagaaaarccccttgtgcccctttctgccatccgcgctgtctcgtgtctccctttttccattaaatgcctcttttcttgcgggtctcatgtcgggaatagtgcactacggggacatacctatccccaactatcctaggcccgagaaccagcccttgccttcgcgtaacaggcggagactcgctgaggcgagttgcacttctaattgggcgtgaggtcttgtcaatccccaagttcttccaatcagaagtccggtccatccagccttccgctccccattggcctgtgtggaggaagaggggtgggtaagccgaagtcgctgcgctcagtgcgcaggcgcgaagaagctggcaggggcacgagccgggggcgggtttgaagacgcgtcgttgggttttggaggccgtgaaacagccgtttgagtttggctgcgggtggagaacgtttgtcaggggcccggccaagaaggagsccgcctgttacgatggtgtcatgagtttcaa

SEQ ID NO: 18120 - DNA, 403 bp, Homo sapiens
accccactctcacgcacgcccccaccctgcactgatgactattgggaacaccctggccactgccaatggaatgatcgagctctactggatgcctttgcatttcaaaagagaatcatgttgattcttcatgagcagtgtcagatgagtcacctgcaccattgacacaatgaagggaacatctctgcatgagactagccatctacattgcttttcaatctcacccaaaagacggttcaaagataagtgttagagaccatggctttggagttcaaatgctctggattcggacatatgttctgtcatgacaattctgtgcaagttttggcaagtaacctttcacctctgtcaacctctgtttccacctatgtaaaatgagaaaaataaaagtattaacctcacaaaa

SEQ ID NO: 18121 - DNA, 493 bp, Homo sapiens
agcaactggcccaggtgccgttccctgctgtgaaggtttgttctttctgtcttcacaataaatcttgctgctgctcactttttgggtctgtgccacctttaagagcctgtaacattcaccctgaaggtcggtggcttcattcttgaagtcagtgagaccaggaacccaccggcaggaaccaactccggacacagcgccactgcactccagcatgggcgacagagcaagactcagtaaataaataaaacaaaaaaagcatgcacgcacaaagcaacaaaaacgtttcaaagaacatcttgaaatcagccgggaaggagaaaaacacaccaaacgatgatataattgatgatgatcttctgataacaaaaaacaggctctaaaacaagggaatgggatccgtaagatttaagagtgagagagagaataaaacttctgaaaacatttctgttttataccaacgaaaataccattttaaaatgagggtcaagtaatg

SEQ ID NO: 18122 - DNA, 62 bp, Homo sapiens
ctcgcgtggtcgctgggtctgcgtcttcccgagccagtgtgctgagctctccgcgtaaccac

SEQ ID NO: 18123 - DNA, 366 bp, Homo sapiens
agtgacggatgttgagaaatggaggagccaatcactattgtagccccagactaacgcatagctagccaactgtcaggcatgtaagtgaggccatctttaaccagaaaacatgctttaaactgccacagaatgaagcctgccttgtttaatgtgttgtgtgaaatcaaagaaaaaacaggtatttcgaaaaaagcctggttttggtacagctcttccagaacccacgggaagaacctgttcatcagctcatccatccgtctgctgagtaaatgcttattgagcatctgctgaatgccagcactgttctttgttcttggaatacatcagtaaacaaaataagaaaaacaaaaccaaaaaaaaaaaaaa

SEQ ID NO: 18124 - DNA, 69 bp, Homo sapiens
ttttactcagggcacagagggtctctgcggccgtagcggcggggctgcggtascactttagatttgggc

SEQ ID NO: 18125 - DNA, 372 bp, Homo sapiens
tactgtgacagatggggaggagccccactgcatctggagtgggtcttggctggccatgtgaactaattaataccccagaaatcaggatacatgccgggcgtcggggcttacgcctgtaatcccagcattttgggaggctggggtgggtgggtcccttgaggtcgggagtttgagaccagcctgaccaacatggtgaagccccatctctactagaaatatacaaaattggcctgtggttccagctacttgggaggctgaggaaggagaattgcttgagcccaggaggtggaggttgcagtgggctgagatcgcaccactgcacttcagcctgggcaacgagagcaaaactccatctcaaaaaaaaaaaaaaaa

SEQ ID NO: 18126 - DNA, 412 bp, Homo sapiens
acacagcccacagagttccacctgctcacaggttggctggctcagcaaggtggtgccctgctctgagcattcaggccaagcccatcctgcaccatggccaggtacagatgctgtcgcagccagagccggagcagatattaccgccagagacaaagaagtcgcagmgaaggaggcggastgccagacacggaggagagccatgaggtgctgccgccccaggtacagaccgagatgtagaagacactaattgcacaaaatagcacatccaccaaactcctgcctgagaatgttaccagacttcaagatcctcttgccacatcttgaaaatgccaccatccaataaaaatcaggagcctgctaaggaacaatgccgcctgtcaataaatgttgaaaagtcraaaaaaaaaaaaaa

SEQ ID NO: 18127 - DNA, 488 bp, Homo sapiens
atattattgcaagcctttgcacatctctttgtatcatccccctatgacatcatgtgttaatctcatctcaggactgcaacccaagattgcagtgagtgggaagatacaatttttacagcatcaccaaaaaggataaggttatttggtacgaaaacagcctgagaagatagataacacatacacaagatggacagatgttgaaagttgctgtgttctaataagactgtcaataaaaacaagtaatgcaaacacattttgagtttctcagctgagccaaaggaaatcaagaaatctcctggaatcaaggaaatcaaggaatcaattacttacaccaagctactcaagaggcagaggcaggaggatcacttgagcccaggaggcggaggttgccgtgagccaagatcccaccactgcactccagcctgggcgacagagacccccatgtcaaataataataataataaataaatccttctcagtccctccaa

SEQ ID NO: 18128 - DNA, 449 bp, Homo sapiens
atattattgcaagcctttgcacatctctttgtatcatccccctatgacatcatgtgttaatctcatctcaggactgcaacccaagattgcagtgagtgggaagatacaatttttacagcatcaccaaaaaggataaggttatttggcaaacacattttgagtttctcagctgagccaaaggaaatcaagaaatctcctggaatcaaggaaatcaaggaatcaattacttacaccaagctgagcaagagacaacatgaaggcagaggtagcagtaatcagacaggatttccaagggtctcactctgtggcacaatgatcatggttcactgcagcctcggccttctgagctcaagtgatcctcccgcctctgcctccgcctcctgagtagctgggactacagatgtgcgacacagcacctggcaaatttttaagtattttcttcagactga

SEQ ID NO: 18129 - DNA, 486 bp, Homo sapiens
aacccacttgggtcccattccatgctgkggaaggtttgttcttttgcacttcacaataaatcttgctgctgctcgctctttgggtccgcaccacctttatgagctatatcactcactgtgaaggtctgcggcttcactcctgaagtcagcaagaccacgaacccaccaggaggaacaaacaactctggacgcgccacctttaagagctgtagcaaccactgcgaaggtttgtgtcttcactcctgaagtcacgccagaccacaaacccactggaaggaagaaactccagacacatctggacatctgaaggaacagactcaggaaacaatctttaagaactgtaacactcaccgccaggttcatggctccattcttgaagtcagccagaccaagaagccaccagaaggaaccaattccggacacgggagcacagatgtaccctgaatatatgccttcgttacagaagctttttgaggtactggacac

SEQ ID NO: 18130 - DNA, 192 bp, Homo sapiens
aagtgagaccaacgttgtgaggtattaactcggaaccgtcatctatccttgtggagaaaaacccggagacttggattaggacccaatagtctaccttggcggcaggcctggatcttgaggaggaaggcacttctgaaatagctgcaactcccgtcccatggtgaccaagagaatttctccagaggctacctc

SEQ ID NO: 18131 - DNA, 314 bp, Homo sapiens
acttcactgacccctccagtaactgtttgtccaggcagttacaggatgcagttaacatgtccgttcacctcgcataacaaagctaacaaaaaacatctccaagatgcggtcaagacatctgtacccccgacttagctcccctaccctgactcagccctcctgcacacccaactcagcttccccatcctgacctcattccttgccctataaagccctgcagtagtctgtaagcggggctgcctcctctgcgtttgtcaggaggtagcctgacgggactgacaataaatcagcttgcctgaaaaaaaaaaaaaaaa

SEQ ID NO: 18132 - DNA, 519 bp, Homo sapiens
aaatagtctccatcggccattttgtgcgagaagccgcagcgccgcctcttctctcgcgccctcgcctcttcctccgcctcctccttcgcctcttcctgcctcctcccggcttccgccgccgccactccagcctaatcccaaccccagggcgaacggttttcttatttatttccgttttctcgccactacagcctcctgacaaggtgatccgggcgggccccgcaggaattttatcccctcaccggcctcacactagtatcgcatgtccactatccagaacctccaatctttcgacccctttgctgatgcaactaagggtgacgacttactcccggcaggactgaggattacattcatataagaatccagcaacggaacggcagaaagacactgactactgttcagggcattgcagatgattatgacaaaaagaaacttgtgaaagctttcaaaaagaaatttgcctgtaatggtactgtgattgaacatcctgaatacggagaggttattcagcttcaa

SEQ ID NO: 18133 - DNA, 394 bp, Homo sapiens
cacagcattttagaacttctcatttgattaagaatcaaatatatacatggggattgtatattttctttcttttttttttctggagacagattgtsgcccagcctggagttcagtggtgtgatcccagctcactgcaacctctgcttcctgggtccaagtgattctcaacctctcaagtagctgggactacaggtgcgcaccaccacgcccggctaattttttgtatttttagtagagatggggtttcgccacgttgcccatgctggtctcgaactcctgagctcagacaatccaccgcctcggcttcccaaagtgctaggattacaggcgtgasastgcacccggcctgtatgttttcactaaatgggctgactgcatgatagccagggacatg

SEQ ID NO: 18134 - DNA, 68 bp, Homo sapiens
agtcgggggttcccggggagccatttttacttggctgtctcaccacagccagccccatgaagaggaac

SEQ ID NO: 18135 - DNA, 387 bp, Homo sapiens
  misc_feature 380: n=a, g, c or t
aaactcstgggctgcggcattsacgtgatctgcacgggcgcagatgtaggcaccggtccgagtgcctgssctctgtccccgcggctgggtctcgtctgctccggttcstgggstcstaattsttggtcmagcttcttcmaggtctgcgcgtctgttgttccsagcgctctgcgaasctgaaaaggaggagcaacctgtccagaatccccgcagacaggaaaaggaggggaaatctcgacatggaaaaactctacagtgaaaatgaaggaatggcttcaaaccaaggaaagatggaaaatgagaacagcsamaagacgagagaaagccagaagtaacttgtactctggaagacaagaagttagaaaacgagggaaagacanaaaacaa

SEQ ID NO: 18136 - DNA, 446 bp, Homo sapiens
  misc_feature 430: n=a, g, c or t
gattgctactttagtaataaataatagtaacttgtgttttataatgtagcagttaagatcaaaagatgcaacaggaaggtcctcacaagatggctgaacagatgcaggtgctgtgcctctggactgcctagcctccagaactgaggtgttggaagctgtgaatgtggatgaaagtaccaatatagagagaacagagtgagaatagaagacagcccaagaatctaaagtcatgcacttgcaagggagtcagaggaagagagggaaaatggttcattgtttccatcatgtactctatggaatacaaagctctgaaacctgttggctactggaagtgtacaagaaaaaagactctcaagctagaggtggggtagagctggagccagccatgtcaagatctttcgaggacatgaacattttttatgcttattanaaagatgatgtggttt

SEQ ID NO: 18137 - DNA, 445 bp, Homo sapiens
ttcctgcggcgtcggtggcgagctgaggtggaggcaggctgcggcagacggcgacagtggcggcggcgcatggcagggcttgcaggtttggatcgtctatccctttcagggaactggtgtgttggggacggcttctctgccctgcctgacatggtccagtcatcccgtcagccttctggacggcaacaccaaagctgggaccaaaaaaagttccagcttaagtgctaatgccaagtgttagatcttgtttgcttgtttgttttaaatcagagactaattaatgtcaagcaaatctgttaaaagatttgatcacgggaagcctggtcggtttccagtgaccaggtcaattccatatctgaaattagtcttgttagagttgctgccaaaaacagtttaacctttaatctgtaatatgttgtttcaaagaggaaaaaaaaaaaaaaaa

SEQ ID NO: 18138 - DNA, 410 bp, Homo sapiens
aacacttaattttgaatgatagtataggcaataggatattcaataagatttcagaaagaggatacagaatcacacacacacacacggaaaaaaaaaaggaggtggatcagttttgaggatgaatatctcacctttgttattgcacacaatggctccatttatggctcaaatctggcctcctgtctgtgacagagtgcagcacctgaccatcgtaaatactcaataactatcttctgagtgaatgacagaaaagactgctcttcttcccagaatgagaatcaacattccataggaataatatttcagaagctagacatggctttcaagttgtcagtagattttacaatgggccatacaggaacatcaaaatctggataaaacctaaaaaacaaaacattaatatatctggg

SEQ ID NO: 18139 - DNA, 356 bp, Homo sapiens
  misc_feature 9..10: n=a, g, c or t
agtgkkstnnaccgcgcggctggaggtgtgaggatccgaacccaggggtggaggcggctcctgcgatcgaaggggacttgagactcaccggccgcacgccatgagggccctgtggtgctgggcctctgctgcgtcctgctgaccttcgggtcggtcagagctgacgatgaagatgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctgaaaaaaaaaaaa

SEQ ID NO: 18140 - DNA, 72 bp, Homo sapiens
attacaatttccttctatactcagaggtcattactactcagacttttctggttttcgtcattacgcatgaaa

SEQ ID NO: 18141 - DNA, 336 bp, Homo sapiens
  misc_feature 64..65: n=a, g, c or t
agtgggcggaccgcgcggctggaggtgtgaggatccgaacccaggggtggaggcggctcctgcnntcgaaggggacttgagactcaccggccgcacgccatgagggccctgtgggtgctgggcctctgctgcgtcctgctgaccttcgggtcggtcagagctgacgatgaadbvtgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatga

SEQ ID NO: 18142 - DNA, 352 bp, Homo sapiens
agtgggcggaccgcgcggctggaggtgtgaggatccgaacccaggggtggaggcggctcctgcgatcgaaggggacttgagactcaccggccgcacgccatgagggccctgtgggtgctgggcctctgctgcgtcctgctgaccttcgggtcggtcagagctgacgatgaatgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctgaaaaaaaaaa

SEQ ID NO: 18143 - DNA, 375 bp, Homo sapiens
agtgggcggaccgcgcggctggaggtgtgaggatccgaacccaggggtggaggcggctcctgcgatcgaaggggacttgagactcaccggccgcacgccatgagggccctgtgggtgctgggcctctgctgcgtcctgctgaccttcgggtcggtcagagctgacgatgaadwwtgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctgaaaaaaaaaaaaaaaaaaaaaaaaaaaaaa

SEQ ID NO: 18144 - DNA, 352 bp, Homo sapiens
  misc_feature 173: n=a, g, c or t
agtgggcggaccgcgcggctkggaggtgtgaggatccgaacccaggggtggaggcggctcctgcgatcgaaggggacttgagactcaccggccgcacgccatgagggccctgtgggtgctgggcctctgctgcgtcctgctgaccttcgggtcggtcagagctgacgatgaantgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctgaaaaaaaa

SEQ ID NO: 18145 - DNA, 350 bp, Homo sapiens
  misc_feature 172,343: n=a, g, c or t
agtgggcggaccgcgcggctggaggtgtgaggatccgaacccaggggtggaggcggctcctgcgatcgaaggggacttgagactcaccggccgcacgccatgagggccctgtggtgctgggcctctgctgcgtcctgctgaccttcgggtcggtcagagctgacgatgaawntgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctnaaaaaaa

SEQ ID NO: 18146 - DNA, 344 bp, Homo sapiens
  misc_feature 1,173: n=a, g, c or t
nbtgggcggaccgcgcggctggaggtgtgaggatccgaacccaggggtggaggcggctcctgcgatcgaaggggacttgagactcaccggccgcacgccatgagggccctgtggtgctgggcctctgctgcgtcctgctgaccttcgggtcggtcagagctgacgatgaagtngatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctga

SEQ ID NO: 18147 - DNA, 353 bp, Homo sapiens
  misc_feature 84..85,173..174: n=a, g, c or t
agtgggcggaccgcgcggctggaggtgtgaggatccgaacccaggggtggaggcggctcctgcgatcgaaggggacttgagwynnaccggccgcacgccatgagggccctgtgggtgctgggcctctgctgcgtcctgctgaccttcgggtcggtcagagctgacgatgwhbnntgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctgaaaaaaaa

SEQ ID NO: 18148 - DNA, 403 bp, Homo sapiens
  misc_feature 359..360: n=a, g, c or t
acagcccacagagttccacctgctcacaggttggctggctcagccaaggtggtgccctgctctgagcattcaggccaagcccatcctgcaccatggccaggtacagatgctgtcgcagccagagccggagcagatattaccgccagagacaaagaagtcgcagmgaaggaggcggastgccagacacggaggagagccatgaggtgctgccgccccaggtacagaccgagatgtagaagacactaattgcacaaaatagcacatccaccaaactcctgcctgagaatgttaccagacttcaagatcctcttgccacatcttgaaaatgccaccatccaataaaaatcaggagcctghtnnggaacaatgccgcctgtcaataaatgttgaaaagtcatcccaa

SEQ ID NO: 18149 - DNA, 362 bp, Homo sapiens
  misc_feature 58,172: n=a, g, c or t
agtrarmggaccgcgcggctggaggtgtgaggatccgaacccaggggtggaggcggcncctgcgatcgaaggggacttgagactcaccggccgcacgccatgagggccctgtggtgctgggcctctgctgcgtcctgctgaccttcgggtcggtcagagctgacgatgaagnwgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctgaaaaaaaaaaaaaaaaaaa

SEQ ID NO: 18150 - DNA, 343 bp, Homo sapiens
  misc_feature 172: n=a, g, c or t
aktkkgsggaccgcgcggctggaggtgtgaggatccgaacccaggggtggaggcggctcctgcgatcgaaggggacttgagactcaccggccgcacgccatgagggccctgtggtgctgggcctctgctgcgtcctgctgaccttcgggtcggtcagagctgacgatgaagntgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctg

SEQ ID NO: 18151 - DNA, 365 bp, Homo sapiens
  misc_feature 2,172: n=a, g, c or t
antgggcggaccgcgcggctggaggtgtgaggatccgaacccaggggtggaggcggctcctgcgatcgaaggggacttgagactcaccggccgcacgccatgagggccctgtgggtgctgggcctctgctgcgtcctgctgaccttcgggtcggtcagagctgacgatgaantgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctgaaaaaaaaaaaaaaaraaaraa

SEQ ID NO: 18152 - DNA, 406 bp, Homo sapiens
agcccacagagttccacctgctcacaggttggctggctcagccaaggtggtgccctgctctgagcattcaggccaagcccatcctgcaccatggccaggtacagatgctgtcgcagccagagccggagcagatattaccgccagagacaaagaagtcgcagmrataggaggcggastgccagacacggaggagagccatgaggtgctgccgccccaggtacagaccgagatgtagaagacactaattgcacaaaatagcacatccaccaaactcctgcctgagaatgttaccagacttcaagatcctcttgccacatcttgaaaatgccaccatccaataaaaatcaggagcctgctaaggaacaatgccgcctgtcaataaatgttgaaaagtcaaaaaaaaaar

SEQ ID NO: 18153 - DNA, 357 bp, Homo sapiens
  misc_feature 173: n=a, g, c or t
aktddgsggaccgcgcggctggaggtgtgaggatccgaacccaggggtggaggcggctcctgcgatcgaaggggacttgagactcaccggccgcacgccatgagggccctgtgggtgctgggcctctgctgcgtcctgctgaccttcgggtcggtcagagctgacgatgaagngatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctgaaaaaaaaaaaaaa

SEQ ID NO: 18154 - DNA, 340 bp, Homo sapiens
aktgggcggaccgcgcggctggaggtgtgaggatccgaacccaggggtggaggcggctcctgcgatcgaaggggacttgagactcaccggccgcacgccatgagggccctgtggtgctgggcctctgctgcgtcctgctgaccttcgggtcggtcagagctgacgatgaagttgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgacc

SEQ ID NO: 18155 - DNA, 360 bp, Homo sapiens
agtgggcggaccgcgcggctggaggtgtgaggatccgaacccaggggtggaggcggctcctgcgatcgaaggggacttgagactcaccggccgcacgccatgagggccctgtgggtgctgggcctctgctgcgtcctgctgaccttcgggtcggtcagagctgacgatgaabtgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctgaaaaaaaaaaaaaaaaa

SEQ ID NO: 18156 - DNA, 350 bp, Homo sapiens
  misc_feature 176..177: n=a, g, c or t
akttttwmggaccgcgcggctggaggtgtgaggatccgaacccaggggtggaggcggctcctgcgatcgaaggggacttgagactcaccggccgcacgccatgagggccctgtgggtgctgggcctctgctgcgtcctgctgaccttcgggtcggtcagagctgacgatgaaktwnngatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctgaaa

SEQ ID NO: 18157 - DNA, 348 bp, Homo sapiens
agtkkksggaccgcgcggctggaggtgtgaggatccgaacccaggggtggaggcggctcctgcgatcgaaggggacttgagactcaccggccgcacgccatgagggccctgtggtgctgggcctctgctgcgtcctgctgaccttcgggtcggtcagagctgacgatgaabhtgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctgaaaaa

SEQ ID NO: 18158 - DNA, 406 bp, Homo sapiens
  misc_feature 217..220,301..303: n=a, g, c or t
acagcccacagagttccacctgctcacaggttggctggctcagccaaggtggtgccctgctctgagcattcaggccaagcccatcctgcaccatggccaggtacagatgctgtcgcagccagagccggagcagatattaccgccagagacaaagaaagtcgcagacgaaggaggcggastgccagacacggaggagagccatgaggtgswgbmgcmnnnnggtacagaccgagatgtagaagacactaattgcacaaaatagcacatccaccaaactcctgcctgagaatgttaccagacnnnhagatcctcttgccacatcttgaaaatgccaccatccaataaaaatcaggagcctgctaaggaacaatgccgcctgtcaataaatgttgaaaagtcatcccaa

SEQ ID NO: 18159 - DNA, 348 bp, Homo sapiens
  misc_feature 171..172: n=a, g, c or t
agtgggsggaccgcgcggctggaggtgtgaggatccgaacccaggggtggaggcggctcctgcgatcgaaggggacttgagactcaccggccgcacgccatgagggccctgtggtgctgggcctctgctgcgtcctgctgaccttcgggtcggtcagagctgacgatgaanntgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctgaaaaa

SEQ ID NO: 18160 - DNA, 361 bp, Homo sapiens
agtgggcggaccgcgcggctggaggtgtgaggatccgaacccaggggtggaggcggctcctgcgatcgaaggggacttgagactcaccggccgcacgccatgagggccctgtgggtgctgggcctctgctgcgtcctgctgaccttcgggtcggtcagagctwaasgatgaadwttatgtggatggtacagtagaagaggatctgggtaaaagtagagaaggatcaaggacdhgatgatgaagtagtacagagagaggaagaagctattcagttggatggattaaatgcatcacaaataagagaacttagagagaagtcggaaaagttttactatgaatgaccctgaaaaaaaaaaaaaaa

SEQ ID NO: 18161 - DNA, 362 bp, Homo sapiens
  misc_feature 150,171: n=a, g, c or t
agtgggcggaccgcgcggctggaggtgtgaggatccgaacccaggggtggaggcggctcctgcgatcgaaggggacttgagactcaccggccgcacgccatgagggccctgtgggtgctgggcctctgctgcgtcctgctgaccttcggncggtcagagctgacgatgaantgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctgaaaaaraaaaaaaaaaaaaa

SEQ ID NO: 18162 - DNA, 349 bp, Homo sapiens
  misc_feature 2,172: n=a, g, c or t
antgggcggaccgcgcggctggaggtgtgaggatccgaacccaggggtggaggcggctcctgcgatcgaaggggacttgagactcaccggccgcacgccatgagggccctgtgggtgctgggcctctgctgcgtcctgctgaccttcgggtcggtcagagctgacgatgaantgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctgaaaaaa

SEQ ID NO: 18163 - DNA, 348 bp, Homo sapiens
  misc_feature 172: n=a, g, c or t
wbtgggcggaccgcgcggctggaggtgtgaggatccgaacccaggggtggaggcggctcctgcgatcgaaggggacttgagactcaccggccgcacgccatgagggccctgtgggtgctgggcctctgctgcgtcctgctgaccttcgggtcggtcagagctgacgatgaantgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctgaaaaa

SEQ ID NO: 18164 - DNA, 344 bp, Homo sapiens
aktgggcggaccgcgcggctggaggtgtgaggatccgaacccaggggtggaggcggctcctgcgatcgaaggggacttgagactcaccggccgcacgccatgagggccctgtggtgctgggcctctgctgcgtcctgctgaccttcgggtcggtcagagctgacgatgaagwtgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctga

SEQ ID NO: 18165 - DNA, 353 bp, Homo sapiens
agtgggsggaccgcgcggctggaggtgtgaggatccgaacccaggggtggaggcggctcctgcgatcgaaggggacttgagactcaccggccgcacgccatgagggccctgtggtgctgggcctctgctgcgtcctgctgaccttcgggtcggtcagagctgacgatgaagktgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctgaaaaaaaaaa

SEQ ID NO: 18166 - DNA, 354 bp, Homo sapiens
  misc_feature 7,173: n=a, g, c or t
aktrrrnsggaccgcgcggctggaggtgtgaggatccgaacccaggggtggaggcggctcctgcgatcgaaggggacttgagactcaccggccgcacgccatgagggccctgtggtgctgggcctctgctgcgtcctgctgaccttcgggtcggtcagagctgacgatgaadntgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctgaaaaaaaaaa

SEQ ID NO: 18167 - DNA, 347 bp, Homo sapiens
  misc_feature 170: n=a, g, c or t
aaaaaacagcccacagagttccacctgctcacaggttggctggctcagcaaggtggtgccctgctctgagcattcaggccaagcccatcctgcaccatggccaggtacagatgctgtcgcagccagagccggagcagatattaccgccagagacaaagaagtcgcagmgnaggaggcggastgccagacacggaggagagccatgaggtgctgccgccccaggtacagaccgcgatgtagaagacactaattgcacaaaatagcacatccaccaaactcctgcctgagaatgttaccagacttcaagatcctcttgccacatcttgaaaatgccaccatccaataaa

SEQ ID NO: 18168 - DNA, 356 bp, Homo sapiens
agtgggcggaccgcgcggctggaggtgtgaggatccgaacccaggggtggaggcggctcctgcgatcgaaggggacttgagactcaccggccgcacgccatgagggccctgtggtgctgggcctctgctgcgtcctgctgaccttcgggtcggtcagagctgacgwtgaakhtgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctgaaaaaaaaaaaaa

SEQ ID NO: 18169 - DNA, 349 bp, Homo sapiens
aktgggcggaccgcgcggctggaggtgtgaggatccgaacccaggggtggaggcggctcctgcgatcgaaggggacttgagactcaccggccgcacgccatgagggccctgtggtgctgggcctctgctgcgtcctgctgaccttcgggtcggtcagagctgacgatgaadwtgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctgaaaaaa

SEQ ID NO: 18170 - DNA, 423 bp, Homo sapiens
  misc_feature 415: n=a, g, c or t
agcccacagagttccacctgctcacaggttggctggctcagcaaggtggtgccctgctctgagcattcaggccaaggccatcctgcaccatggccaggtacagatgctgtcgcagccagagccggagcagatattaccgccagagacaaagaagtcgcagmsaggaggcggastgccagacacggaggagagccatgaggtgctgccgccccaggtacagaccgagatgtagaagacactaattgcacaaaatagcacatccaccaaactcctgcctgagaatgttaccagacttcaagatcctcttgccacatcttgaaaatgccaccatccaataaaaatcaggagcctgctaaggaacaatgccgcctgtcaataaatgttgaaaagtcatccctaaaaaaaaaaaaaawtnsgaaaags

SEQ ID NO: 18171 - DNA, 357 bp, Homo sapiens
  misc_feature 174,331,353: n=a, g, c or t
agtgggcggwsytgctksggstggaggtgtgaggatccgaacccaggggtggaggcggctcctgcgatcgaaggggacttgagactcaccggccgcacgccatgagggccctgtggtgctgggcctctgctgcgtcctgctgaccttcgggtcggtcagagctgacgatgaakntgatgtggatggtasagtagaagaggatctgggtaaaagtagagaaggatcaaggacggatgatgaagtagtacagagagaggaagaagstattcagttggatggattaaatgsatcacaaataagagaacttagagagaagtcggaaaagttttantatgaatgaccctgaaaaaaanaaaa

SEQ ID NO: 18172 - DNA, 86 bp, Homo sapiens
attacaatttccttctatactcagaggtcattactactcagactyttctggttttcgtcattacgcatgaaaacgccaccttaagc

SEQ ID NO: 18173 - DNA, 331 bp, Homo sapiens
cttgttctatcacccaggctggtgtgcactggtatgttctcgctcactgcaaccactatctctcaggttcaagcgattctccttcctcagcctcctgagtagctgggattacaggcacatgtcaccacgcctggctaatttttgtatttttaatagagactgggtttcaccatgttggccatgctggtcttgaacttctggcctcaagtgatctgcccacctcagccttccaaagtgctgagattacagtcctgagccactgctttcggccttacagaattgttttgttttggggcattcagaagtctgacataaaaattaacttgaaaaa

SEQ ID NO: 18174 - DNA, 705 bp, Homo sapiens
aatcagaatcagcaggtttgcagtcagattggcagggataagcagcctagctcaggagaagtgagtataaaagccccaggctgggagcagccatcacagaagtccactcattcttggcaggwatggcttctcatcgtdmtgdvtcctcctctgccttgctggakstggtatttgtgtctgaggcawggccctacgggcaccgggtgaatccaagtgtcctctgatggtcaaagttctatgatgctgtccgaggcagtcctgccatcaatgtggccagtgcatgtagttcagaaaggctgctgatgacacctgggagccatttgccttctgggaaaaaccagtgagtctggagagctgcatgggctcacaactgaggaggaatttgtagaagggatatacaaagtggaaatagacaccaaatcttactggaaggcaacttggcatctccccattcccatgagcatgcagaggtggtattcacagccaacgactccggccccccgccgcttacaccattgccggccctgctggagcccctactcctattcccaccacggctgtcggtcacccaaatcccaaggaaatgaggggacttctccctccagtggaacctgaaaggacgagggatgggggatttcatgtaaccaagagtattccatttttactaaagcagtgttttcacctcatatgctatgttagaagtcc

SEQ ID NO: 18175 - DNA, 178 bp, Homo sapiens
  misc_feature 42: n=a, g, c or t
ahtactactcagacttttctggttttcstcattacgcatganaacgccaccttaagcttatgtcgcctgtgaatatttaagggaaaaaaacatcccggcaaccaactgctaggcgacggacgctaagcacctcctccccgcggacgtcagcacccgccttttcccgaagtcgcaacac

SEQ ID NO: 18176 - DNA, 484 bp, Homo sapiens
  misc_feature 333: n=a, g, c or t
agcggcgggctcctgcagcggtggtcggctgttgggtgtggagtttcccagcgcccctcgggtccgaccctttgagcgttctgctccggcgccagctacctcgctcctcggcgccatgaccacaaccaccaccttcaagggagtcgaccccaacagcargraatagctcccgagttttgcggcctccaggtggtggatccaatttttcattaggttttgatgaaccaacagaacaacctgtgaggaagaacaaaatggcctctaatatctttgggacacctgaagaaaatcaagcttcttgggccaagtcagcaggtgccaagtctagtggtngsmagggaagacttggagtcatctggactgcagagaaggaactcctctgaagcaagctccggagacttcttagatctgaagggagaaggtgatattcatgaaaatgtggacacagacttgccaggcagcctggggcagagtgaagagaagc

SEQ ID NO: 18177 - DNA, 325 bp, Homo sapiens
  misc_feature 170,226,261: n=a, g, c or t
tttttgtcgcgcgaggttttggtttgtaaggatcggcgagtggcgcccaccatctctgcttgctgaaaagctgcagaggccgccaggagcccacgcacctgagacttttacctttacccagaaaggaataaaagaggtcagatgatgacagctgtgtccttaacaaccangccccaggaatcagtggcttttgaggacgtggctgtgtacttcactacgaggaatnggccatcatggtgcctgccgataggccttgtacanggatgtgatgctggaaaactatgaggctgtggcctttgtagtgccacccacttccaaaaccagc

SEQ ID NO: 18178 - DNA, 498 bp, Homo sapiens
acttccgctccaggaaggcgaggtcggatctgagatatctcccagggaggttcacttccccggaactctgccttttcccagaaggaggaggggaaaaatgaccaagttccaggaggcagtgacattcaaggatgtggctgtggccttcactgaggaggagctggggctgctggactctgcccagaggaagctaccgagatgtgatgctggagaactttaggaacctggtttcagtgggacatcagtccttcaaaccagatatgatatcccagttggagagggaagaaaagctttggatgaaggagcttcaaacccaaagaggtaagcattcaggtgagtactgtgcagccggaatcgtagttaacagctgttatttttcctttattcaggataatttcttctccactcagctacctgagagacttttttaaaaaacatctgtcatggttgggcgcgatggctcaagcctctaatcccagcactttgggaggcctggca

SEQ ID NO: 18179 - DNA, 353 bp, Homo sapiens
acttccgcccaggaagacgacgtagcagccatcttttccctggctttggtgattcagccctgacttctcaaaaagcactgcacagaggaggaggcagcagaaccccatttcagcttcttaggactctgcacttccccagaaggaagaattaaaaatgaatatgttcaaggaagcagtgacctttaaggacgtggctgtggccttcacggaggaggaattggggctgctgggccctgccaraggaagctgtaccgagatgtgatggtggagaactttaggaacctgctgtcagtggggcatcacccttcaaacaagatgtatcacctatagaaagaaatgagcagctttggata

SEQ ID NO: 18180 - DNA, 364 bp, Homo sapiens
aattagctgctgccgcgccttggagtccggagtaacttggccaggctggcccgagcggaactggagaaagctgagggggttgggcatgttccaggatctgtctatcgacttctctcaggaggaatgggagggcctggacactgctcagaaggacttatagagagatgtaatgatggagaactatagcagcctggtctcactaggtctctctatcccaaagcctgatgtgatttccttactggagcaagggaaagagtcctgcatggtttcaagggacgtaccaggaggatggtgcccagttttcctttaatgcagccatttcatgcatcaatggatattcattcagcactcttttttttttttt

SEQ ID NO: 18181 - DNA, 494 bp, Homo sapiens
aaatcgtgggtttcctgtggggctagggctcgccctgcgcccaggtgtaagtggaagttaattaaatgggcgtacgctgagtggtttgtttccagcctaggtccgcacgggacgtgatttatttagtgaaggggcacaagatctggagatctggcttgtacttttttcctttggccaggaactacgggcttaatctcttcctttggtctcctcatatgtaaaatgaggtggctgaggccgggcgcggtggctcacgcctgcaatcccagcacattgggaggccgaggcgggcaaatcacttgaggccaggagttcgagaccaggctggccaacatggtgaaacccgtctccactaaaaatacaataaattggcctggcgcggtggctcacacctgttgtcccaaagtgctgggattccaggtgtgagccacagcgcctggcgattaatatgtttcttacaatttagtaaatgattacaagctgcatttattcaa

SEQ ID NO: 18182 - DNA, 363 bp, Homo sapiens
acgggggccgagcccgagctacattcctcctcctccttcttcgccacccaaagactcacgcatacacacatttttctttcgtatctgctgtctcagcctcccacgggccaatttgggtaaatgcgtccaagaggaagaaataaaaatgaaaagactgacagtttaaaagcatgtggagggcttagaagataaagacgagtgcaagaaagggagagcgcggccggccgcggttgtctcacgcctgtcatcctagcactttgggaggccgaagagatcggatcacttgaggtccggagttcaaatccagcctggccaacatggtgaaacccgtctctactaaaaatacaaaaaaaaaaaaaaaaa

SEQ ID NO: 18183 - DNA, 333 bp, Homo sapiens
acgggggccgagccgagctacattcctcctcctccttcttcgccacccaaagactcacgcatacacacatttttctttcgtatctgctgtctcagcctcccacgggccaatttgggtaaatgcgtccaagaggaagaaataaaaatgaaaagactgacagtttaaaagcatgtggagggcttagaagataaagacgagtgcaagaaagggagagcgcggccggccggggtgtctcacgcctgtcatcctagcactttgggaggccgaagagatcggatcacttgaggtccggagttcaaatccagcctggccaacatggtgaaacccgtctct

SEQ ID NO: 18184 - DNA, 196 bp, Homo sapiens
acccttcttrcatttccatcccttccaccacagcatttctcccctctggaggatctascaactaattaccatcttggaagtagagcattcctcacaagttcataaaaatcctgctggtaccttgatttcggacttcccagcctctggaaccatgaaatataaatttctgttctttataaactaaaaaaaaaaaaaa

SEQ ID NO: 18185 - DNA, 203 bp, Homo sapiens
acccttcttgcatttccatccctdccaccacagcatttctcccctctggaggatctagcaactaattaccatcttggaagtagagcattcctcacaagttcataaaaatcctgctggtaccttgatttcggacttcccagcctctggaaccatgaaatataaatttctgttctttataaactaaaaaaaaaaaaaawtbcraa

SEQ ID NO: 18186 - DNA, 189 bp, Homo sapiens
ctggagtgatggtgtccttccctgccccaccacgcatgctcagtgccttttggtttcaccttccctcgacttgaccctttcctcccccagcgtcagtttcactccctcttggtttttatcaaatttgccatgacatttcatctgggtggtctgaatattaaagctcttcatttctaaaaaaaaaaaaaa

SEQ ID NO: 18187 - DNA, 366 bp, Homo sapiens
  misc_feature 175: n=a, g, c or t
aacggattagcaccttaacggattagcaccttaacggattagcgtggcaagaccaagagcagtgatgaccttttagctggaatggccagaggggtaacggtgactaatggtgttaaagggaaggaaagctcctgcccatctgcagcaccttcggcatctgsccctgscsatgacnactgtggagaacaaatccaagattagcacagggcaccaactggacagaggcctccggtcagcctcactctgactgcaaccccctctcactggacagcatcacctggacacagagcctcacctagtctgtgtcccatggacacaactttgctttggacagtgacaccaagaatactcacccctttacttagc

SEQ ID NO: 18188 - DNA, 367 bp, Homo sapiens
  misc_feature 144: n=a, g, c or t
accttaacggattagcgtggcaaggtttacagatctgggactgaaacccgcacaaggataaatggctgcctcaaggctatcttcaggcccattctgaaagaaaaaggaagttctcgtcgcagaaagaaaataataccaaagggnaacaaaatttcaagaaggaataaagaacagtggaagagtaaatatgaagaccaagagcagtgatgaccttttagctggaatggccagaggggtaacggtgactaatggtgttaaagggaaggaaagctcctgcccatctgcagcaccttcggcatctgcccctgccatgaccactrtggagaacaaatccaatattagcacaggtatggggtgacattcagtc

SEQ ID NO: 18189 - DNA, 249 bp, Homo sapiens
  misc_feature 142: n=a, g, c or t
ctggtgcggccgcggccgggaagggactggattatgtcggccccgtttgaggagcggagtggggtggtaccgtgcgggaccccgtggggccagtggtaccagaccttggaggaggtgttcattgaagttcaggtgccgccanatcgtckcccaggatatccagtgsggcctccagagccggcatggtggcgctgtcggtgggcgtcskcgagatcctcaagggcaaactctttrgattctacaatagct

SEQ ID NO: 18190 - DNA, 492 bp, Homo sapiens
aaatcgtgggtttcctgtggggctagggctcgccctgcgcccaggtgtaagtggaagttaattaaatgggcgtacgctgagtggtttgtttccagcctaggtccgcacgggacgtgatttatttagtgaaggggcacaagatctggagatctggcttgtacttttttcctttggccaggaactacggcttaatctcttcctttggtctcctcatatgtaaaatgaggtggctgaggccgggcgcggtggctcacgcctgcaatcccagcacattgggaggccgaggcgggcaaatcacttgaggccaggagttcgagaccaggctggccaacatggtgaaacccgtctccactaaaaatacaataaattggcctggcgcggtggctcacacctgttgtcccagcactttgggaggccgagcattcttcaggtaatctgaaccttctgagaaaacatggtcaacgtcttgaaaaggagtgcttatagaatgtg

SEQ ID NO: 18191 - DNA, 493 bp, Homo sapiens
agagcttctcatgcagcctgcaccagcgccgggtcggagagtcagaggccaccctgagatggaccgagatcttcagttggggaggcgcctccggcttggtggcatgcatgtttagtcccagctacacagcagggaggctgaggctgaaggaatacttgagcccaggaattcaagactagcctgcacaacataggcctcctctgtcacctgggctggagtgcgatggtgtcatcttgggtcactgcagcttctgcctcttgggttcaggtgattctcatgcctcagcttcccgggtggctgggattgcaggcatgcgccaccaggcccagcaaagttttgtatttgtagtggagatggggtttcactgtgttggccaggttgttctcagactcctcacctcaggtgatcacctgcctctgcctcccaaagtgctgggattaaaggaatgagccactgggtcgggcaaacacagagataaattgaaagcatattt

SEQ ID NO: 18192 - DNA, 296 bp, Homo sapiens
  misc_feature 288: n=a, g, c or t
aatgggccagagckkgtcatgcagcctgcaccagcgccgggtcggagagtcagaggccaccctgagatggaccgagatcttcagttggggaggcgcctccggtgagcttgcggccagatgccccctcagtagtcctccgcaacaggtgccgcgcagccgagtggcgggctagcataccgcctgcccgcaattcggccaggcctcgagcctgctccgccttcccgctgcggtagcgccgscggggaaacgccgccacsggctgcatgggcagcgctcgcgccccgccgntgagccgs

SEQ ID NO: 18193 - DNA, 495 bp, Homo sapiens
attaaaagtagcacttagggctggaaagactttctgcaatgtttctgtgcagtctgtgaggatttaaagtagtttttcattcttagattttcttcaatttgacccgctgttgcaaactcccctgggaccacatggagggcccttccattcagtgctttacggtaatggtttcagagtttggtgttagcttttgctttgctgaaacttttcacagctgacttgataccagcactgaggcctgacctctcgatccttcagcacttcagaggttaattttgttgggggatcggatttctttcctggcctggggaatggtgatccctgctagctagtcctttagttacagagttgctgggtgcctgggattccctggcccagtgtgggctggctcagctggctaaaggacttgccatcctgtgagattcattcagcttctttgtccgctgttctccaagggccgcaatgtagtgaaatgctctggcctaggaaccttac

SEQ ID NO: 18194 - DNA, 420 bp, Homo sapiens
  misc_feature 19..20,272: n=a, g, c or t
cactcgstgsytcggcasnnctgctcttctaagatggctgccgctaccggtgcggtggcagcctcggccgcctcgggtcaggcggtaaggtaaaaagatcaccgatctgcgggtcatcgatctgaagtccgagctgaatcggcggaacttagacatcaccggagtcaagamcgtgctcatctcccgactcaagcaggctattgaagaggaaggaggcgatccagataatattgaattaactgtttcaactgatactccaaacaagaaaccanctaaaggcaaaggtaaaaaacatgaagcagatgarttgagtggagatgcttctgtggaagatgatgcttttatcaaggactgtgaattggagaatcaagaggcacatgagcaagatggaaatgatgaactaaaggactctgaagaatt

SEQ ID NO: 18195 - DNA, 266 bp, Homo sapiens
atgaaaagtagtagcatttccagagtataaatgacctttttttaatcatctcatttaattttctctcaagatttcacttagtattaacatcatggttagtagtgtttttaagtaagaattaaaatttgggggtgggtgcagtggcttacactgtagtcccagcacttcggaaggccgagtggggcggatcacttggtgctcaggagtttgagaccagccttggcaacatgatgaaaccccgtctctacaaaaaaaaaaaaaaaagg

SEQ ID NO: 18196 - DNA, 537 bp, Homo sapiens
acgctgaaaaaggatctgagggaaagtgggagattgatgaaccacttgtgccaaaggtaaagaagtgtgtggtcattcaccactaggtcaagcacaacttggcctaacctgtccatctcatggtgtctgaaacgagttgctgtatttctcattggagaattttaacacatagaggaagtttgctattggctcacatgtagaaatcttgttactatgtgtttttcttaccgcccagtgcttcttaccatgaccattttcttcccatttttcaaaatacaattccgtcacgtatgcttggcaattttggtctctgagaattgattttcactatgcgcagatgtctctgcttgagaaaaaatatacagctcaaaatctagcatatttgaaaagttatctagaatctgcagaggtccacacactggaagaggactctaaatgaatacataagaagtagaagatgcaaacctggagatatactgagtaactaactgttttggccaattttcccatgagatatgtttatcaggatatacacgt

SEQ ID NO: 18197 - DNA, 437 bp, Homo sapiens
aggatctgagggaaagtgggagattgatgaaccacttgtgccaaaggtaaagaagtgtgtggtcattcaccactaggtcaagcacaacttggcctaacctgtccatctcatggtgtctgaaacgagttgctgtatttctcattggagaattttaacacatagaggaagtttgctattggctcacatgtagaaatcttgttactatgtgtttttcttatcacccagtgcttcttaccatgaccattttcttcccatttttcaaaatacaagtaagtctcagctatctacattaatcaatgttaggtaakaatgtcctctacttagcagtcctcaaagcagcctttgttagcttcttcttaaaatttcacaaagacagaaatgaaaagtcacaataccactaccaacagattgtggaaagaatattaatcaagtatagg

SEQ ID NO: 18198 - DNA, 436 bp, Homo sapiens
aaaaaaaacgcatgcgcgtcgggcacagcgcgtgcagcctcgtgcagctcttctggtctccggsgcccgcccctsarrmgkkadkgtkrrwttaargarartmctttrtcagaagaagatggccactgcccagttgcagaggactcccatgagtgcactggtatttcccaataagatatcaactgaacaccagtctttbgtgttagtgaagaggcttctagcagtttcagtatcctgtatcacgtatttgaggggaatattcccagaatgcgcttatggaacaagatatctagatgatctttgtgtcaaaatactgagagaagataaaaattgcccaggatctacacagttagtgaaatggatgctaggatgttatgatgctttacagraaaaatatgtatacacaaacccagaagatcctcagacaatttcagaa

SEQ ID NO: 18199 - DNA, 517 bp, Homo sapiens
aaaaccttcctacttttcaggtaacaaaatggcagcttaggctagaaagccgctcatattcgcaggtacaagggctgggtaagaacgccccgcctggctgactaacttgagttccgcgctctggacaggaattatgcacagggcgtcgctgtggcactagaaaccccaaagtcacaagcgccccagatccgaccaggatgccgctaccggctacagcccagaggcccgctcctgcgcgcaagccgccttcctgaagaaaaagcccagtcccggcagcgttcttctccggctccgccttcttccgctcgactttctttgccattggctgacaacggagtacataaggacgtcatttcctgccgcctgtcttttccgtgctacctgcagaggggtccatacggcgttgttctggattcccgtcgtaacttaaagggaaaytttcacaatgtccggagcccttgatgtcctgcaaatgaaggaggaggatgtccttaagttccttgcagcaggaacccaa

SEQ ID NO: 18200 - DNA, 300 bp, Homo sapiens
atatatatcctcctggaatactggccagagggcatgctgaagtttgctgctgccactggagccactccaattgctgaccgctttactcctggaaccttcactaactagatccaggcagccttcccggagccaccgcttcttgtgcttactgaacccagggctgaccaccagcctctcacggaggcatcttatgttaacctacctaccattgctctgtgtaacacagattctcctctgtgctgtgtggacattgccatcccatgcaacaacaagggagctcactcagtgggtttgatgtgg

SEQ ID NO: 18201 - DNA, 250 bp, Homo sapiens
atatatatcctcctggaatactggccagagggccatgctgaagtttgctgctgccactggagccactccaattgctgaccgctttactcctggaaccttcactaactagatccaggcagccttcccggagccaccgcttcttgtgcttactggaacccagggctgascaccagcctctcacggaggcatcttatgttarcctacctaccaktgctctgtgtaacacagattckcctctgtgctgtgtgga

SEQ ID NO: 18202 - DNA, 247 bp, Homo sapiens
atatatatcctcctggaatactggccagagggccatgctgaagtttgctgctgccactggagccactccaattgctgaccgctttactcctggaaccttcactaactagatccaggcagccttcccggagccaccgcttcttgtgcttactgaacccagggctgaccaccagcctctcacggaggcatcttatgttaacctacctaccattgctctgtgtaacacagattctcctctgtgctgtgtg

SEQ ID NO: 18203 - DNA, 207 bp, Homo sapiens
atatatatcctcctggaatactggccagatggcatgctgaagtttgctgctgccactggagccactccaattgctgascgctttactcctggaaccttcactaactagatccaggcagccttcccggagccaccgcttcttgtgcttactgaacccarggctgaccaccagcctctcacggaggcatyttawgttaacctacctacc

SEQ ID NO: 18204 - DNA, 345 bp, Homo sapiens
atatatatcctcctggaatactggccagagggccatgctgaagtttgctgctgccactggagccactccaattgctgaccgctttactcctggaaccttcactaactagatccaggcagccttcccggagccaccgcttcttgtgcttactgaacccagggctgaccaccagcctctcacggaggcatcttatgttaacctacctaccattgctctgtgtacacagattctcctctgtgctgtgtggacattgccatcccatgcaacaacaagggagctcactcagtgggtttgatgtggtagatgccggctcgggaagttttgcgcatsgtgacaccatttccc

SEQ ID NO: 18205 - DNA, 336 bp, Homo sapiens
  misc_feature 212: n=a, g, c or t
atatatatcctcctggaatactggccagagggcatgctgaagtttgctgctgccactggagccactccaattgctgaccgctttactcctggaaccttcactaactagatccaggcagccttcccggagccaccgcttctygtgcttactgaacccagggctgaccaccagcctctcacggaggcatcttatgttaacctacctaccattgntctgtgtamacagattctcstctgtgctgtgtggacattsccatcccaygcaacaacaagggagctcactcagtgggttygatgtggtagatgccggctcgggaagttttgcgcatgcgtgaca

SEQ ID NO: 18206 - DNA, 512 bp, Homo sapiens
  misc_feature 401,414,429,504: n=a, g, c or t
atatatatcctcctggaatactggccagagggcatgctgaagtttgctgctgccactggagccactccaattgctgaccgctttactcctggaaccttcactaactagatccaggcagccttcccggagccaccgcttcttgtgcttactgaacccagggctgaccaccagcctctcacggaggcatcttatgttaacctacctaccattgctctgtgtaaacagattctcctctgtgctgtgtggacattgccatcccatgcaacaacaagggagctcactcagtgggtttgatgtggtagatgccggctcgggaagttttgcgcatscgtgacaccatttcccatgaacacccctgggaggtcatgcctcagctctgcttctacagagatcctgaaganattgaaaaataanagcaggctgctgctnaaaatgcattgaccaatgaggaatttcagggtgaatggactgctccagctcctgagttcactgctactcagcctnaggttaca

SEQ ID NO: 18207 - DNA, 339 bp, Homo sapiens
atatatatcctcctggaatactggccagagggcatgctgaagtttgctgctgccactggagccactccaattgctgaccgctttactcctggaaccttcactaactagatccaggcagccttcccggagccaccgcttcttgtgcttactgaacccagggctgaccaccagcctctcacggaggcatcttatgttaacctacctaccattgctctgtgtasacagattctcctctgtgctgtgtggacattgccatcccatgcaacaacaagggagctcactcagtgggtttgatgtggtagatgccggctcgggaagtttwgcgcatsgtgacaccat

SEQ ID NO: 18208 - DNA, 428 bp, Homo sapiens
  misc_feature 405: n=a, g, c or t
atatatatcctcctggaatactggccagagggcatgctgaagtttgctgctgccactggagccactccaattgctgaccgctttactcctggaaccttcactaactagatccaggcagccttcccggagccaccgcttcttgtgcttactgaacccagggctgaccaccagcctctcacggaggcatcttatgttaacctacctaccattgctctgtgtamacagattctcctctgtgctgtgtggacattgccatcccatgcaacaacaagggagctcactcagtgggtttgatgtggtagatgccggctcgggaagttttgcgcatgcgtgacaccatttcccatgaacacccctgggaggtcatgcctcagctctgcttctacagagatcctgaagagattnaaaaagaagagcaggctgctgct

SEQ ID NO: 18209 - DNA, 418 bp, Homo sapiens
atatatatcctcctggaatactggccagagggcatgctgaagtttgctgctgccactggagccactccaattgctgaccgctttactcctggaaccttcactaactagatccaggcagccttcccggagccaccgcttcttgtgcttactgaacccagggctgaccaccagcctctcacggaggcatcttatgttaacctacctaccattgctctgtgtaaacagattctcctctgtgctgtgtggacattgccatcccatgchacaacaagtggagctcactcagtgggtttgatgtggtagatgccggctcgggamgttttgcgcatgcgtgacaccatttcccatgaacacccctgggaggtcatgcctcagctctgybbctacagagatcctgaagagatgaaaaagaagagca

SEQ ID NO: 18210 - DNA, 487 bp, Homo sapiens
taaggacttttctggggtgtgggcagaggtttgggatcagatggcgcaggtagcctgtcctcagttgtcccaaaggggcagaggcaggggtgcctggagccaagagttcctgagcctgcaggacctgtgaccatgtgggtcacctgtttggggtcttcttgaggcttgtgctttcacagctctctttgaagcagatgtcttggtgaactcggtagactcttttatacctgttgtcacaagaaagctttgtaaaaccagacagtgaagcaaaatgttgccaactgcttaacctaggctatgtgaacccacagtaaacctgaaggtgtttgagggaaaaactgctattttctgaatgaaacgtgacctcctattgatgtattaaaatgtctaacataaaggtcatgtgatttgtaataaatttattgtggtacagtaatatgcataaaataaacccattttaatgtgcattctgatgagcactgacaaa

SEQ ID NO: 18211 - DNA, 298 bp, Homo sapiens
atatatatcctcctggaatactggccagagggccatgctgaagtttgctgctgccactggagccactccaattgctgaccgctttactcctggaaccttcactaactagatccaggcagccttcccggagccaccgcttcttgtgcttactgaacccagggctgaccaccagcctctcacggaggcatcttatgtttaacctacctacccatttgctctgtgtaacacagattctcctckgkggctgtgtggacattgccatcccatgcaacaacaagggagctcactcagtgggttt

SEQ ID NO: 18212 - DNA, 442 bp, Homo sapiens
tatccaggcatggtggcgggcgcctgtaatcccagctactcgggaggctgaggctggagaatcgcttgaacccgggaggtggaggtttcggtgggctgagatcgtgccactgtgctccagcctgggcaacaagagtgagactctgtcttaaaaaaaaaaaacaagaaactgtttacaaatctaaaaattattcctctccaacccctgatgtagaagacagtaggtcgagaaaacaatatctttattgtattaataatgtcaattttccctttcttaaacttttacctactgtagttatattcaaatatgaaaattcagctagtttttttttyctttttttggaagagatgggggtctcactgtgttgcctaggctggtcttgaactcctgggctcaagmaatcctcttcgacctcccgaagtgctgggattataggcatggg

SEQ ID NO: 18213 - DNA, 263 bp, Homo sapiens
  misc_feature 220: n=a, g, c or t
atatatatcctcctggaatactggscaragggcatgstgaagtttgctgctgccactggagccactccaattgctgacsgctttactcctggwaccttcactaactagatccaggcagccttcccggagscascgcttcttgtgcttactgaacccatggctgaccamcagsctctsacggaggcatcttatsttaacctasctaccattgctctgtgtnacacagattctcctctgtgctgtgtggacattgccatcccatg

SEQ ID NO: 18214 - DNA, 419 bp, Homo sapiens
  misc_feature 401: n=a, g, c or t
atatatatcstcctggaatactggccagagggcatgctgaagtttgctgctgscactggagscactccaattgctgaccgctttactcctggaaccttcactaactagatcsaggcagscttcscggagmcaccgcttcttgtgcttactgaacccagggctgaccaccagcctctcacggaggsatcttatgttaasctacctaccattgctctgtgtamacagattctcctstgtgstgtgtggacattgccatcscatgcaasaacaagggakctcastcagtgggtttgatgtggtagatgccggctcgkgaakttttgcgcatsgtgcacaccattwcccatgawcacccctgggargtcatgcctcagctctgcttctacagagatcctgaaganattgaaraaagaagagca

SEQ ID NO: 18215 - DNA, 448 bp, Homo sapiens
atatatatcctcctggaatactggccagagggcatgctgaagtttgctgctgccactggagccactccaattgctgaccgctttactcctggaaccttcactaactagatccaggcagccttcccggagccaccgcttcttgtgcttactgaacccagggctgaccaccagcctctcacggaggcatcttatgttaacctacctaccattgctctgtgtaaacagattctcctctgtgctgtgtggacattgccatcccatgcaacaacaagggagctcactcagtgggtttgatgtggtagatgccggctcgggaagttttgcgcatgcgtgacaccatttcccatgaacacccctgggaggtcatgcctcagctctgcttctacagagatcctgaagagattgaaaaagaagagcaggctgctgctgaaaaggcagtgaccaagga

SEQ ID NO: 18216 - DNA, 219 bp, Homo sapiens
atatatatcctcctggaatactggccagagggcatgctgaagtttgctgctgccactggagccactccaattgctgaccgctttactcctggaaccttcactaactagatccaggcagccttcccggagccaccgcttcttgtgcttactgaacccagggctgaccaccagcctctcacggaggcatcttatgttaacctacctaccattgmtctgtgt

SEQ ID NO: 18217 - DNA, 365 bp, Homo sapiens
atatatatcctcctggaatactggccagagggcatgctgaagtttgctgctgccactggagccactccaattgctgaccgctttactcctggaaccttcactaactagatccaggcagccttcccggagccaccgcttcttgtgcttactgaacccagggctgaccaccagcctctcacggaggcatcttatgttaacctacctaccattgctctgtgtasacagattctcctctgtgctgtgtggacattgccatcccatgcaacaacaagggagctcactcagtgggtttgatgtggtagatgccggctcgggaagttttgcgcatgcgtgacaccatttcccatgaacacccctgggaggtc

SEQ ID NO: 18218 - DNA, 555 bp, Homo sapiens
  misc_feature 500: n=a, g, c or t
aaatttttcatattaagaaaagactagaacttggccaggtgtggtggctcacacctgtaatcccagcactttgggaggctgaggtgggtgaatcacctgaggtctggagtttgagaccagctgaccaacatggtgaaacaccatctctactaaaaatacaaaaattaggcaggcrwggtcatgggcacctgtaatcccagctactcgggaggctgaggcaggagaatcacttgaacccgggaggtggaggttgcagtgagccgagactgcaccattgcactccagcctgggtgaaagagcaagactccatctcaaaaaaaaaaaaccagtwttaatatgttaattttttycttaaacaataactggatcttttactctacaattagttttagagtctaccattttctacttagcaaaatattgkggattttttttcatgtcaataagcatccatctacaatakccatttwactgtccaaattgcatgggtatrgtatvcngagatttaaccaatcccctactgttaggcatttttcactgtcatagcagtttata

SEQ ID NO: 18219 - DNA, 466 bp, Homo sapiens
tagaaatcattaaggaaaattgacttggggaaaagtatatttctcagactgtcttgacattagtgacttttgattgtggaaaaactattgaacacaagatggcagtataccgttaactctgaaaacaagacaaggaatggatttttgactctagtaaagattaacatcaggccgcgcacagtggctcatgcctgtaatcccagcattttgggaggccaaggcaggacgatcacctgagctcacgagtttgagatcagcctgaccaacatggagaaaccccatctctactaaaaatacgagttagccgggcgtggtggcgcatgactgtaatcccagctacttgggaggctgaggcaggagaatcgcttgaacccgggaggcagaggttgtggtgagccaagatggcaccactgcactccagcctgggcaacaagaggaaaactccatctcaaaaaaaaaaaaaaaa

SEQ ID NO: 18220 - DNA, 172 bp, Homo sapiens
agcgcccggctttgaacccgccctgcactgctgtctgggcgggtccggggactcagcactcgacccaaaggtgcaggcgcgcgagcacaacccatggctgcgctgggctgcgcgaggctgaggygggcgctgcgaggggccggccgtggcctctgcccccacggggccagag

SEQ ID NO: 18221 - DNA, 254 bp, Homo sapiens
aaagaggactccaagcgccatggccgctgccgcccgagcccgggtcgcgtacttgctgaggcaactgcaacgcgcagatggctgtttcaaatattagatatggagcagcagttacaaaggaagtaggaatggacctaaaaaacatgggtgctaaaaatgtgtgcttgatgacagasaagaacctctccaagctccctcctgtgcaagtagctatggattccctagtgaagaatggsatcccctttacggtttay

SEQ ID NO: 18222 - DNA, 430 bp, Homo sapiens
agaagtcagaaagaatgagacataaaatacttgaagatgtaatggttgaaatgtttctaaatttgatataataaaacatcttccacaaaaatattcctgacaatcttattcataacatcagtccataaacaccttaaatgtccattaataggagaataaacatttttttcaatacaaactgtgttaatgaaagaaaaaagaagtgagtcttaagtcttcagttattttttcttcccacagatgagtataagtaacactgcaccttaatacctatggaatgatgcagctgaggtcagctggaggtaacaaggccagttcctggagactctgattaggtgagttctagagagatgagcatttgggaggacagatgggctgagccgatacaatgaaatactactcagcaaaaataaacaaattaatttaaaaa

SEQ ID NO: 18223 - DNA, 505 bp, Homo sapiens
acttttctgggtagatcccaggcagatatggcctctgatatgcttggcctttgagaccatgctctttcctgttctcctgaagaaccagtagctatgagcacaggggcctctgtcaggccagccaccagctatcgtgagaggagccaagttcctcattgccctgtgctgaaccgaactgcagcaagttggatagaggaggcagttttggcttgaacgcaaacatcctgtcggagaacagagtgattatagttttagctgcacacggggaaataacagcacagaggtgaatcatggcatctgtttactgctaattaacccctccgtgtacaccagtgttgtatgtgagccggcctgcggtctgaaccgcctcctataaggagggctcccttggcagccaaaaccagttggcccaaatgccttgataggcttcctgcttcacttgttgcccatgtggtctgattttagataaaagcattgcttttgggcctaaaaaaaaaaaaaaatg

SEQ ID NO: 18224 - DNA, 343 bp, Homo sapiens
atattccactgcctagaagcaagtcgcaggtcctgcccacactcaatagcagaggatttcacaaaagtgtgaagagtggggttgggggccaatggggccatcttatatagcctgtctaccacactggctgacatttctcactccttcagcacagtcctctactattggcacatcaaaaaggatgcacctgcttttcaacccaaaagatctgtggcattaaggcccccaccaacatggcagtataggttggccacctgctgaaaggcatctgcaaatccaatgtccttgtctttgaacaagactgaatataggcgtatacctgccttctgagatacacataagc

SEQ ID NO: 18225 - DNA, 306 bp, Homo sapiens
aggagaagggcgksgggggtacgagasgagaaaaaaaaagtgaaaaaamgaaacgaaaaggacagacgaagagtttaaagagaaaagggaaaaaagaaagaaaaagtaagcagggctggcttcgccgcgttctcgtcgtcggatcaaggagcgcggcggcgttttggacccgcgctcccatcccccaccttcccgggccggggacccactctgcccagccggagggacgcggaggaggaagagggtagacaggggcgacctgtgattgttgttattgatgttgttgttgatggcaaaaaaaaaaaa

SEQ ID NO: 18226 - DNA, 538 bp, Homo sapiens
gaaaggatgtacagaggatccccaaccgcctgcgaaacccaagccgccgcgtaggagcgtgcgttcgggccctcttctcccacctgttcggccagcctccacgatccagctgccaaccatctagcctaccctgatctctgagcaggggtcgtcgtcattttactccagaggagactgaagccaaaagactccccatccccaggatgtcaacctcagtccctcaaggccatacctggacccaacggtgaagaaagacgatgaggaggaggacccgctggaccagctgctctcccgctctggctgtgctgcctcccactttgcagtgcaggagtgcatggcccagcaccaggactggcggcaatgcagccacaggtgcaggcgttcaaggattgcatgagtgaacagcaggcgaggcggcaagaggagctgcagaggaggcaagaacaagccggtgcccaccactgagaccccaaaccacctatcccagtagatggccctgcaagaccagcacccagcaagattatagaggaagaaatct

SEQ ID NO: 18227 - DNA, 641 bp, Homo sapiens
actttttcacattccccgccccttccgtgtgcacgctccccacgaggggctggttcctgaaaggatgtacagaggatccccaaccgcctgcgaaacccaagccgccgcgtaggagcgtgcgttcgggccctcttctcccacctgttcgactccccatccccaggatgtcaacctcagtccctcaaggccatacctggacccaacggtgaagaaagacgatgaggaggaggacccgctggaccagctgatctcccgctctggctgtgctgcctcccactttgcagtgcaggagtgcatggcccagcaccaggactggcggcaatgccagccacaggtgcaggcgttcaaggattgcatgagtgaacagcaggcgaggcggcaagaggagctgcagaggaggcaagaacaagccggtgcccaccactgagaccccaaaccacctatccccagtagatggccctgccaagaccagcacccagcaagattatagaggaagaaatcctaaatgctggtgtgggaggtctaaaacatggggagagtttttggatctggagttgagagccatgggtttggacatgactggcacaaacagctgtcatatgttcatggtcagatgtcatacattctcagctgtcttgttc

SEQ ID NO: 18228 - DNA, 409 bp, Homo sapiens
  misc_feature 55: n=a, g, c or t
aaggatgtacagaggatccccaaccgcctgcgaaacccaagcsgssgcgtaggancgtgcgttcgggccctcttctcccacctgttcgactccccatccccaggatgtcaacctcagtccctcaaggccatacctggacccaacggtgaagaaagacgatgaggaggaggacccgctggaccagctgatctcccgctctggctgtgctgcctcccactttgcagtgcaggagtgcatggcccagcaccaggactggcggcaatgccagccacaggtgcaggcgttcaaggattgcatgagtgaacagcaggcgaggcggcaagaggagctgcagaggaggcaagaacaagccggtgcccaccactgagaccccaaaccacctatccccagtagatggccctgcaagacc

SEQ ID NO: 18229 - DNA, 461 bp, Homo sapiens
agaggatgtacagaggatccccaaccgcctgcgaaacccaagccgccgcgtaggagcgtgcgttcgggccctcttctcccacctgttcgactccccatccccaggatgtcaacctcagtccctcaaggccatacctggacccaacggtgaagaaagacgatgaggaggaggacccgctggaccagctgatctcccgctctggctgtgctgcctcccactttgcagtgcaggagtgcatggcccagcaccaggactggcggcaatgccagccacaggtgcaggcgttcaaggattgcatgagtgaacagcaggcgaggcggcaagaggagctgcagaggaggcaagaacaagccggtgcccaccactgagaccccaaaccacctatccccagtagatggccctgccaagaccagcacccagcaagattatagaggaagaaatcctaaatgctggtgtgggar

SEQ ID NO: 18230 - DNA, 437 bp, Homo sapiens
tctccagtcatttttgaacacatccaatagaaacattggcagcatggtcttccaaaacaaaaagcagtaacatgcatgtttaattgcataccattctcttcacagtagcaggcttaccaatttccatagtctcatgaggccgaaatgaattacaatgtaaagtgttccaggaaccaaattggattttctttcttttgtcattggacacggtttgcaaagttggacatcacttgagttccttcttaaacttttcggcaacttctcttggatcctgttatcacagttttttactgtgatgaaatcttgttaaccaccactagggaatctccagatgaactattaatgcactgtcttatgcctctcattggtgatgtttggaaaatagaagacatctctaatggaatcatgggggaaacgggttggaatttgtagccatt

SEQ ID NO: 18231 - DNA, 395 bp, Homo sapiens
ctcgttaaaaccagttggttgggcaacttaaatttttagaggatcacagatgtaggcttgagcagttgtaatagatgatttctttttttttctttcttttttctttttttttgagatagagtctctctctgtcatccaggctggagtgcggtggcgcgatcttggcttactgcaacctctgcctcccaggttcaggcgtttctcctgtctctactaaaaatacaaaattagccaggcatggtggcacatgcctgtaatcccagcttctcgggaggctgaggcaggagaattgcttgaacctgggaggcagaggttgcagtgagctgagatcgtgccattgcactctagcctggcaatgagcgaaactccttcttaaaagaaaaaaagaaaagaaa

SEQ ID NO: 18232 - DNA, 71 bp, Homo sapiens
cttccctgttatctttgtgacccactgatagcagctggtggtcctggtgcggtgagattttgactcttttt

SEQ ID NO: 18233 - DNA, 436 bp, Homo sapiens
catctaagccaacagcaaatgaccactttgccaactaatagataggactccgtttctgcatgggatgctgatgaccttaacaagctaagcaacatacacagtgtatgcaacatggtgattattaaatgtccattggcatcagcctagcattggagtctgtgtattgttagatataaactttgtcagtcacctttattttcttttgtcttttatccttcagttaaaagacttaggttaaaagtctctacttttaggagaactactatggagtttcatcttttataggagagcttcacattgtcctttgataatttcctcctgttaacaaaatttatgatataatatactttacaaagtaatagtcttaatgttctaggcttttaattagttttagtagtttggatactatgaaataaataaggtataccggaactaa

SEQ ID NO: 18234 - DNA, 476 bp, Homo sapiens
catctaagccaacagcaaatgaccactttgccaactaatagataggactccgtttctgcatgggatgctgatgaccttaacaagctaagcaacatacacagtgtatgcaacatggtgattattaaatgtccattggcatcagcctagcattggagtctgtgtattgttagatataaactttgtcagtcacctttattttcttttgtcttttatccttcagttaaaagacttaggttaaaagtctctacttttaggagaactactatggagtttcatcttttataggagagcttcacattgtcctttgataatttcctcctgttaacaaaatttatgatataatatactttacaaagtaatagtcttaatgttctaggcttttaattagttttagtagtttggatactatgaaataaataaggtataccgaactaagtaataataatacaagtttcaaaaatcagtactacatagag

SEQ ID NO: 18235 - DNA, 418 bp, Homo sapiens
aaaattgctcaggttctctttaacggtgtgtaggctttgttttttcactgtgtgggataaatcttgctgttgttcagcatttggggccatactgcctttatgaactgtaacactcaccataaaggtctgcagctttgctcttgaagccagcaagaccacgaaacccccagaaggaacaaactcctgacgcatccaaacctcagaagaaacaaattctggacacaccatctttaagaacggtgaaactcaccgagagggtttgtggcttcattcttgaagtcagcgagaccaagaacccaccaattccggacacaatagtttttacccactgccagactgtcagcccccaccaggcaggacatttcattgctgctgaatctcagggtgtaggacagtacctggcacatagcaggcatac

SEQ ID NO: 18236 - DNA, 337 bp, Homo sapiens
tgaacgcacctcaggatggcccgtactttggaaccactagcaaagaagaggaaaagagcagagcgctttgggattgcctgatgaaaagttcctgatactttctgttctccagtgttttccatttctctccttcttcttggtcacatatatgsctaaaakgcacagtcatgtgcctacgtcctgcctcgcaatgagggagcatgtaccccaggtacatccatgaactgcggcasagtttgacttattgctgtttcagctttaaggttgttgtgtttttgtttttgattatgttgcttgttaataaaaaaaaaaaaaaaaaaaaaaaaaaaaaaaaaar

SEQ ID NO: 18237 - DNA, 661 bp, Homo sapiens
tatttctaaatttttgaggtgctttgctatttcttgtgtgacctgatagctccctggaactttgggtctgtgtgtgacacatgagactcacagttggagttctccagctctggaggtgctgaaggagctgcattaattctggaagacgactccatgcagcaactactgaagaaaggaccagacttcaacggggagtgtggatgggccgacctggctgggactcgtgaatctggagaagagctggagaatggatagtattgtctgtatttggagactttaatttctgtgtgagaccaaaggaggagagatgtgttttgttcaaaatttaaatttgttgtggtacctatcttatgtaacctgtctggtgagtttgtttggacaacctaactcagctttatttgacatggaacctaaaatagaagataagatcttgatattctgtacaagttgatgtaataccctgatgcgttttagaggacttggcataaaatgaaagattggcaaaggcccttgaggggcttggggatgagagtatggaactgtctgcattggaccctaaactggactagaagaggcatcttcaaggttcatacgttgtccagctgtaagttcatttgagtagcagacctaacaaatatttgaggtcaaaaccctaccatgg

SEQ ID NO: 18238 - DNA, 457 bp, Homo sapiens
agtaaaatagaccatccataccttcttatcagcgtaggatatgcctcctatcatgctagcattctagttggaaccttgacactgaagtgccttctgcctccctccatgattctgaggcctccccagccatgtggaagtatgaaaaatcgttacactgggaaggctgcccatagaaaaccataactgaaggcattgcatgttgatcccaccaagagggccacactcacctcggaagtggttgagcctgtccaccggtcctgtgatgggccctgtagggagctctggattcacaggctggagcatgtgcagcagcacggactcactcctgcaaggaactctttaggtgcaagaaaatccgtctcatttgttcatttctgcattggcttagaatgtttattaagacacagtaggcacttgatattttgaagaaaaaagtattgaagtgggtgtggtcttc

SEQ ID NO: 18239 - DNA, 453 bp, Homo sapiens
cagtcttctgccactccttttcgtggtccttcccttcactgccttccttctcccagacagactgggcatccagttccaatccaaaggctgcccctttgaccaggcccatcttctccacctcacatcagacagccaatcggctgcccagacctcgaaacctcagtaacctagaaggaaatggaccttggcaaacgtgtgtcaggagaggatgacttggaggtgtccaccgtgtttcttactgaagatgtctaaaagtcaattggggtcaaggaacaagcctctactcacatgcatgtgggcaaatgaagtcacagaacaaataacctaccctgcatccaggcacggagtccagggacaccccctgctgctgcctaagagaaagtggcccaagaagcactggcccggtgcctgctgatgccaggagccctctgctactgcctgacacaagcatcc

SEQ ID NO: 18240 - DNA, 293 bp, Homo sapiens
cactgctctggccaatgggactgtgcaagcacccaagcagaagggagactgagtgcctcagcctctcaccccctcctcctcagggcagcgctaggggcctcccctatgcctcagccccatctctgctcctgtttgaattttgttattgttgtttggttgttgtttttttaagttgattttaattttttgtttggttgatttttttgtaaaaaactattttatatataaatataaatctatatctatatctattaaraaaacaacaacaacaacaacaacaaaaaaaaacaaaa

SEQ ID NO: 18241 - DNA, 402 bp, Homo sapiens
  misc_feature 193,198: n=a, g, c or t
aagcaaaatctaggtgctgcaagaaaagtcacagccttggggtttcagtgaagagacagcccaaatctcttgaagtagtcagaaaagtctayaggtgtgactcccttatgccgctctctcctgccatttgggcaacagccaacttccgaggccaaccttgtttctggagaagcattcttcccacattggaaangcaangatggtgctgagcctgataacttataaatccttgcattcaagcctcatgctaagatgttgaaaaacatactcttatccccaatttacaaatgaagaaatggaagtcaagacttttcccaaggccaccaaactggttaagtggcaagtacttaaggctcccaagttcagcaatgtttctaatagactcagaaatgtaaaattaac

SEQ ID NO: 18242 - DNA, 413 bp, Homo sapiens
aagcaaaatctaggtgctgcaagaaaagtcacagccttggggtttcagtgaagagacagcccaaatctcttgaagtagtcagaaaagtctacaggtgtgactcccttatgccgctctctcctgccatttgggcaacagccaacttccgaggccaaccttgtttctggagaagcattcttcccacatggaaaggcaaggatggtgctgagcctgtctgcctctgtgttccctggacaactccattccagtgcaagattctcatggttgaattcatattttaagtgctgtttgtggggttttgagcagttgccattctgaggaggagcagaggagcatggctttgcaaagtgtctcccaattatgagcaccatctgcaagagtccacttggaaaatactcaaggaccagcaagtt

SEQ ID NO: 18243 - DNA, 396 bp, Homo sapiens
aaaaaatctaggtgctgcaagaaaagtcacagccttggggtttcagtgaagagacagcccaaatgctcttgaagtagtcagaaaagtctatagggctgtcggcttgccacatatgcagcccttaagcaaagtgggagcagttagtggtggcatcaagaggacagccacaggcagagccctcagccttttgctgttgactctccacaaccccctcttcttggaggcagatccttaaactgatgcctcaaaatatttttaaaagcgcaaccaaatatgaagacctttcctggctgccgggccttttctgtcctgttaattttgcttggctttaaaagagtgaagaatcaatgtctagcatttccaatgaccagtgtgactcccttatgccgctctctc

SEQ ID NO: 18244 - DNA, 509 bp, Homo sapiens
gagtgcgcccttctcgggtcccctaggtcgcggggcagccggggcggaaggggcttgttcattattttgagagtttgttgtgaacgtcataacctttcgtccttaaatattgccgatacttgacctacgcaagagacaatgtcatgtgattcagcctaatatctcagaggatgcagcattcaaggttctatcttggaagcagagactgtgccctcaccagatgctgaacctgctgagcaccctgatcttccacttcaccttcatcagaactactggggctgtggctgagatgtcacatggcagataggatcacaaatttctgttgtatctggatggagatcagcaggaggatctatggactgctgtgattgcacctgccatcttatgcagaaatgacctgaagacagactgaaacaacgtgttctacagcctgaaaatatctaccttgacttacagttttattaatgctggtgtgatcagactggacaaaaattagcatatgttattaa

SEQ ID NO: 18245 - DNA, 418 bp, Homo sapiens
aaatttagaagctctgtatcagaaactagagtcaaaggcaaaatattagaacaaaagatactcctagcacacccatcacttgggaaattacaaaggttttagaagctctgggccaggaacccaggatgaagactcagtacaggttgagtatcccttatccaaaatgcttgagaccagaagtcttttggatttcagattgttttggattttggaatatttgcattatactggttgggctgccctaatccaaaaacatgaaacctgaaatcctccaatgagcatttcctttgagcatcatgttggtactaaaaaagtttcagattttggagcactttggattttgaattttcagattaaggatactcaacatctatgtatttcttgttatagctcatatcacagctataagtttaaaagc

SEQ ID NO: 18246 - DNA, 540 bp, Homo sapiens
actatcacttaggaaattacaaaggttttaggaggtctgtggcagaaactgggtgccagtctgatagcatcaatttctctcagtatttgtctgtctggaaaaggtgaaacagtcgcaaatggaatttcaagaaacattctatatacactgcctctaggactgggacagatagccactgagtacctgcttcaaatcaccctgcacgttttctctttggaaagataagcactggagaaccatctcgttaccttcagcagaaatggaaacaaatcaagacattaagaatgccgcagtggacagcagttatgcaaggttcagcagaagaagttttcaagatggtgtgcctcactagccagaaatcagaaaagatcgaagctagccttttcatctcagctgctccttaaatcagtgcaacccctccaaattaatgtgaattgaaacttgcattgcttttcaacttaattgaatacttactatatgtgaaccactgcacaaaatatgggaagaagatgtgggagacaaagatgtggagctgtcttc

SEQ ID NO: 18247 - DNA, 150 bp, Homo sapiens
actcggcggccgcggcgcgatggaggcgccggccgagctactggccgcgctgcctgcgctggccaccgcgctggcccttctgctcgcctggctactggtgcggcgtggggcggccgcgagcccggagcctggagagcccgcrgggctggg

SEQ ID NO: 18248 - DNA, 148 bp, Homo sapiens
atttattggataccggcttttcatggggccgagcgccgctgggtaggcggaagtagccgcacrtggggcggcggctatgsttgctctgctcgtcctgttgctccskggcccggcggctggtgccttgcagaacccccacgcgacacct

SEQ ID NO: 18249 - DNA, 383 bp, Homo sapiens
tatatattaattgacaaatattaaaaccatactaaagttagctatgtggaaggatggccaatagtttagtatcattgttacattaagaatcacaaatagctggcacggtggcttacgcctgtaatcccagcactttgggatgcctaggcgggcggatcacctgaggtcaggagttcgagaccggcctgaccagcatggagaaaccccgtttctactaaaaatataaaattagttgggtgtggtggcacatgcctgtaatcccagctactcaggaggctggggcagtagaatcccttgaacctgggaggcagaggttgcagtgagccgagatcacgccactgcactccagcctgggggacagggcaagactctgtcacgagaaa

SEQ ID NO: 18250 - DNA, 472 bp, Homo sapiens
ctgttttatgtgtgcttcccagtcctgtggtgctgctataccggggacgttgagtcccacagacctggaaattgcggcccctctttctcaacccagagcaaattgagacgtccgggtgagagtccgtgagtcccttcgagtttaaagtggccctgaggcaggtcccgtcctcggtctttctgcagtggggtcgtgcagacacctcctatcgcggaattttccttctcaaaacccttcctgacctgtcctcccgcctcgcgctgtttcaagtcctcacccgcgagctggattccagccctaggcgcctcccaccgtcgctctcggcggcttcaggagcgccgcgcctcaaccccggttcccgggaggccgcgtcctctgcctggtcctaagatcctgcagacgccacccctgtccgaagctccgtcgctccccacctccctccttgtgcggtgttgctacctagttccaactc

SEQ ID NO: 18251 - DNA, 581 bp, Homo sapiens
aataatttgttctagggctatggagatgctcataaaggattctcattcctattgtaagccagagagaatgcaatccaatgcaatgtttcgatcatggagtctttattggacacaggctggcatgagttgatggcacctgaaaatcagcaagctacaaatgctcctgggaggaacagcatcttcagtctctaaaccttggtgcagctgagtttattagaggttttccagaccttaacaagagcctgtgacagtactaagaccctggggatggtgcgaaggagtctggaaccaggaggctgctgcgttttacaggatactggagcccagttctcaatcaaacgctagagctcagaaagacatgcctctcagatctgtctacctttaagcatttttttaattaataactggatattgaccattaaaaccatcacaggtataggagtttgttgactaaaatttgtattatagatacaactgaaatgtttacaaatctttataagaaaatcattactacttgggtcagaagcatgcaagtcaagcttaggtctatggkttttgctctgatcagtaatatgtagatg

SEQ ID NO: 18252 - DNA, 414 bp, Homo sapiens
ataatttgttctagggctatggagatgctcataaaggattctcattcctattgtaagccagagagaatgcaatccaatgcaatgtttcgatcatggagtctttattggacacaggctggcatgagttgatggcacctgaaaatcagcaagctacaaatgctcctgggaggaacagcatcttcagtctctaaaccttggtgcagctgadtttattagaggttttccagaccttaacaagagcctgtgacagtactaagaccctggggatggtgcgaaggagtctggaaccaggaggctgctgcgttttacaggatactggagcccagttctcaatcaaacgctagagctcagaaagacatgcctctcagatctgtctacctttaagcatttttttaattaataactgggatattg

SEQ ID NO: 18253 - DNA, 429 bp, Homo sapiens
ctggtgcagggtttacctcggctccctcgggacgggttccgtgcagctcctgcttcctcccttctctttcccagtgccatccctggcgagggggaaaaaaaaaaacacggcmaggagayttcccacccctgctttgctatttttgtacctccgtgacagaaaaacaaaaccctgaggaaaagtcaggcgacttcattccctgccgtccgcgccggggcctcgactactgctggcgtccgcggctttcgcccgccgctccacaggcgagttttaagagatttctcacaattgtcaagtccgcaagtctccgtgcgtttgcttttatttgggccgtgcgttcaaatccgctcataattctttctgaccctcagaggggccctgaagtaggtgacaaatttgccttggatccaactgggtggttttatgatc

SEQ ID NO: 18254 - DNA, 513 bp, Homo sapiens
accaaatgaattgctattcaagtatctggtgcctggttgtacatgtttctaagggcaaatttcctaagccccctttcctcaaatatttcacttgtgcttattcagtaaatctaacaaaataaggatgcttttgagctattgattggtgcaaatgtggcttaatagcagaatcattacttttttaatcttggaactgccagctcttactattttcaactgaatttcgagtggtttgattacagcctgccattactaattgtttctaaatttcatggaacatatcttgtttaggaagttttcttcttttggcaatactttttcttttttttcttaaagtctcagttttcacaactttatctgctcagacttatgggcctctctttttagatgtcttaatcttgaagcaggaaaagtcagaacttgtttgctcactcagaaaaatgtggcctcgttgactcctgaataaaatataattttgggtcaccatccccatttgctcagtagcattaaagt

SEQ ID NO: 18255 - DNA, 407 bp, Homo sapiens
agtatggcccggcacgtgttcctaacggggcccccaggagttggaaaaacaacattgatccataaagccagtgaggttttaaaatcctctggtgtgcctgttgatggattttataccgaagaagtcagacagggagggagaagaataggattcgatgtcgtcacgttgtccggcacccgggggcctttatcgagagttgggttagagcctccacctggaaaacgtgaatgccgagttgggcagtatgtggtcgacctgacttcttttgagcagttggcactacccgtcttgaggaatgccgactgcagcagtggcccagggcaaagagtgtgcgtcatcgatgagattgggaagatggagctcttcagtcagcttttcattcaagctgttcgtcagacgctgtctac

SEQ ID NO: 18256 - DNA, 153 bp, Homo sapiens
  misc_feature 46: n=a, g, c or t
aacctggactgckcccctgaccgcaacccctasscscgcccaccantatggcccggcacgtgttcctaacggggcccccaggttagagcctccacctggaaaacgtgaatccgagttgggcagtatgtggtcgacctgacttcttttgagcag

SEQ ID NO: 18257 - DNA, 438 bp, Homo sapiens
actagcgcggcggccgccggcccgcaatggtgctaccctggttgctgctcgagactgcgcgcagggcggtcctcgggtccgcggaggctgcgctctgccatgaaaatgacagatgaaaatagaaaagtgtggctggtctgaagtggatgaagtaggtgaagctctacagatgaatccaagagacttcaaagagaagtacaatgaagtaaaaccatccaaatctgacagctagtgttttcttatttagccggagtgagaagcaagaaggccctggacacagcaatatctctgggctttcacagagataatagcggccaggcgtggtggctcacgcctgtagtcccagcactttgggaggccgaggcgggtggatcacgaggtcgggagatcgagaccgccctggccggcatggtgaaacctgtcactactgaagataca

SEQ ID NO: 18258 - DNA, 341 bp, Homo sapiens
actagcgcggcggccgcggcccgcaatggtgctaccctggttgctgctcgagactgcgcgcagggcggtcctcgggtccgcggaggctgcgctctgscatgaaaatgacagatgaaaatagaaaagtgtggctggtctgaagtggatgaagtaggtgaagctctacagatgaatccaagagacttcaaagagaagtacaatgaagtaaaaccatccaaatctgacagctagtgttttcttatttagccggagtgagaagcaagaaggccctggacacagcaatatctctgggctttcacagttactatgagaggtgtgttaaaatctctctctgaaaaaaa

SEQ ID NO: 18259 - DNA, 496 bp, Homo sapiens
caggatgatagattaaaaaggaaacgagaaagtgaaagaacattttctaggagtggttctatatctgttaaaatcataagacatgattctagacaggatagtaagaaaagtactaccaaagatagtaaaaaacattcaggctctgattctagtggaaggagcagttctgagtctccaggaagtagcaaagaaaagaaggctaagaagcctaaacatagtcgatcgcgatccgtggagaaatctcaaaggtctggtaagaaggcaagccgcaaacacaagtctaagtcccgatcaaggtagtatactttttaaagtattttgtctgatttttaaaaaaaattgactgaatttattcaaagttgaaagtgtcctttctctctctctttaataaactcagtttggtacttgataaataatcatagtcttaaatgttagaaatcctatataatattatttatttaarattgcagatttttaatttaaaatacatttttat

SEQ ID NO: 18260 - DNA, 467 bp, Homo sapiens
catttatgggattttgtagcctttgggttctccattcttaatgtggttagagaagccctttcaaataaaaatttactaatttaaattttacagttaacctggtgttcacaactaacataatcctggggttactgctgactgtagcattaagacattggcaaataacataacctgtctttgtgcttgccttttatctataaaaccaggataatatgtccctacttcagagggatacaacctctgaatgtaacctctctccctacaataacattttttgattagagataaaagaatattaaacagaacttttagttcttcagaaggaaggtactatgtttataaaataatcagtgctcattttcatttagcctgaaggtggggtcgctttttaaaaaggattattaacctactaagaaaaattgtgtttcattttaaatgttagaaagcaacttttcagaaaaacttga

SEQ ID NO: 18261 - DNA, 577 bp, Homo sapiens
tttagaaagataaattaggtaatgtggctttgtgtatgcagtagagttaatatgcttttattcacctcatggtttctatgtcattaccacctgttggtttttattttttaatggaaaacttgaacttctccaaagtgactagttttaaaataacatttatgtaaggattgtttatacagagaaattgaaaaccagaaggtataaagacaattaaaattatctaaaattctactagttagaagtaactactattaatattttgttctatatccttccaatattttttcatatgtattttttttacatagttggaattgtgcatccatattattttgtaatatgttttattatttaatatattatgaaataaatgtttgtgatttaaaaaatcaatatagaatttcagtgtacaggtgtgctattatctgtttaccattctgtgttgaaggtcttttaggcagtttgcaattttgggatattgtaagttgatggacatccttatacattaaaaaaaaattatatggctgattatttcattacaataaattcctagaagtagaattacttaaaagatata

SEQ ID NO: 18262 - DNA, 430 bp, Homo sapiens
  misc_feature 23,28: n=a, g, c or t
accatccgggtactctaagtccncccdnccccttctccttcacccccaagtgtctccsacgastgccctccccgasstctagctgascatggcatcagaggsagaaaaaacattccatcggtttgctgcgtttggagaatcatcaaccagtggcactgaaatgaacaacaagaactkctccaagctgtgcaaagactgtggcatcatggatggcaagacagtcasctccacggacgtgagcatcgtgttcagcaaagtcaaggccaagaacgcccgaaccatcacgtttcaacagttcaaagaggcagtgaaggaactgggccagaagcgcttcaaagggaagagtccagatgaagtcctggagaacatttatggactcatggaggggcaaagacccagccaccactgggcgctactaaagcaacaacag

SEQ ID NO: 18263 - DNA, 445 bp, Homo sapiens
accatccgggtactctaagtcctccctcccccttctccttcacccccaagtgtctcccacgactgccctccccgacctctagctgaccatggcatcagaggcagaaaaaacattccatcggtttgctgcgtttggagaatcatcaagcagtggcactgaaatgaacaacaagaacttctccaagctgtgcaaagactgtggcatcatggatggcaagacagtcacctccacggacgtggacatcgtgttcagcaaagtcaaggccaagaacgcccgaaccatcacgtttcaacagttcaaagaggcagtgaaggaactkggccagaagcgcttcaaagggaagagtccagatgaagtcctggagaacatttatggactcatggagggcaaagacccagccaccactggcgctactaaagcaacaacagtgggtgcagtggaccgc

SEQ ID NO: 18264 - DNA, 551 bp, Homo sapiens
aagaaaaaggatttgaaaagcaagttaaattttatgagtagatgttggttttaagtttaacatcttctctctagagaaccaacaacaattacaacaaagggtttttattcaagaagagaaatatatactactatggtacttggtttaaagtccaatttattaaattcctatatctgataaaagctttgaaaaccaatttttgttcagatgctgattatacatttcattaattaaattccctcaagtaattttaactgtagttacaaatttagtatggttgattcttctgaatatatcgagcatgttaaacagcaattcatgtacaaaaacaaatcaagattcccgatgtgaaaaagaagattcacagattcacatgtcatctgttccaagggagatcaacggttgaaacactatagaaatcagagattgttagggtcagtaggctgtactaggatggcctactgtagtatgctctcctcaaaaaaaaagattatgacaaaatgcactgtttttcaatgagaactgctgaaagtggggctaggtgagaagtt

SEQ ID NO: 18265 - DNA, 513 bp, Homo sapiens
gaaaaaggcaaatgatagtacacagtggggcattgggttcaaacctacacagttaggctctaggctctagccactgtgtagcttgacctgttgggatatcagagttaaaacttaagtattagaggatagaaaagtaagaggagaatttgaaaaagtatctaatattggaaaaatagggtaggacacctgggcagagggaacagacataaaaataagaataattgccatgtcctagataattagaggttagcaacccaataagatgaaacagtaggagactgaagaagctggaaactctatgagagaggtaaccagtaattcctatatgatagatggctaccactgaattaggttgactgtgcaaggcaaaccctagcataacaggcctcagctgtaatggataaggacaccttagcatctccaatcgataggaaagaaagggcatagcacccaggaaattattctccatcgtgactcaccaatgaggcaggggataggggagaggcaggggat

SEQ ID NO: 18266 - DNA, 546 bp, Homo sapiens
aaaagtcatctatgtttcctgataaaggggacaattatttgccatggcactaagatgtgtcatctttgtgaatatgatctagaagaaaaagcacaattatttaaatatggcccattttggtttctgatagatttgtttgacaccttttcttattttgaggtgtagtatgcttccatgtacctttccagtataaattcaggtcctaccatctggagtgactcaaagtaaggttggacttcttttggaagacaaaaacaaacaaacaaaaagcaaaaacaacaacaacaaaaacaattattcaaatatttgaagataaatattgctgcgaaaggccatcatggcatgttcatcatatggcatcccctgctatgtctcttcctggttgggaggaaatggggtccttcacctgctgcccaagacgggtgcgtgcaagtcatctcctgtgtcgactgtgggacgrgacccgctgatcataagaaactgaactgatactcactgttgaactgggctttctctgtttcttctatatgatagtaaagcattgtt

SEQ ID NO: 18267 - DNA, 476 bp, Homo sapiens
smacctgataagcctggcagaagcytgatgaacccagaatgagtgagatgtggtaagttgtgctttaggttagggcgtcatctaactgttgggccagaaaatttaaaggggagaagtgcatcctaaagggagttgcagtttcctcggttctggtaggactacaagtcccaatatgcaccgctcccccgggcgacctgagtgtctcttgagtaaatgtgacccttgaaacgtctacgttagcagcttaatggtttctccagccttgcgcgtgtttccaagtccctaaacgggatggtttttgaaaggctcgaacacttgacaagtaggaaagtggtattttcttagcctaagttatcttaacacgtgatttgaaatagtgctggtaataacaacacaccagccctgcattgagcgtttgttttggaaaagaacctaggaattccagaatgatcagagtcacagctacaaactgagat

SEQ ID NO: 18268 - DNA, 106 bp, Homo sapiens
agaacgccgtgcgtttgagcttgaacctgataagcctggcagaagcctgatgaacccagaatgagtgagatgtgtttctaaaaaaaaataagagagaaaggatggs

SEQ ID NO: 18269 - DNA, 403 bp, Homo sapiens
accaggaagggaggaagcggcagagggggcagcggctggggataccggccgggaggtcccctgtcgaaaagggaagccggtgtgctgggtgcttagggcatgttccgggacacgctcaggccagagccttgctggatgtgcccttggtgggacttgggatggaaacccagacgttttactcmscgmtctgagcacatcgctatccctccsccccctcaccaggctgctgaataacgagggatcactgctggcctactctggttacggggacactgacgcccgggtcaccgctgccatagccagtaacatctgggccgcctacgaccggaacggaaccaagcgtttaatgaagacaatctcarrttcatcctcatggactgcatggagggccgtgtagccatca

SEQ ID NO: 18270 - DNA, 270 bp, Homo sapiens
taatcccaacacagagaggctgaggaaggaggatctcttgagcctaggagttccaggccagcctaggcaacatagggagaagggagaccctgcctctattttaaaaaagaaaagaaaaggagtgtggcttagagagaggtgtcagatctgccagtctttgtgatcacctggggaaagggagaagtcactgawggtgttcaggtctctggtctctggatagctaggaggagaagggacagtaaagtccttgaaaaggaaawatgggggcca

SEQ ID NO: 18271 - DNA, 385 bp, Homo sapiens
  misc_feature 84: n=a, g, c or t
agacttaagatggcggcgtttgcacggagtgaatcactgcgtccttacgggggttgcaaggcgtccgaagtatgagtccactancaaaagtccagaaactcgccagttaatagtattgtgtctcttcaaaatatcggagaataatttctttctcgctgatcgcctaacttctactgacgaagcttggaagttgcagaaggttggagtgcaatggcgcgatctcagctgactgcaacctccacctcctggattcaagctattctcctgcctcagccagccgagtagctgggattacaggcatgtgccaccgcacccagctaattttgtattttttagtagagatggggtttctccatgttggtcaggctggtcttgaactcctgac

SEQ ID NO: 18272 - DNA, 318 bp, Homo sapiens
gacttaagatggcggcgtttgcacggasrdttccactgcgtccttacgggggttgcaaggcgtccgaagtatgagtccactaacaaaagtccagaaactcgccagttaatagtattgtgtctcttcaaaatatcggagaataatttctttctcgcgtgatcgcctaacttctactgacgaagcttggaagttgcagaaggtagctcctaggagggatatatgggtcgtttctttcctttttccttatttaaatgggtttttattgacaccatgtcgcgccaaaatggattccatctcctcagagctttcctaggaaca

SEQ ID NO: 18273 - DNA, 387 bp, Homo sapiens
ttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacattttwaaatgtgattayctaatttttacaacactgggctattaggaataactttttaaaaatwactgtsctgtataaatatttgaaatycaagtacagaaaatatctgaaacaaaargcattgttgtttggcmatgatacaagtgcactgtggcagtgccgcttgctcaggacccagccctg

SEQ ID NO: 18274 - DNA, 169 bp, Homo sapiens
ggcgacgactgcagctcgggaggtagcggcctggcgagggacgggccgtctgccctctcggacggccgcggcggagggcaaaaatggcggaggcttcggcggccggggcggactcgggcttcatcctgcacaataaactccggaagcaagtaaaaaaaaaaaaaaaaaa

SEQ ID NO: 18275 - DNA, 592 bp, Homo sapiens
atttaaaaaacatttttagtgttatgaatgtgtacttgaggaactcttatacaatccattatattgaaaaggaaatacaacattatatttaagattatacttaagatatgatgactctaaagtggccaaagtcccctttgtcaggaacactgaataatttcagcctgcatcagactttttacatgcttttaatttgaaagtatttataatattctgaaaaaaccatcagccactaagacattgagaaatgtcgagtttttctggattttattccataccttgatatgagccatgaatgaataagacaaatgactatactttttactttacaagaaaacaaatctgaacgttttagcccttgatttttacagaccamacccaaaaacctcaaaaaaggctctatgagctgctaaatacatttttggagattcactattctgtttagaaacaaattccacagccaccccaaactttcagcaaccgccaccctgatcagtcagcagccatcaacatccaggcaagaccctctactaacaaaaaaacattacaacttgcagaaggctcagatgattcttagcattttttagcaata

SEQ ID NO: 18276 - DNA, 453 bp, Homo sapiens
  misc_feature 174: n=a, g, c or t
atttaaaaaacatttttagtgttatgaatgtgtacttgaggaactcttatacaatccattatattgaaaaggaaatacaacattatatttaagattatacttaagatatgatgactctaaagtggccaaagtcccctttgtcaggaacactgaataatttcagcctgcatcagnctttttacatgcttttaatttgaaagtatttataatattctgaaaaaaccatcagccactaagacattgagaaatgtcgagtttttctggattttattccataccttgatatgagccatgaatgaataagacaaatgactatactttttactttacaagaaaacaaatctgaacgttttagcccttgatttttacagaccacacccaaaaacctcaaaaaaggctctatgagctgctaaatacatttttggagattcactattctgtttagaacaaatt

SEQ ID NO: 18277 - DNA, 204 bp, Homo sapiens
tattgattacaaagtttttcttctttaaccaaaaaggaaagacaacggtttgtgtgcacttcccgacatacctgtgtcttcgtgtgcctgccttccctccctcctccccaccgggccggactgtacagagccctgctgcggcgtgttaggaatgacctggaattgtcaataaacagatgctgctgtcaaaaaaaaaaaaaaaaa

SEQ ID NO: 18278 - DNA, 371 bp, Homo sapiens
gcttttctacgtggttcggtactgctggctacgcaggcaggcggccctgcagaggaggctcagatggagtctcattctgtcacccaggctggagtgcagtggtgcgatcccggctcactacaacctccgcctccctggttcaagcgattctcctgcgtcasgtcccgagtatctgggactacaggctggagtccaatggcgctatctcagctcaccgcaacctccacctcccaggttcaagcaattctcctgccccagcctcccgagtagctgggattacagtgctcaatggtgccccggctggagtgcagtggcatgatctccgcttgggcgacagaactagactctgtcccaaaaaaaaaaaaaaaaag

SEQ ID NO: 18279 - DNA, 365 bp, Homo sapiens
  misc_feature 11: n=a, g, c or t
agcgggacggnagattggagaccagcagcagggagctccaagccgcggagtatttggaaaagcatcagatcaaggaggtggttagctacctcaccagcgccctccttttctttcggccgggtctaggaagtatttttcttatttttcctttacctatatcttttctggaaattattattggatattggacatcttggcttgattttctaatttactttacatcttgatatgttgtataatttttatcagaagaatgcaatttatgaatctgcagattctcttgagaatttaccaaattgttattttgatgctcctcactgacttatacttacatttcctgtcttcattagtcgttctttatggaa

SEQ ID NO: 18280 - DNA, 397 bp, Homo sapiens
ctatttagagcacgtttccctgagtagcctcatggcttgttcccgcatcaccttgagatttttgatcagatgttacttttgggcctgttatggtggctcacacctataatcccagcgctttgggaggccgaatggggaggatcacttgaagccaggagttcaaggctagtcgggcatcatggtgagatgctgtctctgtgaaacagcaacaacaacaacaacaacaacaaattagccaggcatgatggcatgtgcttgtggtaccagctacacaggaggctgagtggggaggatcagttgagcccaagaatttgaggtggcagtgagctatgactgtgccactgcactccagcctgggtgacagagcaagaccatgtctctcaamaaaaaaaaaaaa

SEQ ID NO: 18281 - DNA, 327 bp, Homo sapiens
atttacttcctgcgggtgcacaggctgtggtcgtctatctccctgttgttctycccatcggcgaagatggccctggagacggtgccgaagacctscggcatctgcgggcctgtttgctgtgttcgctggtcaagactatagaccagtttgaatatgatggttgtgacaattgtgatgcatatctacaaatgaagggtaaccgagagatggtatatgactgcactagctcttcctttgatgggtaactttaagccaggtgtatatgcggtgtcagtcactggtcgcctgccccaaggaatcgtgcgggactgaaaagtcgaggagtgg

SEQ ID NO: 18282 - DNA, 438 bp, Homo sapiens
gtattagtccgttcttgcattactataaagaactacctgagactgggtaatttataaagaaaacaggtttcaatgactcacagttccataggctgtacaggaaacatgtctgggaaggcctctggaaacttatgattatggcagaaggcaaaaaggaagcaggcacatcttcacatggcagagcaggagagagagcaaaggtggaagtgctacacacttttaaacaaccagatcttgtgagaactcactcactatcatgagaacagcaagggcaaagtctgctgccataattcaatctcctcccaccaggcccctcctccaacattgaggattatcattccacaggagatttggatggggacacggaaccaaaccatatcgactcctgaatctaaaataaaagttgaaattatagaaaagaaaaaaataaaaaactta

SEQ ID NO: 18283 - DNA, 559 bp, Homo sapiens
tttctgaaacccaatctggggacagtgcagactaaataaaatttcattttgatttggcctcccgctgcgaatgggactgctttgtctcagccgacagaaccagcaagccagaaagggaatgaagacatttggagaagaagcgtttactgaaaggagattcctgggctggaggaaaaccatgatctacagttcatgttgacagatattgtatttttggtcctagatctgacttttgaaatgacttatcacaaattcaaatttagcaatcatgagtgaagtacccacgatgtgctaagcatctacctctgcagatagaagaacacttactgttcctgagcatgggagggaatagaagttcctgggtcctggcctcacctcatcaggcactgccaaatttgacacctccttcctgttcacggcagtcctttgcgatagggtattagatgccaccaagtagctgcataactcacccatttggtcagagcctgggtctaagccaggtctgacagactccaaagcaagccctgtttamaggcatgactgggatccagtggacgag

SEQ ID NO: 18284 - DNA, 363 bp, Homo sapiens
catgttggggcatactcattaggattgagtgctttcttacaccaaaatacatgtatacaaagatttaaaacactttcggccgggcgcgttaatcccagcactttgggaggccgaggcgggtggatcacaaggctaggagatcaagaccatctggctaacacggtgaaacctgtcgctactaaaaaaatacaaaaaattagccggacgtggtggcgggcgcctgtggtcccagctactcgggaggctgagacaggagaatggcatggacccgggaggcggasttgcagtgagccgagatcaccccactgcactccagcctgggcgacagagtgaaggctatgtcccaaaaaaaaaaaaaaaaag

SEQ ID NO: 18285 - DNA, 446 bp, Homo sapiens
aacagcgaggcgccggcccagactccactccccagctgtgaaaggaggagctctacggtgacttctgaagacttggaaacaggggacgtgcacaagggaaaatcgggccccgatactcagaatgaagatgtagagaaacaaggaagaaattgaccctgacgaagaagaaagtgccaagaaaaagcatttggataagaagagaaaattgaaggagatgtttgatgtggaatatgatgaaggagaaagcacatattttgatgatcttaaaggagaaatgcagaaacaagcacaggtaacagcatacaggtttcccccccccaccccgtcatgtacagctgaatcatgcagaatttgaagatcaagatgatgaagccagagttcagtatgagggttttcgacctgggatgtacgtstgcgttgagattgaaaatgttccctgtgaattt

SEQ ID NO: 18286 - DNA, 355 bp, Homo sapiens
aagaggcgcacaggagacctcaggcccagactccactccccagctgtgaaaggactgctggccagacccccaagctagcccgccagcctccatagagctgcccagcatggctgcatccagtaccaagagttggtgggagacgggtgaggtataggctcagtctgcggccaagactccgtcctgcaagtaaggtcccctccaggggcaaggctgggctgcagagccagcactggggagtttagtagcaggccaggtttccttgttaagacaagcgtgggactgtccaggatgaatgtgggcagacagaaccctgaggtattgcagtagggttgggttcacccttgctggttgtaga

SEQ ID NO: 18287 - DNA, 458 bp, Homo sapiens
tttttcgacgctggcggtggacgcaggcagcatggaccacggttgctgggcggatggggagcgtctatggtcagttcctagaactttcctgcttcaggacccgaagtgcacattcaagaatgcaggaggagtgatctcctgctgtgggcacagttgccttagaagtggtgagatgggaagctgcagttggaagaccctggaggatgcctgacaaggggatgtctgacacatgattggagctctttttgaaatgtttcttgcccttcctggagcagaggagccattatttatgcaggtacatcgaagtcttttgacctccatacagtgattatgcttgtcatcgctggtggtatcctggcggccttgctcctgctgatagttgtcgtgctctgtctttacttcaaaatacacaacgcgctaaaagctgcaaaggaacctgaagctgtggctgtaaaaaa

SEQ ID NO: 18288 - DNA, 433 bp, Homo sapiens
tttattaagttccctctgtatgcagaatattgtgcaacatggttatgggtactacagtggatgtgagtgtgtagaccttgtacaatagagcttataggctaatgagaagacaggaagaaacaacaggaacacatatagctggaatgcagatgggatctgtgctacttacgctagccatgggatgattagaacaagataagagacatgaggaagacttcttcaaggaggtgctcaagccatgttttggaaaagagaactcaaggtctggcagggagaaaggagcaagggcaagtagagctgcagctgtctggcgccactgtaatgctgtctcctcctctgagtgagttcatcctggaaacattttctcccataagacatgcacaggtcttacgtttacatgtttcactgaaagaaatttgattccactgctggg

SEQ ID NO: 18289 - DNA, 418 bp, Homo sapiens
aagcgattcatcgggccgcgagcgccctccccgtcgttttccgtgagagacgtagagctgagcgacccagcccgcgagcgaggtgagatgccggtggccgtgggtccctacggacagtcccagccaagctgcttcgaccgtgtcaaaatgggcttcgtgatgggttgcgccgtgggcatggcggccggggcgctcttcggcaccttttcctgtctcaggatcggaatgcggggtcgagagctgatgggcggcattgggaaaaccatgatgcagagtggcggcacctttggcacattcatggccattgggatgggcatccgatgctaaccatggttgccaactacatctgtcccttcccatcaatcccagcccatgtactaataaaagaaagtctttgagyaaaaaaaaaaaaaaaaaa

SEQ ID NO: 18290 - DNA, 368 bp, Homo sapiens
agagctgagcgacccagcccgcgagcgaggtgagatgccggtggccgtgggtccctacggacagtcccagccaagctgcttcgaccgtgtcaaaatgggcttcgtgatgggttgcgccgtgggcatggcggccggggcgctcttcggcaccttttcctgtctcaggatcggaatgcggggtcgagagctgatgggcggcattgggaaaaccatgatgcagagtggcggcacctttggcacattcatggccattgggatgggcatccgatgctaaccatggttgccaactacatctgtcccttcccatcaatcccagcccatgtactaataaaagaaagtctttgagttaaaaaaaaaaaaaaaaaagc

SEQ ID NO: 18291 - DNA, 387 bp, Homo sapiens
  misc_feature 356: n=a, g, c or t
gttttccgtgagagacgtagagctgagcgasccagcccgcgagcgaggtgagatgccggtggccgtgggtccctacggacagtcccagccaagctgcttcgaccgtgtcaaaatgggcttcgtgatgggttgcgccgtgggcatggcggccggggcgctcttcggcaccttttcctgtctcaggatcggaatgcggggtcgagagctgatgggcggcattgggaaaaccatgatgcagagtggcggcacctttggcacattcatggccattgggatgggcatccgatgctaaccatggttgccaactacatctgtcctttcccatcaatcccagcccatgtactaataaaagaaantctttgagtagtcgaaaaaaaaaaaaaaaaa

SEQ ID NO: 18292 - DNA, 354 bp, Homo sapiens
aaataaggtggttctataatcagctataaaactctaacaggtgctcttgaatgcgggtttctgataactttggagactgtgtatcaaaatagaggaaaaactttcaggactcatggacagctaaaatgttcatgaatatcaagaagaacaggaatatactacatggactgaactaatctttttgacttttttgcttaaaacgtttgctgatcctttgttttgtwtttcagagtcktaatacctttatyttatgctaktgacagcttctaacaactcagtatactcctatgaacaaaatttggagcatatttgtwtcwctctacctgatttcttcagactgtggaaactatttga

SEQ ID NO: 18293 - DNA, 439 bp, Homo sapiens
aaaaaggaatgaactatatggactgaactaacatttttgactttttgcttaaaatgtttctgattctttgttttgtttttcaggtctcaaaacttttctttkggagttattgatagcttttaacaatttattttactcctaaggacaaaatttggggcatatttgtttctctcgacctgatttctgcagaatttggaaactatttcatttagtggtcctgaacagaaagtggaaagacacagcaattcaatccccccaattttggggatctgctgtgcacactaggttctttcttaatccctgctgaggaacttgagaagcagcagcagcaccaaaaccaaggcatgcaccggattcaaggttctttttgttccagttgtcagattccaaactagaccccaatgtattgcaagtatgaccaaataawaagccctgttta

SEQ ID NO: 18294 - DNA, 400 bp, Homo sapiens
tcttgtgatggtggctggcattttgctcactccttgtaccccttaggtaagaatcacatgggcagatgacaggtaggttctgtgaagagcaaaattgaaatggaggctgggtgcagtggctcacacctgtaatcccagcactttgggaggccgaggccgaagatcatgaggtcaggagatggagaccatcctggctaacgtggtgaaactcgtctctactacaaatagaaaaagttatccaggcgtggtgtcatgcgcttgtagtcccagctactcaggaggctggagcaggagaatcgcttgaacccagaaggcagaggttgcagtgagccaagatcgcaccactgtactccagcctgggtgacagagcgagactccatctcaaaaaaaaaaaaaaaaa

SEQ ID NO: 18295 - DNA, 340 bp, Homo sapiens
agggcgccgccgtgacagattagtcctaaagggaacggggttgttagttcaattggctaccggaaaaaaccaggctgggctgggcgccgccatgacaaccgataccggaaaaggcgggtcgttccccccggacagccctacgccggcaaaggtctcgagatgcaggcggccctagaggtcaccgctcgctactgtggccgggagctggagcagtatggccagtgtgtggcggccaagccggaatcctggcagcgggactgtcactaccttaagatgagcattgcccagtgcacatcctcccagtgagtgcgggcaagtatgagacagtgtggggggtggs

SEQ ID NO: 18296 - DNA, 465 bp, Homo sapiens
attttcgcaatggagcacgaagaaatttacatctgagtcccagggcaagcggactgcaagcaaacactgccaataaaaatggcaagaattatttcattaataaattataatagagactcaaaacctgctactgccaggcaaagcaggtttttagcccatgttgtgtaatgtcatacttgtagaggcacccacacccttggagcccaaaaccatgccatgacatgtaaccaaccagctacatgtgaagatcacataaaggtgttcttgtcctggctctagctaaggttccagctctcagtcagcatcaattgtggaagatgggagtgcatgagcttttagatgakacagtcccctgcctttgacaccaagtggaactgagatgatctttccaccgagccctagtcaaactgcagattcatgagcaaaataaacaccatcattactgaagcagaaaaaaaaaaaaaa

SEQ ID NO: 18297 - DNA, 426 bp, Homo sapiens
attcacagcccttttctccccctaaggatccaagccacgctcagaagcctgttgacagtggtgctcctcatgctgtcgttcttcatgatttcccagcagagcaagttgatgatttgaacctcacttctggagaaattgtttatcttctggagaagatagatacagattggtacagagggaactgtagaaaccagattggcatatttcctgccaactatgtcaaagtgattattgatatcccagaaggaggaaatgggaaaagagaatgtgtttcatctcattgtgttaaaggctcaagatgtgttgctcggtttgaatatattggagagcagaaggatgagttgagtttctcagagggagaaattattattcttaaagagtatgtgaatgaggaatgggccagaggagaagttcgaggcagaactg

SEQ ID NO: 18298 - DNA, 128 bp, Homo sapiens
agcatactgagtgggcttgcgagtcgattgctcctgagtttctgtccctggttccctctgcatggcgtggagagatttcagtcatggttcagttgagggggctgaatctcctcttttttttttttttt

SEQ ID NO: 18299 - DNA, 425 bp, Homo sapiens
attaacttactcaaaacacactgatacatagttctataataaatcatacctttaacatgttttcttatacagaatacagcaataacctccaagaggacatttattcagagacctcgggacacttcagagatactctcatgaacttggtccaggggacagagaggaaggatatacagaccctgcgatggctgctcaggatgcaatggtcctatgggaagcctgtcagcagaagacgggggagcacaaaaccatgctgcaaatgatcctgtgcaacaagagctaccagcagctgcggctggttttccaggaatttcaaaataaaatgtgattcctttgaagaggaaaatgaataatacattgaattagaaacataaataaaatgaccagtaattgtgaaaaaaaaaaaaattaaaaaaaaaaaaaar

SEQ ID NO: 18300 - DNA, 494 bp, Homo sapiens
acctttttgactagaaataactgatgaaagttcacttagtttggtgggaaataagagatacaaagatatcttctccaggatgagactcccaaaagcaaatgttctctgagtacctctgtcgctcaaatttaagccctttggagttcctttgagcatggttctgccctcatatttctgatcactccctctagactcctactcaacttctcttcctctgagcactccaattgcaagtcacacccagagacagggtcttgttatgttgcccaggctagtctcaaacacctggcctcaactgatcctcccacctcagcttctgaaggtgctgggattacaggcatgagccaccacaagaacaacacatttctataagctgcattggggcttacgagaaaggagacaaaagagactgcccaacatgcagaggctgagaggagacctacacataaaccagaaagccttatatcttcagtgaaaagtgaacaacaatagca

SEQ ID NO: 18301 - DNA, 65 bp, Homo sapiens
gctctgctccgagccgctcactgcatggtagagtctggtgcccccgccgccgcctgcatcgccgc

SEQ ID NO: 18302 - DNA, 239 bp, Homo sapiens
agagtctggtgcccccgccgccgmmtgcatcgccgccaccgrcgytccgscacgaccaccgccgcctcctgccctgcagccaccgccaccgsctgtgtmgccgscgyctcrggaccggmtgtatgattaggccacaatcttcaatgagtaaacatattcctcaattctgtggtgttcttggtcacacatttatggagtttctgctgggctgwgaaggagaataaagagttaaactgtcw

SEQ ID NO: 18303 - DNA, 519 bp, Homo sapiens
tgttttcttttcaatctcagctcttgtatgtggaaataatgaaataatatttgctatgagtgttggttggggttttttgttacagatactaagagttattctagtagtgtaagcagcaagtgatttattaagggtgatagctagtttagcacattgggcaggctgacaaaagagactgtactctgagtttctgggaatggttgccagttctgcactgtggaaaagcctgctgaggagctgctgctactgataaagtcagggtgctgcaaaccaggaacccaagcaagactcaccccccttcttccactttccctacataacaccgttctgaaggagccccatgtggtatgtctggttggtggaactaattaacatgtctgcttgtatacccccaatttgcttatttgctttctttttttaaattctatattgggaagtgaggtttacacagtaaggaagtagtgaaaacataacaaagatgatttggggctcatgaataacagatacttattacagtat

SEQ ID NO: 18304 - DNA, 535 bp, Homo sapiens
aggatgggaggagcatggagaagccaaatatgtaggaaaggcatcctcttcttaactcagactgctgagtccctaattaccagctgcagaccaccaataagggtggagcaccatgcctggacatagtggccatgcttttatatttggactggacaaaagggatcttgataagagtttagccttggaaggactcctacagagagcatctatgacccccaaagacagatttcaggcctactaaaagtctctttctcatgagacacttacccattgatcaaatgacttctcattcatggtgttatcagtcctgttacaatgttgtttaacctgtaacatggatataatatctgccctgccttcattttaggattctagggaagtgcttggaagagcaccaagtgcaatgcaactatagggttattaataatgttgctattatacattttgattgatgagattttgacaatgggaagccccctctctccccactctggccacaggacctgttcctaaacgtacatctcagtccacactc

SEQ ID NO: 18305 - DNA, 512 bp, Homo sapiens
actaggaaggtgggacgttggaggggtggccgcatggagtgagtactgtctctggccaccgagcagagccagtgacagcagcgtcctggtaggcaggcaggcgtatcaggtttcagaggatgcggctgggaacgggagtagaggtgaggggtcgttgcatctgtcgcggtgtgtatcttttgggggttcagcgccaccagcgacttgggcctcattcatcgcgcttacatttctccacctcatttgaagaacgagcttcgtagcccacggagctgaggtatatgagctccctgaaagcacaaagcagttatttccatcttcagatcattcagagattatgaaggcacaaaccctgccttcaatttgcttatagtcaagtkgagcagacacaagtcaatgattgcagtatagccactgaagtaatctaaaagagacttatcagcaggttgcaggtgaacatggccttgaggtaaatctgtcccttgctgaatacagtttcagtagattgttta

SEQ ID NO: 18306 - DNA, 438 bp, Homo sapiens
agtggatttactaggaaggtgggacgttggaggggtggccgcatggagtgagtactgtctctggccaccgagcagagccagtgamaacagcgtcctggwargcaggcaggcgtatcaggtttcagaggatgcggctgggaacgggagtagaggtatatgagctcsvtgaaagcacaaagcagttatttccatcttcagatcattcagagattatgaaggcacaaaccctgccttcaatttgcttatagtcaagtggagcagacacaagtcaatgattgcagtatagccactgaagtaatctaaaagagacttatcagcaggttgcaggtgaacatggccttgaggtaaatctgtcccttgctgaatacagtttcagtagattgtttatagtagtttcaggaattgagattttttacaraartacaaaagttttgsttg

SEQ ID NO: 18307 - DNA, 196 bp, Homo sapiens
cccccaccccctctgacccttccatgaggcacaccagggctggttccttctaattgctaggcataactccaacctatttagtcctcaccttcctcattaacagagtcaaatctgggccccaatcataaaagtctgaccgggttgtttccttcttaaatcccttttgttttcccattctcctcaggataaggcacaa

SEQ ID NO: 18308 - DNA, 503 bp, Homo sapiens
cctgtccccagcttcacccagcacagggccaggcaccgagtaggcgtcggtagatgtttgctgaattgaattgaatccccacggcagctctgtgaggcaggtggcgagctcttcacgcatctggagcgagagggcatcttcctggaagatacggcctgcttctacctggctgagatcacgctggccctgggcatctccactcccagggcatcatctaccgggacctcaagcccgagaacatcatgctcagcagcagggccacatcaaactgaccgactttggactctgcaaggagtctatccatgagggcgccgtcactcacaccttctgcggcaccattgagtacatccgccctttaccgcagagaaccggaagaaaaccatggataagatcatcaggggcaagctggcactgccccctacctcascccagatgcccgggaccttgtcaaaaagttctgaaacggaatcccagccagcggattgggggtggccaggggatgg

SEQ ID NO: 18309 - DNA, 426 bp, Homo sapiens
agttggaagagtactggccctgggaagacccagctttgagcctcaggttgtgtctaatcatctctctgtccttgggccagtcaactcacctgttcgtgctgccacagagacagaggggccacatcagagagaaagactctacagcttgcccagagtcgagcttaaatggagcagcatgatttttgtctgaaaagtctgagatgggaccagtggaaaggtgtgcattttaagaaggawttgcttccccatcttgtgctttctgtgtcttgcagcacgacctggccvtccacctaggaatcataccctcatcccccatactcataagcatcctcattcctgtttccttgtggatgtcatggtctgctgtgaagtctgcttggtgacccgtccagacctgacttggtrtaaatgattttgttgcagaga

SEQ ID NO: 18310 - DNA, 487 bp, Homo sapiens
cttttatctccactctgcggagattcacgcctggaaaacgctcttctgagaggatctgtggaggtcaacccaggagagagaagacaggactgaagcactgaaagggtcctgccgttaagggcgcaggattgtatagaatatataatagcagtagcagctctgtttacggagcattaaccttacgtggagttatttcctgcatttcctcctttcgtctttacaaggtagccgtttggcgtcgtgagagattgggtctctccacattgccccggctgctctccaacccctgagttcaagtgattcacctcccttggcctcccaaagtactgggattacaggcgtgagcaccgtgcctggctgagaagatggatttaagacatattttggaggtaacattgtcaggacttcctgaaggattagatgtggaagggaaggataagaaacagaccaaggataactttcaaatgtatgcttaagcaactggatg

SEQ ID NO: 18311 - DNA, 168 bp, Homo sapiens
gtgtggtgatctcaattactttacctgagtagactactgaagcagcatttgaagctgcagtcttgaaacacatgcaggctggaaaagtcgctaaagaattacttatttgagatggcacatgtttctgcagaaactcaagatgtttctcctaaagatgaatcaactggt

SEQ ID NO: 18312 - DNA, 444 bp, Homo sapiens
gtgtggtgatctcaattactttacctgagtagactactgaagcagcatttgaagctgcagtcttgaaacacatgcaggctggaaaagtcgctaaagaattacttatttgagatggcacatgtttctgcagaaactcaagatgtttctcctaaagatgaatcaactggttcaaaagcctcctctgggtctccattgtgtgaacacataatccctggggattcagacttaaggtcaatgactgaatcaatgattttcaggttttgccacaaggatccttgataaaaaggccacattatactttatgtctctgagccagataaagataatgattttccttctctgacctttcccagtaaactttggaaaatagctgaaagtgaccaattcaagtctaattcataggataagaatgaaacttgcatagtgactaatgaagaactcttc

SEQ ID NO: 18313 - DNA, 452 bp, Homo sapiens
  misc_feature 19,102,145,187,239,254,263,297,305,333..334,337,339,343,357: n=a, g, c or t
gtgtggtgadvtcaattantttacctgagtagabtactgaagcagcatttgaagctgcagtcttgaaacacatgcaggctggaaaagtcgctaaagaattanttatttgagatggyacatgtttctgcagaaactcaagatgttntcctaaagatgaatcaactggttcaaaagcctcctctgggtntccattgtgtgaacacataatccctggggattcagamttaaggtksaatgantgaatcaatgatttnaggttttgncacaaggatccttgataaaaaggscasattatantttatgtntctgagccagataaagataatgattttnnttntntganvtttcccagtaaantttggaaaatagctgaaagtgascaattcaagtstaattcataggataagaatgaaacttgcatagtgavbtaatgaagaactcttcaagaaaga

SEQ ID NO: 18314 - DNA, 422 bp, Homo sapiens
gtgtggtgatctcaattactttacctgagtagactactgaagcagcatttgaagctgcagtcttgaaacacatgcaggctggaaaagtcgctaaagaattacttatttgagatggcacatgtttctgcagaaactcaagatgtttctcctaaagatgaatcaactggttcaaaagcctcctctgggtctccattgtgtgaacacataatccctggggattcagacttaaggtcaatgactgaatcaatgattttcaggttttgccacaaggatccttgataaaaaggccacattatactttatgtctctgagccagataaagataatgattttccttctctgacctttcccagtaaactttggaaaatagctgaaagtgaccaattcaagtctaattcataggataagaatgracttgcata

SEQ ID NO: 18315 - DNA, 362 bp, Homo sapiens
gcccactggagctctggagggtgggacatccccaaacctaaactgttaactgagacctggaactgtagctgagtcatatattcttcttctttttttgagacggatttggttcttgttacccaggctggagtgcagtggcgcgatctcggctcactgcaacctccgcctccccggttcaagtgattctcttgcctcagcctaccgagtagctggggttacagacatgcgccaccacacctggctaatttttttgtatttttattagagacagggtttcaccatgtctactaaaaatacaaaaattagccakgcgagttggtgtgcacctgtaatcccagctacttgggaggctgaggcaggag

SEQ ID NO: 18316 - DNA, 472 bp, Homo sapiens
  misc_feature 361,374,378..379,381,442: n=a, g, c or t
gcccactggagctctggagggtgggacatccccaaacctaaactgttaactgagacctggaactgtagctgagtcatatattcttcttctttttttgagacggatttggttcttgttacccaggctggagtgcagtggcgcgatctcggctcactgcaacctccgcctccccggttcaagtgattctcttgcctcagcctaccgagtagctggggttacagacatgcgccaccacacctggctaatttttgttgtatttttattagagacagggtttcaccatgtctactaaaaatacaaaaattagccaggcgagttggtgtgcacctgtaatcccagctacttgggaggctgagggcanggggaaatsggcnwahnnrnccrhggaagtggaggttgcagtgagctgagatctcgrccattgsactccagcctgggsggncaggagcaaaactctgtcccaaaaaaaaaa

SEQ ID NO: 18317 - DNA, 454 bp, Homo sapiens
ctcagcctttatctccactctgcggagattcacgcctggaaaacgctcttctgagaggatctgtggaggtcaacccaggagagagaagacaggactgaagcactgaaagggtcctgccgttaagggcgcaggattgtatagaatatataatagcagtagcagctctgtttacggagcattaaccttacgtggagttatttcctgcatttcctcctttcgtctttacaaggtagccgtttggcgtcgtgagcggaaagtgaccagaagaggtgtgcagtttccaggcctggcccatacagacctccaacaggtgctcccctgtgctgttactccttctgccaactggaagcagatggtgaccaggctctggagaaggcaaggcctgaagatgggagattcctaagtggaggagaactgtgccttactgacctaaatatccactcagtattgttaa

SEQ ID NO: 18318 - DNA, 301 bp, Homo sapiens
attaccatcatgatggcctgtcaggcttttcagagaagaaatgaactgattaaccacaaatgcattattccaacaagccaaaagtcttccatcccatgggccagggtaattttcccaggttagatccagggtttgggtgaaatttaactttaagatgtgggtgccaaaagagagaattggcttgtggggcctttcaccagagacccatgccagtgactgaatgacctggattaggtatgcatacttgcaagcctcttatttgggaattacactaatggttacctgttttgtgtgaccaaaa

SEQ ID NO: 18319 - DNA, 590 bp, Homo sapiens
cttaatgttcatattttgagtaaaggaagctaaaaccatgtttgctttctggtactacatgcattagcgaaaggttaagtaagttttgttctccactgaagtaatacttaacatctcagaaaaaattttgcatgttctgtagttttgtattaaatcagtcatttcatatgcactatatcaagtacaaacaggtagtttacctgtttatagtagtgtactaacaaagtctcccttgcagcttcagactgttatctataggcttatcgttcaaatacagcacttgaatatcccaagtagttcttctacgcatagctcacctttctaaacccagttaagcatggaagagaggtagtaggtaggtgcagtgtgtggaagctgcaaacaagtaggccttttattcattgatatcttttcccaagtactggattttaaatctgtatgtatctgtttgatttttttttctatatttcagttgagctgctgttttcttccatgcaatattgtatactcaattgtgtatagaagaagctggtgagagtgccctcctacataaataagcaattgcagtgttttgcatgcaaaatataaaa

SEQ ID NO: 18320 - DNA, 478 bp, Homo sapiens
agatttcctgttctaccccaaactttggaatgtgctgaaaaaaccatctcacttcctacctccaagacatcaaagttgcaccttgaatgatactccacatcgaagtcatggatggatcttgcyatattgcccaggctggtcttgaactcctaggctcaagtgatccacctttccctcccaaagtgctgggattacaggtatgagccaccacacctggccgtgttttgtatcctcacaagactttatccccagatttgagacaaagacttggagctagaagaggaattactggttaaaaagctatcatgaatagctagagaagagcaatgcgcccctccgccccaacccacatattattgctacttgaacctaaagaaagaatgaattgtgtcacttagtgggaagcctttgaaactggatcaccatttacttggttacccttgggataagctgcccatgacaacgaaacataaaaatt

SEQ ID NO: 18321 - DNA, 154 bp, Homo sapiens
tatttttgatcagtggcctttgggcactgttcagggtactgaccatcagtgtcagcattagggttttggtttttgtttcttttgggtatttcttttttggcacatgtgaatcttgttttgtgwaaaatgaaatacccaaaaaaaaaaaaaaaaa

SEQ ID NO: 18322 - DNA, 436 bp, Homo sapiens
caatatacattattaagctttcttgggtactattttgctggggctcttgcgtgaaggtggtacctgtctcatgatccttaaaagagagaggcttttttcatccaaagctgtagtgttgggaactggggtgggagaggcactttttggaattctgaaagaatcatatctgtgtatatacatactgagtggggaaggatgggggttggcaggggttgagggaggtgggaacaaacagtgagtatgggaacaggcagtcacctcgagtgtgggaggtcacctgggtccgtcgtcttccttctgtatggtgttgggtttatgtacacacctataacacttcctgtgtgagttcatgtacctgtctgtgagtgctttggtgtattgagccctcagtacactccaagggcattaaagtcaagaaccaaaaaaaaaaaaaaaa

SEQ ID NO: 18323 - DNA, 517 bp, Homo sapiens
tatatatgatttatggatgttgacgccaatgttcagtttgggtacgttggtgtattgcaaggggagaggcttttataacaatagatttgaacatttttaaaaaattggactgtgtaacttaaatacacaattatttggtttaggatggttattagggcccattagaaacaggagaagtattttacccattcttaaagctctaaaaaaccatctcatggactgaaaggtagatagacagatggaccacaatgggaaataggatgtccatttgtacttctttgtacttttttgttaataaactgttttggaattaatggcttaatttgtgatatcatgttctagaaatacctgcaacatgacagtctaatcagtagtctattaaaacttgtattcataatgtgtataatttcctggtaaggctaactcctgatcgtttctgtagaaagatgacaaataaagaaaaagttataattattaattatagttttttgtgtggtaaagcaaagatactgtgata

SEQ ID NO: 18324 - DNA, 461 bp, Homo sapiens
tgtacttccttagtactggtagcattattatccaatggacttttatagctttcattaggttttcttttgtttttgttctttaaagaacgttttacttatcttagtatttcatttttcatcyatattatgaggcagtaagagtcttctgtttttccaaagttgagactgctttatatttatttcgtattgtctacagctgtagtgttcaatacattagccactagccacatgtggttatttaaataagataaaataaaaattggccgggcgtggtgggtcacgcggtaaycccagcactttgggagsccgaggcgggcagatcattaggtcaggagatcgagaccatccttactaagacggtgaacccccatctctattaaaaatacaaaaaattagccgggcgtggtggcgggcgctgcagtcccagctactcaggaggctgaggcaggagaatggcgtga

SEQ ID NO: 18325 - DNA, 402 bp, Homo sapiens
tgggaaagctctgtagagcatggttccagtgaggccaagattgaaatttgatactaaaaaggccacctagctttttgcagataacaaacaagaaagctattccaagactcagatgatgccagctgtctcccacgtgtgtattatggttcaccagggggaactggcaaaagtgtgtgtggggaggggaagggtgtgtgagtggttctgagcaaataactacagggtgcccattaccactcaagaagacacttcacgtattcttgtatcaaattcaataatcttaaacaatttgtgtagaagtccacagacatctttcaaccaccttttaggctgcatatggattgccaagtcagcatatgaggaattaaagacattgttttttaaaaaaaaaaaaaaaaaggc

SEQ ID NO: 18326 - DNA, 109 bp, Homo sapiens
acttccttctcgagcccggagccgctgccgccgcccccatgcttctggggacctttcctacccccatcagcatcaataaaacctcctgtctccgaaaaaaaaaaaaaaa

SEQ ID NO: 18327 - DNA, 139 bp, Homo sapiens
attttcaaggggctgtgaaaagagagggtcactcctttttgatcatttccctgctgcctggcttcaaatggccctcaggcaggtcactttagggaaattggtgatcgctcttggtattccactttttttttttttttga

SEQ ID NO: 18328 - DNA, 242 bp, Homo sapiens
acacacacagacagggaaaaaggccacgtggggatgactgcagagagtgaagtgatatgtctacaagccaaggaacgccaaagactactagcaaccaccacaagctaggaagaggcaaaggattctcctgtaaagccttcaaagggagcacggccctgctgccaccttaatccagaattccagcctccagaactgtgagacaataaatttctattgttttaaaaaaaaaaaaaaaaaaaaaa

SEQ ID NO: 18329 - DNA, 276 bp, Homo sapiens
acacaaacagacagggaaaaaggccacgtggggatgactgcagagagtgaagtgatatgtctacaagccaaggaacgccaaagactactagcaaccaccacaagctaggaagaggcaaaggattctcctgtaaagccttcaaagggagcacggccctgctgccaccttaatccagaattccagcctccagaactgtgagacaataaatttctattgttttaaaaaaaaaaaaaaaaaaaaaaaaaaaaaaaaaaaaaaaaaaaaaaaaaaaaaaar

SEQ ID NO: 18330 - DNA, 261 bp, Homo sapiens
acacaaacagacagggaaaaaggccacgtggggatgactgcagagagtgaagtgatatgtctacaagccaaggaacgccaaagactactagcaaccaccacaagctaggaagaggcaaaggattctcctgtaaagccttcaaagggagcacggccctgctgccaccttaatccagaattccagcctccagaactgtgagacaataaatttctattgttttaaaaaaaaaaaaaaaaaaaaaaaaaaaaaaaaaaaaaaaaa

SEQ ID NO: 18331 - DNA, 283 bp, Homo sapiens
aacttaaattaaaggggccgtctgaaaccagaagactggactggaggcgaggaaaaggaggcgaggggaggggagggagaaaagagagttatttggaggttttttcccgcctcctctaacttggcagagagaggagatggttcagtgatggacgaaaagatgagaagacagagaaaatagaggagataaagacaggataaaaatcacattaaacatggaaaacaaaaacaaaaaccacagtgggacaacaacagggacagagcaaaaaaaaaaaaaaaaaggc

SEQ ID NO: 18332 - DNA, 191 bp, Homo sapiens
atttttctgtattagctggttattgttacttgagatttgtcagctttccttgaagtgtgttcccttgaactggatgctaatgtttgccatgcagggaagaatgtctctgcagtaaaataaagttaaaatcagtttatttactgcaaaaaaaaaaaaaaaaaaaaaaaaaaaaaaaaaaaaaaaaaaaaaaa

SEQ ID NO: 18333 - DNA, 173 bp, Homo sapiens
atttttctgtattagctggttattgttacttgagatttgtcagctttccttgaagtgtgttcccttgaactggatgctaatgtttgccatgcagggaagaatgtctctgcagtaaaataaagttaaatcagtttatttactgcaaaaaaaaaaaaaaaaaaaaaaaaaaaaaa

SEQ ID NO: 18334 - DNA, 98 bp, Homo sapiens
atttttctgtattagctggttattgttacttgagatttgtcagctttccttgaagtgtgttcccttgaactggatgctaatgtttgccatgcagggaa

SEQ ID NO: 18335 - DNA, 473 bp, Homo sapiens
acttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctcactttctggtggaggtgatagccaacagtaagatggccaaaagctacttacccttgaagaggaaatgaagggcttggagctccaactagatagcctatgaataattgagatttggctttttacctcattatggatttagtttgaatgtattctgtgtatatattttaaggatatgttttcatgatgatgatgatagcactgatgagaggagtaattaaagcttctatttattgagacttgactatatgtcaggtactgtttcactttcatcaccagta

SEQ ID NO: 18336 - DNA, 468 bp, Homo sapiens
aaatgtttgaaaagagataagctgactgcttgataatcactctcaggtgtaaagctccaagtgtaaataaaagtggcatttaacaaatctttcagaacaaagtacagctgactatatataccaagagctaagctaaaggaacagctgagagctccgatctccacgagagactaatctaaaagctctgctttgtacttcctcaccctgctttcgtacaaggaagggggacgatgggaaatcatggacttgtaagttgtatttaaacataaaaatgaacttggtaacttctgggtttagtagagcctcagtgtcgctttaacttagtttactttttttttatttttaaagcagcatggatggktttaaaggagtattatgattgtaaaattgctaaatatgactgtaacacagctttgtggtagctgtgacacagttcacttgggcaaaggagtggtgatggactcgtta

SEQ ID NO: 18337 - DNA, 552 bp, Homo sapiens
agcgtaggagagattcttctgtaattttgcgggggttcagccttgctcggcgattcacggcccagacatagagaatcgggatagctggccgaaccgtctctctcagtctgactctctttaaagaagggatgtgggctggggcgcggggacagtcctggtggagcacggaaaatgcggctgtaaagttgtaattaccctattgtgccgagttccgagaaagttcttaaaattgttaagtccactttgttctctaaaatgtacttcgctttgagaatttcttcagggagaaagcacaaaaaccagcctgattgtatctggaaaaaaccattatgttacagttgataggctcaccccaaaatatgcttttggggactgatttagcacctgcatattctgcgtgaatctctttaattggttgcagttgagctaatggtggagccaaaatgctattgccctgtcttcatcaacatttaatcactcctttatgtctccaaatgatacaagaagacccgagaaagtggtaaactaaatgatttttattaaagtaattgc

SEQ ID NO: 18338 - DNA, 237 bp, Homo sapiens
gcgccttcgtactgggcctgagaaggaaggagttattcatctccttaagctttcaggcctcagggagaatcgtacattcccgtctatttggttgtagataaaagagataaggggcctctttctcaataactacttcacgtgtgatatagggggtggtgtgggcaccttggaaaaacaaaaccttaattttttgggtattcttgagagacgggttggtatccacattgtccttgtagt

SEQ ID NO: 18339 - DNA, 490 bp, Homo sapiens
agaacactgctagtgttctctgcagtttgttgtagaatcatagtgtcttggcaaccaaaggcagatctggtgctatggaggacctgcttactgctatgaggtgttactttatagaggtcctggagaagctgattgaggccacgtcaatgttgcaaggagacatgagactcacatcagagttctatggcttaacatgggggatggtgtgaaaagaaacagagatcgttggagaaatgtctgattataagatatttctaagcctggtgaagaaatatataagagaagcctggagaagaaccagtaataccagaaatcagggaggggccctgaagagaaaaggataacaaaaggatgaagacctgtccaagggacccagcagctaacttgaaagagctctcaatgggtaaagctggagcaatttcaacaacaaaataataacatatcactggattataacctgaagtataaacgtatgagtccatactcttat

SEQ ID NO: 18340 - DNA, 592 bp, Homo sapiens
agttaggccacatcagcgcaaatctgtgagggtctagtaactgcctgagaaaatatcttgtctgaccccggttatatttttccttcggtagggattggactttctgaakgacgttgtgatccaaaggaaggaggccggagtctctacttcccatacagcagcctggtccgaccccagtggcactaacgtgggatcctcagggcgctctcccagcaaagcagtggccgcccgggcgcgggatccactgtccggcagaggaaaaatgccagctgtgggacaaggagtgcaggccgcacaacctcggcaggcaccggggggatrtggcgattctacacagaagattcacctgggctcaaagttggccctgttccagtattggttatgagtcttctgttcatcgcttctgtatttatgttgcacatttggggcaagtacactcgttcgtagattcagttacatccatctgtcatctgaagaaggaggaaaaaacccaacatttcttggaccaaaagtatagtgactatctgttcatgagagaaattttctgtaagcttgctgttttacaggggatttatcaatattgattttgagg

SEQ ID NO: 18341 - DNA, 413 bp, Homo sapiens
atgcgcatgcgcgtcgggcacagcgcgtgcagcctcgtgcagctcttctggtctccggcgcccgcccctcagacgtaatgttgaattaaagaaaatactttatcagaagaagatggccactgcccagttgcagaggactcccatgagtgcactggtatttcccaataagatatcaactgaacaccagtctttggtgttagtgaagaggcttctagcagtttcagtatcctgtatcacgtatttgaggggaatattcccagaatgcgcttatggaacaagatatctagatgatctttgtgtcaaaatactgagagaagataaaaattgcccaggatctacacagttagtgaaatggatgctaggatgttatgatgctttacagaaaaaatatgtatacacaaacccagaagatc

SEQ ID NO: 18342 - DNA, 72 bp, Homo sapiens
ctttttgttgctgccgccgccgccgagtgtcactttcagcgccgccgcctgcgtctcccaggccgtaaccac

SEQ ID NO: 18343 - DNA, 60 bp, Homo sapiens
ctttttgttgctgscgccgccgccgagtgtcactttcagsgccgccgcctgcggtctscc

SEQ ID NO: 18344 - DNA, 115 bp, Homo sapiens
cattttgttcatcctcctcctcctcctgctcctcctggttggagcgcagtgtccggagcgggctggggggagagagcccgagagcagggttcggtgccttttcctctgtccccac

SEQ ID NO: 18345 - DNA, 478 bp, Homo sapiens
aaagggtgtgaaccggaagcgatttcatagccacggtttttggctttcatcgctttttctacatgtttttagcctcaccagaagtctttcatcacggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagtcttcaatgcgtctgtctcataatttgtaaacgtttattatcttgaagtcattgttaatctgtggtgaaaagtaattgctaaatagaaattctgagaagaaaaaggcctcatccttttcacatgatgtaggaaggtctgttgcatgagcaatgggaaatccagaaaacataga

SEQ ID NO: 18346 - DNA, 391 bp, Homo sapiens
aggagacgccatgccgggggctgggatcaccatgccccttgcccgtctcgcaccttgctgctgtctctaaccccccagcacctcccgcagcctggacgtcttatccctctccttagccccaggagcgtgtttcaggaactctcctcacctctgtgtcttgtgttttgcagtgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcactggacgttggaggaaagaaggaaatatctcattgcaggaaaggccga

SEQ ID NO: 18347 - DNA, 351 bp, Homo sapiens
aacggggcggasgcggctgcscggcgcgtcgaggggagaggcagcagccgcgrtggacgtgttcctcatgatccggcgccacaagaccaccatcttcacggacgccaaggagtccagcacggtgttcgaactgaagcgcatcgtcgghrrgcatcctcaagcggcctcctgacgagcagcggctgtacaaggatgaccaactcttggatgatggcaagacactgggcgagtgtggcttcaccagtcaaacagcacggccacaggcccagccacagtggggctggccttccgggcagatgacacctttgaggccctgtgsatcgagccgttttccagcccgccagagctgcc

SEQ ID NO: 18348 - DNA, 440 bp, Homo sapiens
aggaagaggccgcgtggggcgaaggcggcgcttggctggatctatcttgggatcccatggctttctttactgggctctggggcccttcacctgtgtaagcagagtgctgagscatcactgtttcagcaccactgggagtctgagtgcgattcagaagatgacgcgggtacgagtggtggacaacagtgccctggggaacagcccataccatcgggctcctcgctgcatccatgtctataagaagaatggagtgggcaaggtgggcgaccagatactactggccatcaagggacagaagaaaaaggcgctcattgtggggcactgcatgcctggcccccgaatgacccccagattcgactccaacaacgtgtcctcattgaggacaacgggaaccctgtggggacacgaattaagacacccatccccaccagcctgcgcaa

SEQ ID NO: 18349 - DNA, 71 bp, Homo sapiens
attccttttagttattaggtattcgtagtatggtccagcaatttgacccctgatctctgcttttttttttt

SEQ ID NO: 18350 - DNA, 544 bp, Homo sapiens
ctctccgcgcgccccctgcagccctggacgcagcacctccgtttgggacgccctacgcccaccttaacttgaggctcccatccamgccagcctctgcargcctcaccgcaaccgtgctaggcgcgtcggvtggggcgggaataaagtttttccaacccagtttggggagagggctggatgggaaggaccctccctgctgcagacttcatggcaggctgcactgtgtcccctcggctccacggctgccccgggggcgctgctttcgggttttctttctagaatctctggtctgctgctgtgcagatggacctgccggcactgctgtcagaagtgctacgagtccagctgttgccagtcaagtgaggatgaagttgaaattctgggacctttccctgctcagacccctccctggctgatggccagccggagcagtgacaaggatggtgactctgtccacacggccagcgaagtcccgctgaccccacggaccaattccccggatggaagacgctcgtcctcagacacatccaagtctacatacagc

SEQ ID NO: 18351 - DNA, 465 bp, Homo sapiens
agcagtactcaataaatgtatttcacatgttgaaaatgggtccttatgattgattatttagtttaatagtaaataataggaaaatttctttggaaaaatggaaatatagttaatttactgaagactggtaaaaattctctgtctttgatacttattcttaatttggctacttgaaaggcataggttgggccaggtgcagtggctcacacctgtagtcccagcactttgggaggccgaggcgggcggatcatgaggtcaggagattgagaccatcctggctaacgcggtgaaaccccatctctactaggaatacaaaaaattggccaggtgtggtggcgggtgcctgtggtcccggctactcgggaggctgaggcaggagaatggcgtgaaccccggaggtggagctcgcagtgagctgagattgcgccactgcactccagcctgggcgacagagcgagactccgt

SEQ ID NO: 18352 - DNA, 464 bp, Homo sapiens
gaaatctgggccaggcacggtggctcacgcctgtaatcccaacactttgggtggccaagacgggcggatcacctgaggtcaggagtttgagacaagcctggccaacatggtgaaaccccatctctactaaaaatataaaaatttgacagccatagtggcgcgtatctatgatcccagctacttgggaggctgaggcaggagaattgcttgaacccgggaggcagagtttgcagtgagctgagatcacaccattgcactccagccttgacaacagagtgcgacgccatctcaaaaaaaaaaaagaaaggaaagaaatgacatgtgtttggatgggycatgawagttgagaaaaagctggatttcagagctatgtcacacctttttatcatcatcaggatctagcatggggctttatacatrgtaaatgcttaattagkatttattgrgtatacagatgtttttat

SEQ ID NO: 18353 - DNA, 417 bp, Homo sapiens
catgttgatcctgaagaatccgttaaaatggtagcacaagagtctggcaagttggtactgcagagaaaaggggttaattgaggcttgtttggagtcgggattcccctttcccaaacatgcgtctcgccacttggacagcagccatttgtactcgtatactttttaaactttttcttggaatactatattttatttgactggtagtctgatattactcctaacttgtcaaattgatctctttgcaggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaaccttttttttttttttttttc

SEQ ID NO: 18354 - DNA, 495 bp, Homo sapiens
tcagtgaatttcattctacagacttttcagagcatctcataatcagtcaacaaatctatttcaaatgtgtttgttactaagcaacggttgctaagagcttctgtaattaagatgaaagttccaaggtaacaatgcccaaacacagcaccattttcaccattttctgataatgcaggagtaggatggctaaaagtgaaagaagaatctactctatggaaagcatggcacctgaaatttctgaagatattggctgtcctctagcttatatgagagagtttgtgctttactaatcaaccagtcatttttttcttgtgtggctgaaatgtacattccagacatgaacaggtagagtatgtgttgggggcaggtttatactgcatgggtgtgctgagacagggccacgtggtgatgtaaatgatgctgcctgacacgtgcagctgtaagaggggtgaacggataccctctgcatgaaataaacttcctttgcagttaaaa

SEQ ID NO: 18355 - DNA, 503 bp, Homo sapiens
tcagtgaatttcattctacagacttttcagagcatctcataatcagtcaacaaatctatttcaaatgtgtttgttactaagcaacggttgctaagagcttctgtaattaagatgaaagttccaaggtaacaatgcccaaacacagcaccattttcaccattttctgataatgcaggagtaggatggctaaaagtgaaagaagaatctactctatggaaagcatggcacctgaaatttctgaagatattggctgtcctctagcttatatgagagagtttgtgctttactaatcaaccagtcatttttttcttgtgtggctgaaatgtacattccagacatgaacaggtagagtatgtgttgggggcaggtttatactgcatgggtgtgctgagacagggccacgtggtgatgtaaatgatgctgcctgacacgtgcagctgtaagaggggtgaacggagtaccctctgcatgaaataaacttcctttgcagttaaaaaaaaaaa

SEQ ID NO: 18356 - DNA, 518 bp, Homo sapiens
  misc_feature 214..215: n=a, g, c or t
tcagtgaatttcattctacagacttttcagagcatctcataatcagtcaacaaatctatttcaaatgtgtttgttactaagcaacggttgctaagagcttctgtaattaagatgaaagttccaaggtaacaatgcccaaacacagcaccattttcaccattttctgataatgcaggagtaggatggctaaaagtgaaagaagaatctactctsnngaaagcatggcacctgaaatttctgaagatattggctgtcctctagcttatatgagagagtttgtgctttactaatcaaccagtcatttttttcttgtgtggctgaaatgtacattccagacatgaacaggtagagtatgtgttgggggcaggtttatactgcatgggtgtgctgagacagggccacgtggtgatgtaaatgatgctgcctgacacgtgcagctgtaagargggtgaacggagtaccctctgcatgaaataaacttcctttgcagttaaaaaaaaaaaaaaaaaaaaaaaaaa

SEQ ID NO: 18357 - DNA, 165 bp, Homo sapiens
atctttgatctttcttgtaagtgcatagaagaaaacgctgacgtatgctgccttctctctctctgcttcggctacctaagagggaagggccccctgtgctgtgatcacgtgacttgcttcaccttgtcaatcacttagaagattcaccctcctgaccctgtgcac

SEQ ID NO: 18358 - DNA, 521 bp, Homo sapiens
gcttagatttcctattggcttagagtatttgctataacaaatgaagtgcaatgacaattatatattcctactcggtcatactggactggcttcgttctcttaatatactcagtaatgactcaagcctctggtattaacataccctagttgccgttttttaattgccatgagccaaatacttcttgtatacaattgatccatttattttaatggctgccttttcattttcatcttttcttgctgctacccatctatgtatgtagtcattggggggaaaatgtagccacattttttatgggaagactttgtgttaaaagtgaacattttgaaggtttttaactggtgaaactagcctggaataatgccaccagagactgagtggaaatcgccccttttgaagtgccattcttatgagccaaaagtttgtcatttaaaagttcattttgagggaataacatgtaatataatttgaaataaagggtatagtaaccttaaaaagaacattataactgattgttgtg

SEQ ID NO: 18359 - DNA, 424 bp, Homo sapiens
ctcctgtctactgaggaagcgcmkkaaggcactattcccactgttttctttctctctcagcaggtttctcagcccccgaggattcacgatcatctttgggaggagagggccactcacatcctcccaactaagctccatgttggccaactgggaccacacgcctcgggcaacgtccaagggaaaggcgatctgggggcaagaggcatgaggttcgggcacctccagcagaggcggacttccagccacggcccccacctgggcagagggaacgtctccagacctgtggaaacaggaggagggcagagcgacggtgggaggggggtcgcattcaattgtcccagtagaaagtcctgatagtgccgttcagctcagctctgcagggcagacccagaccctgagtaaggaaatgtgcgaatggagatat

SEQ ID NO: 18360 - DNA, 404 bp, Homo sapiens
caggacacaataaaaatcacttataagacaaaagaactaggaaatcataacctgaatgagagaaagacaacagacaccaacacagacataaaaaaggggttggggctgggcgcagtggctcacacctgtaatcccagcactgtgggaggccaagatgggtggatcacttgaggtcaggagttcaagaccagcctgtccaacatggtgaaaccccgcctctactaaaaatataaaaagttagctgggtgcattggcacatgcctgtaatcccagctacttgggaggctgaggcaggagaatcacttgaacctgggagatggaggttgcagtgagccaagatcataccgctgcactccagcctgggtaacagagtgagactgtttcagacaaaaaaaaaaaaaaaa

SEQ ID NO: 18361 - DNA, 224 bp, Homo sapiens
ctctgtgattgttctggagtgaattaagttcacctgataactcaaaagtgaatgtataatacaattctgttttaatctgtgtattctttttctcctactttttactggggtgagaggggcatgaagagaaatacgcctttttttttttttcttttcctgtsgcaaaggctcgaytgagagaagtcagaasagagaaggggaaaaaaaccccaaaattatgtgaa

SEQ ID NO: 18362 - DNA, 307 bp, Homo sapiens
atatacttccgtttgcctcgcggtttctttctttccgcgccgatagcgctcacgcaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcacgacaacacacaaaaa

SEQ ID NO: 18363 - DNA, 250 bp, Homo sapiens
atctttgatctttctwgtaagtgcatagaagaaaacgctgacgtatgcwgccttctctctctctgcttcggctacctaagagggaagggccccctgtgctgtgatcacgtgacttgcttcaccttgtcaatcacttagaagattcaccctcctgaccctgtgcacattaaaaacttgaaaagcaaaaaaaaaaaaaaaaaaaaaaaaaaaaaaaaaaaaavmaaaaaaaaaaaaaaaaaaaaaaaaaaar

SEQ ID NO: 18364 - DNA, 389 bp, Homo sapiens
cttttctttccgcgccgatagcgctcacgcaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggctattaaaagatgcaagcattttgaactgggargagaaatttttatttttgaacccctgtgtcccttttgcataagattaaaggaaggaaaagtaaaaaaaaaaa

SEQ ID NO: 18365 - DNA, 382 bp, Homo sapiens
cttttctttccgcgccgatagcgctcacgcaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggctattaaaagatgcaagcattttgaactgggtgatccagttctaagtgtcatcttttattatgaagacaataaaatcttgagtttatgttcaaaaaaa

SEQ ID NO: 18366 - DNA, 358 bp, Homo sapiens
cttttccgcgccgatagcgctcacgcaagcatggttaacgtccctaaaacccgccggactttctgtaagaagtgtggcaagcaccaacccctttatgacaggaagcagagtggctatggtgggcaaactaagccgattttccggaaaaaggctaaaactacaaagaagattgtgctaaggcttgagtgcgttgagcccaactgcagatctaagagaatgctggctattaaargatgcaagcattttgaactgggakgagataagaagagaaagggccaagtgatccagttctaagtgtcatcttttattatgaagacaataaaatcttgagtttatgtccaaaaaaaaaaaaaaaaag

SEQ ID NO: 18367 - DNA, 203 bp, Homo sapiens
atctttgatctttcttgtaagtgcatagaagaaaacgctgacgtatgctgccttctctctctctgcttcggctacctaagagggaagggccccctgtgctgtgatcacgtgacttgcttcaccttgtcaatcacttagaagattcaccctcctgaccctgtgcacattaaaaacttgaaaagcaaaaaaaaaaaaaaaaaaaa

SEQ ID NO: 18368 - DNA, 221 bp, Homo sapiens
atctttgatctttcttgtaagtgcatagaagaaaacgctgacgtatgctgccttctctctctctgcttcggctacctaagagggaagggccccctgtgctgtgatcacgtgacttgcttcaccttgtcaatcacttagaagattcaccctcctgaccctgtgcacattaaaaacttgaaaagcaaaaaaaaaaaaaaaaaaaaaaaaaaaaaaaaaaaaaa

SEQ ID NO: 18369 - DNA, 405 bp, Homo sapiens
ctttccgcgccgatagcgstcacgcaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagagtctaagagaatgctggctattaaaagatgcaagcattttgaactgggaggagataagaagagaaagggccaagtgatccagttctaagtgtcatcttttattatgaagacaataaaatcttgagtttatgttcaagaaaaa

SEQ ID NO: 18370 - DNA, 401 bp, Homo sapiens
ctttccgcgccgatagcgctcacgcaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggctattaaaagatgcaagcattttgaactgggaggagataagaagagaagggcaagtgatccagttctaagtgtcatcttttattatgaagacaataaaatcttgagtttatgtccaaaaaaa

SEQ ID NO: 18371 - DNA, 225 bp, Homo sapiens
atctttgatctttcttgtaagtgcatagaagaaaacgctgacgtatgctgccttctctctctctgcttcggctacctaagagggaagggccccctgtgctgtgatcacgtgacttgcttcaccttgtcaatcacttagaagattcaccctcctgaccctgtgcacattaaaaacttgaaaagcaaaaaaaaaaaaaaaaaaaaaaaaaaaaaaaaaaaaaaaaaa

SEQ ID NO: 18372 - DNA, 285 bp, Homo sapiens
agttcttctcgatcgtgtcagtttgtaaggcgagggcggaagttggattcctggcctgagaatattaggcgtagttttccagtttttggcaaagcggaaatacttaaggcccctgggttgactgggttctttgttttatctaccggcttctgctttacgacaggtcacaaacatgtcagacaaaagtgaattaaaggctgagttggaacgtaagaagcagcgactggcccaaatcagagaggaaaagaagagaaaagaagaagaaaggaaaaaaaaaaaaaaaaa

SEQ ID NO: 18373 - DNA, 279 bp, Homo sapiens
gtccctaagctctcgccgtagcagccgccgcccatccctctttgtgtgctttggaaagccgcggastggtggtggctacagttggtgttgggggcttaggcgagggacgttaccgggaagttgcaggcgggaggactcttccccatccagtcacctgacaggtcacaaacatgtcagacaaaagtgaattaaaggctgagttggaacgtaagaagcagcgactggaaaaatcagagaggaaaagaagagaaaagaagaacaaaaaaaaaaaaaaaaagg

SEQ ID NO: 18374 - DNA, 58 bp, Homo sapiens
gccgtagcagccgccgcccatccctctttgtgtgctttggaaagccbggastggtggt

SEQ ID NO: 18375 - DNA, 172 bp, Homo sapiens
aggaggggctgggggtgaggggccacgcatggccaaggggcagctgcccctcatttatcactctgaccttcacagggacagatctgatttatttattttggttaaaaaaaaaaaaaaggawcagaaacaactttgcattgcattggcttgacccataaactaagttatatcc

SEQ ID NO: 18376 - DNA, 202 bp, Homo sapiens
aggaggggctgggggtgaggggccacgccatggccaaggggccagctgcccctcatttatcactctgaccttcacagggacagatctgatttatttattttggttaaaaaaaaaaaaaaggaacagaaacaactttgcattgcattggcttgacccataaactaagttatatccgtgggaaaaaaaaaaaaaraaaaaaaaa

SEQ ID NO: 18377 - DNA, 116 bp, Homo sapiens
agagggcggtggctcaggctcctggaaaggaccgtccacccctccgcgctggcggtgtggacgcggaactcagcsgagaaacgcgattgagaaatgaaaaaaaaaaaaaaaaaagc

SEQ ID NO: 18378 - DNA, 460 bp, Homo sapiens
attgcgtagggtcttgcgcagcgcgaaaagtagcgtgggccaggacagcgggagcaggtcttgcccttggcctggtgtggtggttcatggctgcaatcccagcacattgcggggcggargcgggaggattgcttgagcccaggagttcaagaccagcctggacaacaaagtaagaatcagtctctaaattaaaaaataaaagtaatttttttttgtttttttgttttgagacagagtcttgcactatcackccaggctggagtgcagtggcaccgatctcggcttactgcaacgtccggctcccgggttcagacgattctcctgcctcagcttcccgagtagctgggattacgggtgcctgccaccatgcccagctaatttttgtatttttagtagagatagggtttcaccatggttggccaggctggtctcgaactcctgacctcatgrtctgcccacc

SEQ ID NO: 18379 - DNA, 437 bp, Homo sapiens
tctgtaattggcaccatccacaatagcttttttctgttctgttgtcacggtaacagatgcatctcgagcacttccagagtttggagaagttgaaatctcttctctgccagatggtactacctttgaggatatcaagtcactgcagagtctttatagagagcactgtgaggtaagtcttttcaaatgtagtatgaacacatgcwaggttttgccagataacttgctaatataaaataatcaagcttattcctaaaggacaggtgaacttagcactaattcttttgagcgtatcttttagcactaacaaattcatttttcttctttctggtctcagagtggagagatgaggaatgcagaaaagtgagaataagttttattctctatttcttaagcctatcctaatatgaatcctttggcgtakcaattccacctctagg

SEQ ID NO: 18380 - DNA, 492 bp, Homo sapiens
tgtttttgtcagctaatgcaggctcagtgactttaagtctgtaagttacccaggaagaaggattataggaaaaataactcagtaagtttaaaaccaaacacatttccatttagtgacaggaatttaagcaaggacctgaagtagaatcaactgattcacacagtagtaaatacaaagtagaacaatgatcttggcttcgctgtctggttcagtggtctgctggaatgcaatacacaagttaagtcacactgcagactgttttctagctgtggccgctggatgccacttctagcatagtagaactatgttaggaggaatgggaaaagtgagcaccacttctcaccatgttcccccctcctgctgccagtctctgctcccatgttggatgcagcagagatcacccaccagttggcccaggacagaccaataggaagggtccaatcactctaactacagccgaactcacctccacaacagtctctgtggctctag

SEQ ID NO: 18381 - DNA, 498 bp, Homo sapiens
tttatggggtaggtgattttgtttagtttagtattaaggcagatggttgtacatgtgcagaactcctttctgctaatagccaggatgaggctatatgagatcacatggggttaggccatgaggcaaggttccattcttcctctgccattcaaaagtgatagggctttggatagtttaattcatctctttgagttatcgttttccaaattgtaaaatgtaaataataatacaatctgccttatagggctgttatgaagattaaatgggataaagaatgggaaaaatactttgaaaactctagtgtggaaatgaggacaattgttcccaagctggtgtcctcttagtccccttatgttctcatcattattgtgttctttattcctttattatcattttaatagtctggaagttgagataaatgcatgcttttcatcagtctatgaratcaaaagttcttattcttaaaataatattaactttattcttactatgtaatta

SEQ ID NO: 18382 - DNA, 250 bp, Homo sapiens
attccggttccggtgggcctccatcagcaagctccagtgctacgtgtccctggcattttaggtgtcggttgggtaggcagtcatggatcaggtaatgcagtttgttgagccaagtcggcagtttgtaaaggactccattcggctggctacttgtatcggtgacgccccaccggcccgcagcccctgctsccaataaaaccactccgaccccaaaaaaaaaaaaaaaaaaaaaaaaaaaaaaaaaaaaaaa

SEQ ID NO: 18383 - DNA, 256 bp, Homo sapiens
tgtcaaggctgttggtaacctgagaaaatgctccacctcatcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttaaaaaaaaaaaaaaaa

SEQ ID NO: 18384 - DNA, 159 bp, Homo sapiens
  misc_feature 90: n=a, g, c or t
attgttctcggggccgggcgggccgcgagtcctgggactgcggcccgctctattcgtgcgtctccgtctccgcagtcagctccgccgaancggccaaggaagagcccaagaggagatcggcgcggttgtcagctaaacctcctgcaaaagtggaagcga

SEQ ID NO: 18385 - DNA, 97 bp, Homo sapiens
  misc_feature 60: n=a, g, c or t
gtagtgactcatctcgggcagagcgctagggctccgagcgaaccagccggagctcagcgnggacccacggcccaatcaaaaaaaaaaaaaaaaaagt

SEQ ID NO: 18386 - DNA, 478 bp, Homo sapiens
cggcactgactgggccctctctgacagtagcttgtacttaaaataaataatcagctgaaatgaatgaatgaatgaaaaaagaatatttgtggttttcattcaaagtagaaaagtgatgctatcaacattttttcccccttgtgaaggcactggattgatctatgatggtggaatgcaagaagtacatgttctaccatcagcaaacagttgacccccacctctgctagcaactggcgatggactaggtcctactgatgttggctatcttgcctcctggttgcttgactccaggtaactgataggaactcaaatgcttagagctcttaaaatttggaactaaaatccaagattttatagatttctccaaattgtggcaatgtgagcatatttccagataaagcaccttccatctgccactgtcttgtctatacataggccgtatatttgcagtgggggtgatatcacccccaaggggtga

SEQ ID NO: 18387 - DNA, 244 bp, Homo sapiens
taaggtgttttacccatacctccttgccttatatctcatgataatatgaggcttttggaaggcagtgacttattgtggcttggggcatgggtttttggagtcaggctgacctactggctgtatggcttgagactttgtctcttcatctgtaaaatggggaagttaaaacttcatggtgtgtatgtgtgtatgtgtgtgtttagacagagtctcgctctgtcactcaggctggagtgcagtggcg

SEQ ID NO: 18388 - DNA, 497 bp, Homo sapiens
agtgacgcagcagtgtgttacctgccgacagcataawgygaggcaaggtcyagcygttccscccyggcatacaagcttatrgagcagccycctttgaagatctccaggtggacttcacagagrtgycaaagtgtrgaggtgwtcgagtgtggatcaagractggaacgtagcctctttgtgyccaykgtggaaaggaccccagactgtcgtyctgakcactcccacygctgtgaasgtagarrgaatccyagcctgatccaycacarccrtgtaaaacctgcagcgcctgaawcctgggaggcaagaccaagycyrgacaacccctgcagagtgaccctgaagaagaygacaagccctgctccagtcacacccrgaagctgactggtccacgcacagccgaagcatgaggaagctcattgtgggcttcatttttcttaaattttggacttacagtaagggcttcaactgttcttactcaaactggggactattccca

SEQ ID NO: 18389 - DNA, 485 bp, Homo sapiens
agatcgcaaaggaaaaaaccctggcgtgcaagcaccgataggagaggaaatgtttgctcagctgtaaaggagggagagaaaagggagaaagcacaggcggcgtggcaggtcttgtttcagtgagaatgtaaagtacgtgagctatgtgctttgtgatgaagtcgttgatttatttcactttggaacaagcacaccacaacaaagtgagaatgagaaggtaattcagagggagaagaaggaaacggaactgtacgtagaaatatatcctcatatgaacttagattctgaaataaatctaggttgtaaaaacaccaaaaggctgtttccatgagtgagtcaaccaagaggccctctcaggacttctgtgggacgttggaatcccctggcatatatgaaatccaaattagtcaggataggtaagattgtgctgcggtaacaaagaaaacctttattttcatggcttcatgctgaagcagcctcgctgt

SEQ ID NO: 18390 - DNA, 166 bp, Homo sapiens
atatcatccctgaccctgtgtctcsractgctgcaccccatcccgaccctgtctccgccacctcgcagccccattaaagcgctctcatctggaaaaaaaaaaaaaaaaaaaaaaaaaaaaaaaaaaaaaaaaaaaaaaaaaaaaaaaaaaaaaaaaaaaaaaaaaa

SEQ ID NO: 18391 - DNA, 95 bp, Homo sapiens
atatcatccctgaccctgtgtctccaactgctgcaccccatcccgaccctgtctccgccacctcgcagccccattaaagcgctctcatctggaaa

SEQ ID NO: 18392 - DNA, 427 bp, Homo sapiens
aaagaagaaaagatatataggtggctcacgcctgtaatcccaaagtgctgggattacaggtgtgagcactgcgcctggcccccatcacataattttaactcttaagtaggctgggaagttaaagatgaacattgtatttcctagagcagccacttaaaaaataatttatcaagagaatgagaaaacaagccacaacctgggagaagatacttgcaaaagacttatctgatgaaggactttgtatattttacccaaaatatacaaagaactcttaaaacccaacaataagaaaaggagcagttttaggccaggtgtggtggctcacaccggtaatcccaatactttgggaggccaaagtgggaggatcctttgagccgaggagttcaagatcagcttgagcaacatggtaagacccctctccacaaaa

SEQ ID NO: 18393 - DNA, 388 bp, Homo sapiens
  misc_feature 294: n=a, g, c or t
aaagaagaaaagatatacaggtgtgagccactgcgcctggcccccatcacataattttaactcttaagtaggctgggaagttaaagatgaacattgtatttcctagagcagccacttaaaaaataatttatcaagagaatgagaaaacaagccacaacctgggagaagatacttgcaaaagacttatctgatgaaggactttgtatattttacccaaaatatacaaagaactcttaaaacccaacaataagaaaaggagcagttttaggccaggtgtggtggctcacacggtrntcccaatactttgggaggccaaagtgggaggatcctttgagccgaggagttcaagatcagcttgagcaacatggtaagacccctctccacaaaa

SEQ ID NO: 18394 - DNA, 539 bp, Homo sapiens
ttgatcattaatctctgctctaaattacctttcttctgctagctttgggtttagattgttctttttctaattcattaagatgtgaagttagggagggttttttgtttcattttatttgttgttgttattgagacaaagcttactcagttgcccagcctggagtgtggtggtgcgatcttgggtcactgcaacctcgacctcctgggctcaagcaatcctcctgacccatagtctcgtagcttggactacaggtgtgtgccaccatgcccagctatctatctgtctgtctatgtatttatttacgtagggacggaggtctcaccgtgttgcccaggttggtctcaaactcctgggctcaagcagtcctcctgcctcagcctcccaaggtgctggaattacaggcatgagcaccacgcctatcctagttaggttgctgatagagatctttcttgttttttgatgtgtttgtagctatacattttgctcttagtgcttgctttcactgcgtcccgtaagtttcagtatgttatgtttttgtt

SEQ ID NO: 18395 - DNA, 392 bp, Homo sapiens
aacattggggatttagtttacagcacatgaactttgggggacacacttaaaccatagtgccgtcttcagtctgagaagaatttctgtctttcattgaagttccaaaggcttcttattttgatgactttgcctaaagaagggattctacagccaaatgctttctttttaacataccgaatgagtaaaagtgcaaaataagtacagaactatcaaacagcaacaaatgtgcttctgctgcctaccacagaattttccttgcctcagagttgatgatgaatgcagtcctgctccactttgattccatctggctctggaaggtgtttctgaagatttgtgaacagcatttgaatttgtttgtttttatttatattggctttttactatgatgtata

SEQ ID NO: 18396 - DNA, 348 bp, Homo sapiens
ctttttcgccccgcccttcaaatgcgaaasgactgccttcttggacagggtgtcgccatgtttgccaggctggcctcgaactcctgacctcaagtgatttgcctgccttggcttcccaaagtgctgggattacaggcatgagccaccacgtctggacataaacccagtaattttgtacgatttataaaacaatgtagtctgcaggaactaaggctatgttttgcctcaaatgttctttgttttcagaataaaatacttggtcagtggaatctcttcaacaaaatagaagagaagcagtcatggagtgaagaaataaatcatctttgtttccaaaaaaaaaaaaaaaag

SEQ ID NO: 18397 - DNA, 361 bp, Homo sapiens
ccacgggctctccttgcatcagccaagcttcttgaaaggcctgtctacacttgctgtcttccttcctcacctccaatttcctcttmcaacccactgcttcmtgactmgmtctactcsgtggaagcacgctcacaaagttcctgacctggccatcccggggtgcccttraccagccccgtgtcwcctsagggtgtcccagacaccagcctggcacagagtggggctcagttagagtatctcgggatgttcgtttcgccaggcacgtgggccgtggcccggctgggtcggctgaagaactcgcggatggaagctgcggaagaggccstgatggggcccacsatcccggacccaagtcttcttc

SEQ ID NO: 18398 - DNA, 448 bp, Homo sapiens
acgtggcccggctgggtcggctgaagaactgcggatggaagctgcggaagaggccctgatggggccaccatcccggacccaagtcttcttcctggcgggcctctcgtctccttcctggtttgggcggaagcatcacatggatgcctacgtgggaagggacctcgaatgtgggaccccagcccctctccagctcgaaatccctccacagccacggggacaccctgcacctattcccacgggacaggctggacccagagactctggacccggggcctccccttgagtagagacccgccctctgactgatggacgccgctgacctggggtcagacccgtgggctggacccctgcccaccccgcagaaccctgaggcctaggggagctgttgagccttcagtgtctgcatgtgggaagtgggctccttcacctacctcacagggcttttgtg

SEQ ID NO: 18399 - DNA, 439 bp, Homo sapiens
tcaaaaagaaagtcatttgccttttctgggatttttcttccatgcccatgaaaacctgtgtcaagacacttctagatatatacacagacataagggtaatatggaagagtctctagctcagctaaggcatagatatctttggctcaggaaatccagtgatatcagcctttgattagggtagtagataacattttgtaacgataaataactgtcttacttggtgaaatgggtgtattgaggaagcaaataagtgaagatactttttcaaaagactttatgattcttgttacttgggaaaattttcccagaatgatagaccttgtaaaaractatttccatctatgtccctgaatttccaagccactgaagaaaaacaatacagaggttgaaaaaacctaattgttgcctacttacttggaaatgattgttgctggaaaaa

SEQ ID NO: 18400 - DNA, 183 bp, Homo sapiens
tcttttcggttattttctgctacggcagttccctgccctgccccgggcccagggcgccgcggtctgaactctgctcggctggaggactcgtctccgagctccgtcagaaatggggaacttgcagtcggagccatccgcgggcgggggctcccgaaaagtgcagccctcggaccgcgcccccga

SEQ ID NO: 18401 - DNA, 96 bp, Homo sapiens
atctgccaggagaatttaactatagggagagtgatggaggtgctgggagcctggggctgagaaagtgtcggaattggtttaaaaaaaaaaaaaaag

SEQ ID NO: 18402 - DNA, 356 bp, Homo sapiens
tcatgaaatttcacccgcatttatgggttctttttaaaaattcagacaactggctgggtgtggtggctcacgcctttagtcctgacactttgggaggctgaggcagaggaatcacttgattccaggagttcaggaccggcccgggcaacatgatgaaaccccatctctgctaaaaatacacaaaattagctgggtgtggtggtgaacacctgtggtcctagctgcttgggaggctgaggtgggaggatcgcctgagcctgggaggtcgaggctgccatgagccccgatcatgccactgcactcaacctggatgacagagtgagaccctgtttcaaaacaaaaaaaaaaaaaaaaag

SEQ ID NO: 18403 - DNA, 137 bp, Homo sapiens
tttttttcgccccgcccttcaaatgcgaaasgactgccttcttgggtgagtgcattagctgggtagggtctgtcccggacctaactggatagtgtgggaagcagtggatcgttgtttcaaaaaccatttctttttgg

SEQ ID NO: 18404 - DNA, 391 bp, Homo sapiens
gaaaaatcaaagtgctactccactaagcatatgaataagaaagtgaaacagctttattgctgctagggagaaagtttgaatggtctgaatagaagatcaaagcaaccacaacatttccttaggctaaagcctaatccagagcaaggccctcgtttcaattctgtgaagcctaagagaggtgatgaagctgcagaagaaaaattggaagctagcagaggttggttcctgtggtttagggaaagaagccatctccatgagtgcagaatgaagcagcaagtgctgatgtagaagctgctgcaagttacccagaagatctagctaagatcattgatgcagatgactaaacagattgtcagtgtagaggaaacagccttccattggaagaaggtgc

SEQ ID NO: 18405 - DNA, 533 bp, Homo sapiens
  misc_feature 495..497: n=a, g, c or t
attatgataggacagaaagggaacatgggcagggacaaataagggaataaaagctggccaccccagccagcagtggtaaccggtttgggtcctttttcgcagtgtggagtcttcgtccttttgctcttcccaaaaaaccttgctgcctcttactttttgggtctgtgcaatctttaagagctgtaacactcaccgtgaaggtccgtggcttcattgatgaagtcagtgagaatcatgaagtcagccagagtactggtaggaaccaaccccagacacaccagcactttggtaggctgaagcagttggatcacctgaggtcaggagtttgagactggcctgactaagatagtgaaaccccgtctccactaaaaatgtaaaagttagccaggcatagggacggggacctgtaatctcaactacaggggaggctgaggcaggagaatcacttgaacctgagcgccagaggttgcagtgagctgaggtcgcatcattgannnccagcctgggcgacagagtgagactccgtctttgaa

SEQ ID NO: 18406 - DNA, 145 bp, Homo sapiens
aattagggctagaatggggctgatggaccatgaactacagttaaggaattggctttcattattatgggatatgtgcaagcttagtagaaatgaaaggctgaaaaagttaaaaagtgaagagctcagaaaagaagcaagasaatta

SEQ ID NO: 18407 - DNA, 187 bp, Homo sapiens
cctgtatggccctgtagccctgggcagagctgggcctgtcgtgtgttcctgcctggcagtgcaggtgctggccatctgcaggtggaaggaggtgggaatcttggattttttgtttttttttgtkttttttttttttgagatgaagyctcgctctgmcacccaaggctggcgtgcagtggtgtgatct

SEQ ID NO: 18408 - DNA, 503 bp, Homo sapiens
tattctttagtgtgtttgtatgtgcatgactatgcaagtagttttaaaaaataaatagccagccaggcacagtggctcacttctataatcccagcactttcgggatgctgaggcaggcagattgcctgagcccaggagtttgagaacagcctgggcaacatagtgatacccccatctctataaggataaaaaataggccgggtgtggtggcttatgcctgtaatcccagctatttgggaggccagggcggggggatcacctgaggtcagcagttgaagaccagcctggccaacatggtgaaacccgtctctactaaaaatacaaaaatccgccgggcgtgatggctcacgcctgtaatcccagcattttgggagaccgaggtgggtggatcatgaggtcaggagatcgagaccatcctggctaacacagtgaaaccccgtctctactaaaaataaaaataaaaaaattagccgggcatggtggctggcgcctgtagtccagct

SEQ ID NO: 18409 - DNA, 315 bp, Homo sapiens
actcttgtctgcttacgagggctcctcccttcagctttggtccctcggggcgtctgggcagcctacgctttccggataaaaatggcagaatgaaagaattatgagtggaactagagaataggaaagacatgaaccaacgcccaaaatgagaaagaaggacatataaagaaaaagacaaatacaagtgaaaaaaatagactaatggattaacgtccctgtcgtgtgacattttctggtatgacagctgaagatgttgaaccgtatggtgcagttttgcaaatagtgtatgaagtgggttgtaagttttaccagtaa

SEQ ID NO: 18410 - DNA, 499 bp, Homo sapiens
cttcagctttggtccctcggggcgtctgggcagcctacgctttccgaagtacagtctatataaagactgtccaggacaaaaactggccactccattcagcattgacagcagtatttaaagctggtgcatggtgaggtgaagtttctcaagggcaaagacaatgccttcatgcatgttcagtgtctgcccccgtggctttgaaatgatcgctgacaatgggggatctgcagtgacttctctgcctctgccaaagcccaggggtgctgctccctaattctaaggattctaatgagactcagagcaggtgtaacacagggcatggagcttcctgagcaagaggctggctaacaaactgtggacgtggtacttagacacattaagagacattacagggacacctgcaagtatgtctccctggggagaagccaagtgcagatgctatggccacagatgatatggtttggctctgtgtccccactcaaatctcatctcaagttgt

SEQ ID NO: 18411 - DNA, 369 bp, Homo sapiens
tttttttccggcccgcagcgcgcctgggctcccgcgtgtttaaaagtgcgcttgtggctgctgctgtcttaactcctgtgcttrggcggacagacaggcgagatggcggcggaggtgttgccgagtgcgaggtggcagtattgtggggcgcccgacgggagccagagagctgtactggtccagttctccaacgggaagctacagagtccaggcaacatgcgctttaccttgtatgagaacaaagattccaccaaccccaggaaraggaatcaacggatcctggcagctgaaacagataggctctcctatgtgggaaacaattttgggactggagccctcaaatgcaacactttgtgcaggcactttgtg

SEQ ID NO: 18412 - DNA, 408 bp, Homo sapiens
agaargstgggarggstgcgsggggctgcgcgtccgccatggagccgacggacttacgagccgggcttcgtgggtattcgcttctgccaggaatgtaacaacatgctgtaccccaaggaagacaaggagaaccgcattctgctctacgcgtgccggaactgkgataccagcaggaggccgacaacagctgcatctatgtcaacaagatcacgcacgaagtggacgaactgacccagattatcgccgacgtgtcccaggaccccacgttgccgcggaccgaggaccacccgtgccaaaagtgagcgttcagctggtactggggaggtgcggccacaaggaggctgtgttcttccagtcacacagtgcgcgggccgaggacgccatgcgcctttactacgtgtgcacagc

SEQ ID NO: 18413 - DNA, 389 bp, Homo sapiens
tttcgcttctgccaggaatggtgaggcggagggagcgggtgatgttagaaggcgggcgaggaatggctccagaactaacccctggcacctccccctccccacagtaacaacatgctgtaccccaaggaagacaaggagaaccgcattctgctctacgcgtgccggaactgtgattaccagcaggaggccgacaacagctgcatctatgtcaacaagatcacgcacgaakkgacgaactgacccagattatcgccgacgtgtcccaggaccccacgttgccgcggaccgaggaccacccgtgccaaaagtgcggccacaaggaggctgtgttcttccagtcacacagtgcgcgggccgaggacgccatgcgcctttactacgtgtgcaca

SEQ ID NO: 18414 - DNA, 340 bp, Homo sapiens
ctttttcccccacactcgccctctcgtagtgccggaactgtgattaccagcaggaggccgacaacagctgcatctatgtcaacaagatcacgcacgaakacgaactgacccagattatcgccgacgtgtcccaggaccccacgttgccgcggaccgaggaccacccgtgccaaaagtgcggccacaaggaggctgtgttcttccagtcacacagtgcgcgggccgaggacgccatgcgcctttactacgtgtgcacagccccacactgcggccaccgctggaccgagtgacctcctctctcccccgagtgtaataaacaccagattccatgcgtcaaaaa

SEQ ID NO: 18415 - DNA, 367 bp, Homo sapiens
ctcataaatactgataggaacacaatgatacttttttttcaccctttttatatgaacagtttgaagcataaagaaaagttgaggctgggcgcggtggctcatgcctgtaatctcaacactttgggaggctgaggcgggcgtgttgcttgagctcacgagttcgagatcaccctgggcaacatagtgaaaccccacctctaaaaaatacaaaaaattagcctgtagtctcagctactcaggagcctgaggtgggaggatcacttgagcctcggaagcggggttgcagtgagccgagatcacgccactgcactccagcctgggcaacagagtgagatcctgtctcaaaaaaaaaaaaaaaaaaggaaaa

SEQ ID NO: 18416 - DNA, 377 bp, Homo sapiens
agtcatagacgagtagaccttaggcgaaggaaggcatgtactttccctaagaagcgggaggagagaaataaatagagggcagtgggatgagaagaacctcgcgggatgggaagccgcgtagggaagggccgtctttggttacctggagagcgggacagctgcggatcccttatgaagtgcccggatgaagctccagcgctcacgcctttccgcattgagtgcagcgccatcttgagaagggcggasgtcttgtttggaatgacgtctgttcagagagccaatcccagtctcgcgactcctgcttgctgggcgcggcttgggcctccaggctgcgcascagccgctatcaggcggactgcagttcttgccgagcaggt

SEQ ID NO: 18417 - DNA, 522 bp, Homo sapiens
gaggataaggcgctgtcatggaggacgccgccgcgccggggcggaccgagggggtccttgaaaggcaaggagcgccggcagctgcaggccagggaggtactggaagatgctcacagagatgccaacctgcaccatgtagcttgtaatatagtgaaaaaacctggcaacatttactatctctataaacgggagagtggtcagcagtatttttccatcatttctccaaaggaatgggggacaagttgtccacatgacttccttggtgcctacaaactacagcatgacttgtcctggactccgtatgaggacattgagaagcaagatgctaaaatcagcatgatggacacgttgctaagccagtcagtggccctgcctccgtgcactgaacccaacttccagggactgactcactgagagtgggctttgacaaacagctctcacaggacctggctgtcaacctccttgttgcccccactgttgccttgagaattgaagacatgtaggtgactcacaaacttcttg

SEQ ID NO: 18418 - DNA, 483 bp, Homo sapiens
agtagcatggcgtcaagatacaccccaggcctgctaattcagaatctgcattttaacaagatccccagggattcacatgcaccttagagtgtgacaagccctgatttagaagatactatttgcagagcctgaagtacgtgaggtatggaaagagagacgacagaaaaagaaatcaccaagtttcagccttctgataaataaatacattgattaataatatggtacacaaagggatggagatgggaagttaaataatgacccaaggcagtgtgatatacaacacatgagtgtgcagtcccaattccttgtgacacagagcaccagagaagaataaattccagtgagtcggattagtttgtctttgatccattcagaaatgttaaattaatgttcttgacattatgaaataaaacaacacatctcaagtgcttacaatgatgtttagcacatggtgtgcagacaaccaactttaaaaaaaaaaar

SEQ ID NO: 18419 - DNA, 547 bp, Homo sapiens
tagaaaaatggctatttattttaaccttttttaatgttgctggtcataagtttatgttgctacttctttttaaatgaacaagaacagaaagggcacaaactttagttttggaaaatgtaggtattgtagctaaaaatgacatccctctgttccaatgctggaaaaagtgacatttctccttttctgagacctagcccaatttattgcttgtgttaatcaccctctggtattgtacaccagtggctggccttggatctgtattctccctgttggagataagaaatatctgctgtcatgaaaaaaccttttatcgtagaagagcggtatagctaatctgctttgtaatagagtagtgtacgctcttatccacggtttcactttgtgtggtttcagttgacctgtggttaactgcagtcagaaaatattaaatggaaagttccagaaactcctaagttttagattgcacccttttccgagtagcatgatgaaatctcgcactgtcctgcctaggaggtgaattatccctttgtcagcttatctacactgt

SEQ ID NO: 18420 - DNA, 97 bp, Homo sapiens
cccttctccccggcggttmgtgctgagagtgcggagtgtgtgctccgggctcggaacacacatttattattaaaaaatccaaaaaaaaaaaaaaaaa

SEQ ID NO: 18421 - DNA, 228 bp, Homo sapiens
aaaaaacgaaggcctttccggggacctgggtagtcggttgtaatggcgtttgcctgggatgcagcacctttggtgggccattagatgacgtgtcgcttctccaggggcttgctaggcactagcagaaatgctcccctgtgcttactcggtgttatggaagattgcttgcacaatgctattcgtacgaaaggatattattaaaagtgatttatgggcgggcgcggtggc

SEQ ID NO: 18422 - DNA, 102 bp, Homo sapiens
cttttccttcctctttccttacttccttcccttccctcggcttcccgctcttgcctcactctcagcggctgccttcgcccctgtctgcagacagcgccgctg

SEQ ID NO: 18423 - DNA, 476 bp, Homo sapiens
agtagctgcctgggcgccaaakgccgcggcactcccacgcggaccccgaagtccgcaacccggggatsggcccgcggctgcgagtctgtggattctagccttgggggtctttcacgatccagcactgtggccagcctcgacacagattccaccaaaagctcaggacaaagcaacaataattmagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggagaagaatttattatgggagtttccaagtatggcataaaagtatcaacatcagatcaatatgatgttttgcacaggcatgstctctacttaataatccggatsgtgtgttacgatgacggtctsggggcgggaaaagcttactgg

SEQ ID NO: 18424 - DNA, 412 bp, Homo sapiens
cacggttagttcccaaataaatcccagcctcctctcttctgttaatttcttcggaaggatttgaggtagcttttgaagtatttggtcaaagttgcaaactcctcgggaggaggccaggcatggtacctcacgccttaatcccagcattttgggaggctgaggcgggaggatcacctgaggtcaggaggtcaagaccagcctggtcaacatggcgaaaccctgtctctattaaaaatataaaaatgagctgagtatggtgatgcacgcctgtaatcctagctacttgggaggcttgaggcaggagaatcacttgaacccagaaggcagaggttgccgtgagatgagattgtgccactgcactccagcctgtgtgacaaaacaagactcctcctggaaaaaaaaaaaaaaaaag

SEQ ID NO: 18425 - DNA, 478 bp, Homo sapiens
  misc_feature 11,40: n=a, g, c or t
gctggagcggngaacgggagtagctgcctgggcgccaaangccgcggcactcccacgcggaccccgaagtccgcaacccggggatgggcccgcggctgcgaggggatcttctctggatcaagcaatggtggtgaaaaatgtttcgcaagggcaaaaaacgacacagtagtagcagttcccaaagtagcgaaatcagtactaagagcaaggacaaagcaacaataattcagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggagaagaatttattatgggagtttccaagtatggcataaaagtatcaacatcagatcaatatgatgttttgcacaggcatgctctctacttaataatcggat

SEQ ID NO: 18426 - DNA, 143 bp, Homo sapiens
ttcctgcctcagccttctgctgctttgctctctgggagatccagctccttgctctgtgtcccagtagaacatgatgtggcccatgcacaccccactgctgctgctgactgccttgatggtggccgtggcgggagtgcctcggc

SEQ ID NO: 18427 - DNA, 64 bp, Homo sapiens
atgtgaccggaagggctcctcacggacgccgtcctcctcggcgcggcctgagcgccggsccgac

SEQ ID NO: 18428 - DNA, 186 bp, Homo sapiens
  misc_feature 113: n=a, g, c or t
attctgtctggcaagcgccgcgcgawtcctcggttcccgccgcgccgttgccgccgctcctctccctcctcacctccccgcaagctgagggagccggctctggccttggcsancccagamaggggctcccacagtgcagcggtgagctgaagggttcctcaagcgcggccasagtgggcgccaagg

SEQ ID NO: 18429 - DNA, 509 bp, Homo sapiens
agataagagaataaaagcaggctgcctgacctagcagtggcaaccgttggggtctccttctgcattgtgggagcgttgttctctcactctgcagtaaatcttgctgctgctcattctttgggtccacactgcctttatgagctggaacactcactgcgaaggtctgcagtttcactcctgaagccaccgagaccacaaacccaccgggagaaaggaacaactccagacgcgccgtcttaagagttgtaacacacactgggaaggtgtgcagcttcactcctgagccggggagaccacgaacccaccagaaggaagaaactccgaacacatccgaacttcagaaggaacaaactctggacacgccgtctttaagaactgtaacactcaccgcaaggtcgtggcttcactcttgaagtcagaccaagaaccaaccaattccagacacagagatatgtttgccatacaaattattgttctgccgggtaaatgaagttgcatgtatctttcaa

SEQ ID NO: 18430 - DNA, 427 bp, Homo sapiens
  misc_feature 36,48,101,108: n=a, g, c or t
aacaaaagtgctgcagccgcttgctccggccggcancctagtccggcncgccgcsagctgtcgccgacatggaacccttggccagcaasatcyaggtcctnstgcagnsggccgagttcctggagcgccgtgagagagaggccgagcatggttatgcgtccctgtgcccgcatcgcagtccaggccccatccacaggaggaagaagcgacccccccaggctcctggcgcgcaggacagcgggcggtcagtgcacaatgaactggagaagcgcaggagggcccagttgaagcggtgcctggagcggctgaagcagcagatgcccctgggggccgactgtgccctacaccacgctgagcctgctgcgccgtgccaggatgcacatccagaagctggaggatcaggagcagcgggcccgacagctcaagg

SEQ ID NO: 18431 - DNA, 93 bp, Homo sapiens
  misc_feature 63..64,83: n=a, g, c or t
cctttgcaggacgtcactgaggactgcaggggcctgagccgctgctgccgccgccgccgcyannccacatcaacgcaccggkntcccgtaacc

SEQ ID NO: 18432 - DNA, 115 bp, Homo sapiens
cgagtgtattataaaatcgtgggggagatgcccggcctgggatgctgtttggagacggaataaatgttttctcattcaaaaaaaaaaaaaaaaaaaaaaaaaaaaaaaaaaaaaw

SEQ ID NO: 18433 - DNA, 134 bp, Homo sapiens
cgagtgtattataaaatcgtgggggagatgcccggcctgggatgctgtttggagacggaataaatgttttctcattcaaaaaaaaaaaaaaaaaaaaaaaaaaaaaaaaaaaaaaaaaaaaaaaaaaaaaaaah

SEQ ID NO: 18434 - DNA, 137 bp, Homo sapiens
cgagtgtattataaaatcgtgggggagatgcccggcctgggatgctgtttggagacggaataaatgttttctcattcaaaaaaaaaaaaaaaaaaaaaaaaaaaaaaaaaaaaaaaaaaaaaaaaaaaaaaaaaaaa

SEQ ID NO: 18435 - DNA, 55 bp, Homo sapiens
actcgctgggtcgctcgggtcggcttcggtcgctaccgctcccactctgccaccc

SEQ ID NO: 18436 - DNA, 358 bp, Homo sapiens
  misc_feature 324,355: n=a, g, c or t
atttgtctcgttctttcctcccagcaacttcgcggtgtggtgaactctctgaggaaaaacgtaagttcgagccctgattcctccgcttccccgcagtgaccttgggcttgtgccccggmcacccctgtcccgggtccctgttttctctctggaaatgggttgaagaccaaagaaaataatgtgcgccacttgggtcaccgggggccgcctgccccggaaaattggccccagttgaggagttgtggctgtaaggatgccttgaaccgaggcggcggtgctcgtggttggagctctccagggtgggtgcgcatttgtaatgcggtngatgctctgggactcggcccctctaaaggtnctt

SEQ ID NO: 18437 - DNA, 414 bp, Homo sapiens
gtctcgttctttcctcccagcaacttckmggtgtggtgaactctctgaagaaaaaccattttgattattactctcagacgtgcgtggcaacaagtgactgagacctagaaatccaagcgttggaggtcctgaggccagcctaagtcgcttcaaaatggaacgaaggcgtttgcggggttccattcagagccgatacatcagcatgagtgtgtggacaagcccacggagacttgtggagctggcagggcagagctgctgaaggwttaggccctggccattgccgccctggagttgctgcccagggagctcttcccgccactcttcatggcagcctttgacgggagacacagccagaccctgaaggcaatggtgcaggcctggcccttcacctgactccctctgggartgctgatg

SEQ ID NO: 18438 - DNA, 61 bp, Homo sapiens
  misc_feature 12: n=a, g, c or t
accccgcgcgcntctctgtcgtggcgcggcttcccgggtcttctctgcaaatgggctccgt

SEQ ID NO: 18439 - DNA, 478 bp, Homo sapiens
atgtaataaagtatataatttttttatgttttgtttctgaaaattccagaaaggatatttaagaaaatacaataaactattggaaagtactcccctaacctcttttctgcatcatctgtagatactagctatctaggtggagttgaaagagttaagaatgtcgattaaaatcactctcagtgcttcttactattaagcagtaaaaactgttctctattagactttagaaataaatgtacctgatgtacctgatgctatggtcaggttatactcctcctcccccagctatctatatggaattgcttaccaaaggatagtgcgatgtttcaggaggctggaggaaggggggttgcagtggagagggacagcccactgagaagtcaaacatttcaaattttggattgtatcaagtggcatgtgctgtgaccatttataatgttagtagaaattttacaataggtgcttattctcaaagcag

SEQ ID NO: 18440 - DNA, 302 bp, Homo sapiens
aaaggaaattagtgaccactcaaaagtggaattcgtaggagccatcatttcattagaacatcagaatccatcccaggggaccctgccttcaccctttcttcacacacagttgatgaaggggggaaaatgtatctgttggaatttatcatgaaatggatggaaatctcacctgggggcaagttgccactgaaaggaatatacagtcaaatcttgactaactggaatgcttgaatgaagcagatggaaaaggacaaagaaaaaaagacaaaacttcagacattcactttgacattaaaaaagaa

SEQ ID NO: 18441 - DNA, 464 bp, Homo sapiens
agcgggctgagccaccggcttggcgcggcggccaaactggtgggacagtgtctccaggtagtgaggcccaacctctttaaaacaaacaaacaaacaaacaaaaaaccaaaatgcaaacgtgagtagagaatgaaatacacagtttaaatgccctcactatctttgggttactaatatactaagcctttctggactaagtaaaagatgcaggttcctgcggctagggatagaagccagactggcgtcttcagaatctcccaccaaggctgtacctctggaggagttctaggtttggatttggtcatctcaagaagagtcttcagatggattttaaaattgaacacacttgggatggttttccagtgaagcatgagcccgtatttatcaggctgaatccaggtgacakaggagtgatgatrgacattagtgctccatttttcatggatcctccagccccacttgga

SEQ ID NO: 18442 - DNA, 518 bp, Homo sapiens
aaaactgttctggcgctgatgggagtgtaacaatgaggacaaccagaggtcactgtcatcaccattttggttttggtgggttttggccggctcctttactgcaacctgtttttatcagcaaggtctctatgacctgtattgtgtgctgacctcctatctcatcctgtgacttagaatgccttaaccgtctgggaatgcagcccagtaggtttcagccttattttacccagctcctatttaagatagagttgttctggttcacctgcctctgacactatcaccaggtagacagtgtttgttagaagtgagttaaattgtaggacactcagttgttatccactggagaattgcttggttgtcgacagggggacatccccacacattctggtgaccggagggaagtattctgtgttgagtgttttaactgtgtgagagcaggaaaacactgttttttttgttttgttttgttttgttttccccatccttttcaaagactacattaaacgctaaggagaaag

SEQ ID NO: 18443 - DNA, 377 bp, Homo sapiens
acaacctgttttatctgcaaggtctttgtgacctgtattttgtgccgacctcttagctcatcttgtgacttagaatgccttaacctgctgggaatgcagcccagtaggtctcagcctcattttacccagcccttattcaagatggagcttctctggcttaaacgcgtctggcacatacagagttaaaaaaaagaaaagttgccagatttgtacagatcaggaacttttgcttctcttagaaatttctgacttcgtctgaaaaatcagaacataggccaggtgcggtggcttacgcctgtaatcgcagcactttgggaggccgaggcgggtggatcacgaggtcgggagttcaagacaagcctggctaagatggcgaa

SEQ ID NO: 18444 - DNA, 387 bp, Homo sapiens
atggcatttgtaaactgtcatggtgctggtaggagtatcctttagcatgaaaatacattgtaattattgtgtaatgaccagtgaggatgaacagaggttactttcatcatcaacttggttttgatgagtttgggccaactcctttaccacatgctttattatcagcaaggtctttgtgacctgtgtcttgtgccaacctcctatctcatctgaaaccaacaatcaggcctcccacatagatcaaggaattgaaacttaccagatcacttcatctggacaatgagatactagacaccttacccatcatgagtgcctaagckaccacctgctattgggttaccagctcctcttccatatccctccctaattcctgttttcccacacatg

SEQ ID NO: 18445 - DNA, 275 bp, Homo sapiens
  misc_feature 234: n=a, g, c or t
arttttatcaccatcttggttttkgccagcttctttactgtatcctgttttatcagtggggtccttatgttctatattttgtgtcaacctcctagctcatcctgtgtctaagaatgcccaacatcctgggaatgcagtccagaaggtctcagccttattttacccagcccctgttcaagatggaggtgctctggttggaatgcttctggtagtttggctagttattatcttttnaaaaatttcaaagatgttctcacctggttattctttttttt

SEQ ID NO: 18446 - DNA, 278 bp, Homo sapiens
tttgtcttctgtggtttcagttaaagttctaaagactattttactaaaagtggaattgactttttgtattcaggggaacttgtcagtggttttcatattatgtgccgtggagtcccaggattccagaagatgcctcaagggagacccctcccttcccccgtatcccttccagctttaagcagcctgtctgctttaagctcttatatatattgagattctccatgagatttcatttgtataaatgatttcacagcttacaaaaaaaaaaaaaaaaaggc

SEQ ID NO: 18447 - DNA, 216 bp, Homo sapiens
aaaaaacgccggcgcctccgtccccagccgcggctcgggaatccacccgaagagtggctataaacgtccgcgcctccattgcgctctccttttcacttaggacactggtcctcccacgcctgacaccgacgtcgccaggaccgcggggttgggggaacttggctgtcccacgtctttcaaataaagctgttttgtcaaaaaaaaaaaaaaaaaagt

SEQ ID NO: 18448 - DNA, 396 bp, Homo sapiens
attccacccggcatacaggcttatggagcagccccctttgaagatctccaggtagattccacagagatgccaaagtgtggaggtaacaagtatttacwagttcycawggtgcctaactgggtgggtggaggcttatccaacatgaactgagaaagctcgtgaagtaacccgtgtgcttcttcgagatcttattcctagatttggactgcccttacggatcggctcagataacgggccggcatttgtggctgacttgatacagaagacagcaaaggtattggggatcacatggaaactgcatgccgccwaccagcctcagaattccggaaaggtgragtggatgaatcggactatcaaaaatagtttagggaaagtatgtcaggatacaggattaaa

SEQ ID NO: 18449 - DNA, 425 bp, Homo sapiens
ggggtttctaaattcactgttgagtgctgtggattacttttggaaaggcttttcggagcgcttctgaattttcagattctctaactatccctaacggtgcctggatgtgtgtctgagaaaaggcagcagactcggagaggttgaagggtcgggtcaaagcaaaagatgcgtttgtgaatgtcagacatttggaggctcttcagtggctccttagcatcagggatgccaggcagtcccagtggaagcgaagagatactcggcaagtggctgctggtaatgggacgcaaatgttgacttgatttgtgggacatccacgctgagaactgagtgctcacgtaactcaaatgggggtaatttggtttgttccactatatgtttatcttcaataaaatacctactgtctgtgcaaaaaaaaaaaaaaaaag

SEQ ID NO: 18450 - DNA, 515 bp, Homo sapiens
cctttccggcggtgacgacctacgcacacgagaacatgcctgtgagtgctttggtccaggtttcggcggagatctcgctgttctgtccgaactctcccctcacgctgatttcggatcgtagagggtcctcatttaccctctgcacttcttaggacattaactccagggaccgcagcggcccacgggcacccgcatagacgggagcggagaggagataagatggcggcccagctgcgcagacaccaggggcggcgaggggcgagctctccccggtgtgtkacagtgggggctattttcgaccatcccattttcgctgttggtttctaaatctctgcatttctgtccctcttagctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtg

SEQ ID NO: 18451 - DNA, 493 bp, Homo sapiens
cctttccggcggtgacgacctacgcacacgagaacatgcctgtgagtgctttggtccaggtttcggcggagatctcgctgttctgtccgaactctcccctcacgctgatttcggatcgtagagggtcctcatttaccctctgcacttcttaggacattaactccagggaccgcagcggcccacgggcacccgcatagacgggagcggagaggagataagatggcggcccagctgcgcagacaccaggggcggcgaggggcgagctctccccggtgtgttacagtgggggctattttcgaccatcccattttcgctgttggtttctaaatctctgcatttctgtccctcttagctcgcaaaggatctccttcatccctctccagaagaggagaagaggaaacacaagaagaaacgcctggtgcagagccccaattcctacttcatggatgtgaaatgcccaggtgaggagacggcttgctgtagtggggaaagc

SEQ ID NO: 18452 - DNA, 416 bp, Homo sapiens
cctttccggcggtgacgacctacgcacacgagaacatgcctgtgagtgctttggtccaggtttcggcggagatctcgctgttctgtccgaactctcccctcacgctgatttcggatcgtagagggtcctcatttaccctctgcacttcttaggacattaactccagggaccgcagcggcccacgggcacccgcatagacgggagcggagaggagataagatggcggcccagctgcgcagacaccaggggcggcgaggggcgagctctccccgctcgcaaaggatctccttcatccctctccagaagaggagaagaggaaacacaagaagaaacgcctggtgcagagccccaattcctacttcatggatgtgaaatgcccaggatgctataaaatcaccacggtctttagcatgcac

SEQ ID NO: 18453 - DNA, 276 bp, Homo sapiens
agaagttgatgcccagcgcagatcgcttgcagcttgctagctgtgtgggctgggaggtctggtagggctgagcttgcaagaggatcaacatgcctttggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgt

SEQ ID NO: 18454 - DNA, 373 bp, Homo sapiens
  misc_feature 160..161: n=a, g, c or t
cctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctatanntcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaaaaaaaaaaaaaaaaaaad

SEQ ID NO: 18455 - DNA, 406 bp, Homo sapiens
agaagttgatgcccagcgcagatcgcttgcagcttgctagctgtgtgggctgggaggtctggtagggctgagcttgcaagaggatcaacatgcctttggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacatgaggaaaggccagactcacagaagggtgttcatttagaagaaagcaacactaatgattcaaacagcttcctgaattttaattttgtgttgtctcacagaaagccttatcataaat

SEQ ID NO: 18456 - DNA, 421 bp, Homo sapiens
agaagttgatgcccagcgcagatcgcttgcagcttgctagctgtgtgggctgggaggtctggtagggctgagcttgcaagaggatcaacatgcctttggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacatgaggaaaggccagactcacagaagggtgttcatttagaagaaagcaacactaatgattcaaacagcttcctgaattttaattttgtgttgtctcacagaaagccttatcataaattccataattctaatt

SEQ ID NO: 18457 - DNA, 55 bp, Homo sapiens
cctttccggcggtgacgacctacgcasacgagaacatgsctctcgcaaaggatct

SEQ ID NO: 18458 - DNA, 148 bp, Homo sapiens
ttcttaccatgtctgttttctttgtctcaaatagttccactaatggactatattttttcggttgagaacttgtcgaacagaattttcttttttttttkwaaccttsagtagggaaaaatgtttgtttaaagawtgrgtaatggccagg

SEQ ID NO: 18459 - DNA, 484 bp, Homo sapiens
gaagattaggactgatacttaaaaccaaacgtaaaattccaggtggtgttgctatggggagcagcattaggacaatctgagtggtttcagttgcaagactgtgcgtgtacgtgcaagaactacagtcaaggttcaacttctggcttttagggtctctttaataacagtaataacaacctaaggcagtttaacggtatggaatggttgccttttagaagttaagctatgggcatggaagttcaatcagtacattgaagtttttcctttatctctcctatggttaatggtttctgcagaaaaggacctattgatttctttctaaaacgttgcttcagggtgtagagacctttataggtcatgtttcaacttacagaaaattttatagttcaaatataaattacattcaatgtggactttgtaatagaattgaaggtcaagtaaagtttccacttttcttaggctgtttgcagtgccagcaggcccc

SEQ ID NO: 18460 - DNA, 338 bp, Homo sapiens
cagaaaatttttatagttcaaatataaattaagttcaatgtggaatttgtaatagaatttcaggtgaagtaaaatttccactttccttaggctgtttgcagtgcccagcaggccccatgatatcgagatggaagttctgttaaaggaggagattgatcagggatgggcagaataaggaatatgggcagctcaggcataatgatacaatgattgagatgtagaaagagggccgggcatgggataacgcctgtaatcccactgccttgggaggccaagacaagagaatcgattgaggtcagaccagcctggtcaacagagtgagacctaacctgtacaga

SEQ ID NO: 18461 - DNA, 107 bp, Homo sapiens
ttctttgttaggaaagatctaaatatggtccttgacttttaataatcattctttagaatgttaaataaaggcaacccaattaaagggagaaaaaaaaaaaaaaaaaa

SEQ ID NO: 18462 - DNA, 56 bp, Homo sapiens
cttttgcgttctctttccctctcccaacatggcggcctcagcaaaaaaaaaaaaaa

SEQ ID NO: 18463 - DNA, 462 bp, Homo sapiens
catctaataattggagaaatctggtatgtcacaggctgcagtgtaagcctgtcaagcaatatgatgaagaggtgcacatggggagagctgttttaagtatgtcttttggttccctgggttagaattttttctgctttttcttacctgccttcatccaaagttgggggtcaactgcagatcctgaaaagtggatctcaggaatagtcccccatgtcctgtcactgctgaatctacactaagaatggacaagtgtgttcaaggctggcctgcctttgtaatcagtcctccgtgggctatgcagggatcccactagttacgcactcatctgttgcagcatatcagctgcggctgtactgtagaagaatgcaacgccctagtggcaaatgctgactccaggaatgcggaggaggaggaggactgcatagctcatcactgggggccacttgactggagcagctgtgc

SEQ ID NO: 18464 - DNA, 76 bp, Homo sapiens
ctttttcgcaacgagtttgccgccagaacacaggtgtcgtgaaaactacccctaaaagccaaaaaaaaaaaaaaaa

SEQ ID NO: 18465 - DNA, 414 bp, Homo sapiens
agcccgggagctcgagaccagacgcggcaacatggcgagacgcacatctctgcctttaaaaatgagaggctggcggttacctttcttggggagacgcgtccgactgcttcattgtgggggcctcaggagcggaggatcgggtcccgcccgaggtgacgcgtaaacccagactctcagcaacgcgggtaggaaggacccttgaagttccgcggcgaccacgtcggctgaaaccagcagcccaggacaagtggaccagccagcaagacccagaccatccaaaccggctgatcctacgacaggacccagatgccagtgaaagtgaccacagccctgctctagtcaccccggaagctgaccagtctacgcacggccgaagcgtcgtcaaggaagtaaatgtagttagaaatctcaaaa

SEQ ID NO: 18466 - DNA, 398 bp, Homo sapiens
  misc_feature 245..246,290: n=a, g, c or t
attatgttttacaaatgtctgtatttagccagttcttgattttcttttgacacagctccaaggccaccagctatgcaaggccacaagttatgcactatatgattaactgcttttgttttacttttggggctggagccctgggccaagggagacctgtgaccccaggtggccgscsggragaacttcagcccagaggggaaatcagctctccgtgacccagcacccctacccagcagcgcaacagnncctgaaggagctacaggatgattctagaaacagcgcacttcavnaatcatgttgcaggtgttgtgcattggatccaccacagtcggctgaaactgacaactcaagacaagtggaccagccagcaggacccagatcatccaactcggctgatc

SEQ ID NO: 18467 - DNA, 427 bp, Homo sapiens
agtgacgtcgtaaattggaatgaggcatccagtttagcaacagcagagatgacgactctgcgattctgagagtccctggcgagcccgggctagcgaaaagtgggggcagaacgaactacatctcccatcgtgccaggaggcggtcccgcccgtttccccctgggagttgtagtctaaccccctcggatccaacagcaacctcagtgcgtgaactctgttatccagaaggcctcgccctgccgccgccgaagctggaattcgtcggctagtagttctcgccggcaactagaggaacctgttggcgtggccagaaggcttagcgggattgcacgaggttagttgctaagcaaggtggtctttggtcaactgccgcctggaccaaggcaacaggaaccctcagattcatcgctaccccgaggctaagcgc

SEQ ID NO: 18468 - DNA, 440 bp, Homo sapiens
  misc_feature 48: n=a, g, c or t
ctcttgccccattgctctttgcaggggtagaagaaggaagtgtagcgnggtaaggaatgcaccgtcaggtctctcacaaccctttcccagctctcctccccaacaaacagtacctgggatggagccctagggtaatcgcagccacgggatgggtcgaggtgacaggcttcagggaccacacttcggcctttgcccgaccttccacaacttaagcgaagagaggccaccagccgtaacagggcgttaaagcccaggggaagattggtccttatgacttcctgccttccagccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcg

SEQ ID NO: 18469 - DNA, 439 bp, Homo sapiens
taatctcattttacctcagctttactatatgttaggtagacaaaataatagtttctacgtcacaaggttattttgagaattaaatgagttaatatgcataaaacactcagatcactgccaggcacataagatgtgggtcgagcgcagagctcatacctgttatcccagtgctttgggaggctgaagtgggaggattgctagaggctgggaatacacaactagcctgggcaacataaagagaccttgtctctacaaaaatttttaaaaaaattagctgagcatggtggcgcgtgcctgtagtcccagctactcaggaagctgcagagggagcaccatttgagcccaggagtttgatgctgcagtgagctatgattgtgtcactacactccagtctgggtgacagagctagatcttgtctctattaaaaaaaaaaaaaaaa

SEQ ID NO: 18470 - DNA, 412 bp, Homo sapiens
tcaataaggtaattgtagtgagcttggactcttgtcccttgcacttgctttatgaccttgaataaattactacttcttgctctacctcagttttcacatatgaacaatgagattaatagtaatatctatttaagtagggatgtgagaattaaatgagttaatacatgtgaagcacttagcccagtgcctggcagatagaaactctatataaggttaaaggtaataatggtggtagtagtagcagtagttatatgaggatttaaatttcttctttcatgccaggcatggtggctcacgcctattatcccagcactttgggatgccaaggcaggcagatcacttgaggctgggagttcarcaccaacctgcccaacctggaaaaacccgtctctactaaaaatacaaaaattgg

SEQ ID NO: 18471 - DNA, 410 bp, Homo sapiens
tcaaacaaatggaagggaaaatttggggaggcagcagccaggtactgccaggtaattggagataggccttccagataccagcgaccagtgaagttgaaatctcccgtaggggttggatagaatggagcagcagttaggccccctagtgtctgctcagccacctggggcagcagaatgttgtcaaacttcttcattccataccacaatcaaatggagggacccaactctgaaaagatggtaagaggaagtgatctgaattggaggaggaggatttagattagcttttgaggaaacttcctcatgcctgtgaggttcttcagggggcgactgaaggagatcagagctctcaaaggatggggcagaaaaattcaatttcagcttgaggaagaagcctatgatcagaatcagag

SEQ ID NO: 18472 - DNA, 440 bp, Homo sapiens
agttcagcgcacgccggagccgagcgcagggggcggggaagggacctgctgcagctgcagccgcctgggcgctcctggagcgcgcggtgactcccccggtcggcccgctccatgcagctccgttgcggaagtgtagcggggggaggcggcggccaccgcggcactaagcacgagaggccggggctcggccccctgcagcactaggctctgggagccgcgcgcggcgcgtcccagtggcccgactcgccgtgcgcccggcgcccaccgcagcctgcatgccccgcgctgcgccttgcccggcccccgcagcctcctgctcgcaccgctgcagccgggcgccggagtaatatgctcactcgagtgaaatctgccgtggccaatttcatgggcggcatcatggctggcagctcargctccgagcacggcggcggcagctgcgg

SEQ ID NO: 18473 - DNA, 417 bp, Homo sapiens
acagaccccctcacagcccagcgcagtgcaggcccttggagagcaggagttagagatggggaggacgtgctgcaacaggcactgccctgctacaccctgcccatgggcagaggggatgtcctcccamcccacagaggccccatccttcccttttctctccctaaggctgctccagcagggagtttagctcccatggacacctttgaagactgtgaaggcgcagaagacatggaaaaggagagcagtgctctgagtctcgcgggccttttccagtcggacgacagtcacgaaacctgttcctccaaatctgctttcctggagargggagaaagcagccagggagaaaaagaagaacgcgatgaggaggaaacggcgacccgcagcaccgaggaggagcgcgctggggcgtccacgggc

SEQ ID NO: 18474 - DNA, 426 bp, Homo sapiens
ctctgttctttttcaagattgttttggctgttaagggtcccctgcgattccatgtggatttcagaattgatttttctatttctgtagaaaacatggggatattaatagggtttgtatgtattgaatctgtagatggctttgggtagtgctgatatcttaatatcggatcttctgatccacaaacacagatgtctttccatttatttgtgtgtttaatttcctttgatatgtaccagtcatttgtctccttggtttcttacgtattatttttttgatgttactgtaaatggaattgctttaataatttccttttcagattgtccattgttgatttatagaaacacaactgatttatctgtgttgatttttgtatactgcaacattgccgaatctgttagctctaagagtttttttttttttttcctg

SEQ ID NO: 18475 - DNA, 498 bp, Homo sapiens
  misc_feature 2: n=a, g, c or t
angctcgcaagtgcgcgtagccgtggcggctggtgtggggttgagtcagttgtgggacccggagctgctgacccagcgggtggcccaccgaaccggtgacacagcggcaggcgttagggctcgggagccgcgagcctggcctcgtcctagagctcggccgarccgtcgccgccgtcgtcccccgcccccagtcagcaaaccgccgccgcgggcgcgcccccgctctgcgctgtctctccgatggcgtccgcctcargggccatggcgaacacgagcagatcctggtcctcgatccgcccacagacctcaaattcaaaggccccttcacagatgtagtcactacaaatcttaaattgcgaaatccatcggatagaaaagtgtgtttcaaagtgaagactacagcacctcgccggtactgtgtgaggcccaacagtggaattattgacccagggtcaactgtgactgtttcagtaatgctacagccctttgactatgatc

SEQ ID NO: 18476 - DNA, 324 bp, Homo sapiens
tgttgtaaaagtgtaaaccagcccatgacaggtttttgtacatgttaaagaacttcattgttcagttttcatgattattgtgtaaggaagactgatgtagatgttctgtgctgtcctggaccatgttaattacacttacgacgtattttagttccacatcacaatgatttgtccccagtgacccttttatcctttctaggcacatttcttgttgttgttgttgttgcagttcccctttgcattgtattgctttgacaactgtaatttgaatcagatctgaaagaggtccagaataaaatatattttgatattaaaaaaaaaaaa

SEQ ID NO: 18477 - DNA, 237 bp, Homo sapiens
tttaattatttgttcatcagttgatggacattttggtgttttcacttttggctatttttgagtaatactgctgtgaacattcatgtacaagttttttgtgtggacataggtttttatgtttataaaacatgttttatgtttatgtytttatgttttatgtttatatttctcttgggtacattccacctagaagtggcactgctgggtcatatggtaacttttwttttttttttgaaa

SEQ ID NO: 18478 - DNA, 478 bp, Homo sapiens
ctaagctcgttcttccgccagcttccctcctcttcctttctcagccatcgtggtgtgttcttgtabtccgctgctcgccatgtcttctcacaagactttycaggattaaagcggattcctggccaagraaccaaaagcaaaaatcgtcccattcccccagtggattcggaatgaaaaactggaaataaaaatcagggtacaaactccaaaaggagacattggagaagawaccaagctkggkccataaaggratttgcacatgagatggcacacatatttatgctgtctgaaggtcacgatcatgttaaccatatcaagctgaaaatgttcacccactatctggagattttcgacgtgtttttcctctctgaatcttgtttatgaacacggttggttggctggattcagtaataaaatatgtaaggcctttctttttaaaaaaaaaaaaaaaaagstcttwtcgataccgtcgacctcg

SEQ ID NO: 18479 - DNA, 303 bp, Homo sapiens
actctcgtctggccgccgcgctttcaggaggtgcttttggttctctccggtcttgtccacgctagggggtgcacgtactcccaactgtggtcgcgctctcaccccttctgctgctctcgtggccccctcgcgatggcgggcatcctgtttgaggatattttcgatgtgaaggatattgacccggagcaagaagtttgaccgagtgtctcgactgcattgtgagagtgaatctttcaagatggatctaatcttagatgtaaacattcaaatttaccctgtagacttgggtgacaagtttcggtt

SEQ ID NO: 18480 - DNA, 311 bp, Homo sapiens
actctcgtctggccgccgcgctttcaggaggtgcttttggttctctccggtcttgtccacgctagggggtgcacgtactcccaactgtggtcgcgctctcaccccttctgctgctctcgtggccccctcgcgatggcgggcatcctgtttgaggatattttcgatgtgaaggatattgacccggagcaagaagtttgaccgagtgtctcgactgcattgtgagagtgaatctttcaagatggatctaatcttagatgtaaacattcaaatttaccctgtagacttgggtgacaagtttcggttggtcatag

SEQ ID NO: 18481 - DNA, 326 bp, Homo sapiens
gccactctcgtctggccgccgcgctttcaggaggtgcttttggttctctccggtcttgtccacgctagggggtgcacgtactcccaactgtggtcgcgctctcaccccttctgctgctctcgtggccccctcgcgatggcgggcatcctgtttgaggatattttcgatgtgaaggatattgacccgggaggcaagaaagtttgaccgggaktgtcycgactgcattgtgagagtgaatctttcaagatggatctaatcttagatgtaaacattcaaatttaccctgtagacttgggtgacaagtttcggttggtcatagctagtac

SEQ ID NO: 18482 - DNA, 437 bp, Homo sapiens
aagagcgatttgctgaaggaaaaatcggactgcaaatcattccaaggccaaactgcaactgagccacccactcccaaacaggaaaccctggtgaaggttcaggaagcacggagattctctccaacaaaggtccagttaggaaacgacgctgagaggatgacgacaacgtgcaacagcagaaagatgcttgcaagcagagtcagggtcaccagtgaatgccacaaaagttctctttcccactgtttaatttgacaagagaagaatttgaaggatatgaacattttcaagaactctgctgaggtcacttagagcgccatcacaacttatttgtgtgactaattgcctagattgtaagctctttgagggcagggcttgtctcttacacatctttataatcccctgcagcggctttcagtattttgtacttgtaggcacct

SEQ ID NO: 18483 - DNA, 353 bp, Homo sapiens
taggataacaggtgtgagccaccgtgcccggctgaagatttttcttaattgcaataaatattcagcattttttctaatgaaaatgaattttgtttaccagtaaaagtatgcattttaaaagactttcagatttatgctttttacgtgaagctgctaaactaaaagtaaatggaagaaaccaagtctagtaggttttttcttttttttttgtgggggtgggatgggggaggttagttacacttaaaatatcttctccagagactgtatgctcctatactagactgtaagctctttgagggcagtctgtcagatttatcttkgtatcttccccagcgcctagtgtagtgccttgc

SEQ ID NO: 18484 - DNA, 102 bp, Homo sapiens
taagcttccttctaacaagggtagtagacgtacgtgtctgtgtcttctgttctctaggtrtkgattstgsaatgctgcacagaaacctactgcarcctcaga

SEQ ID NO: 18485 - DNA, 472 bp, Homo sapiens
agttggtcttgaggctgaggaagaggagcttactccacgggaacagcctctagataatctgagttgttgaaaatacgaagcctgttactcgtgaacagtggctgacaacagtgttgttgtgagcctggctgtctgcttggacccagaggtttcgtctgccagggtttttggttgtatttaggatttcagggaaaagtgtccaagctttcagtgttggagcaggtaaggtatcaacactgttagtagcaacaaaattttaacttaataagtctgtatttgctatttataaagtggcatttgtaaagaaactgatagtagaatgtagtattcgtattcatttgaaatacattcagccatttgtatcagcagtctctatagcagcagattctgcatctgtggattcaaccagctgcagattggaaatatttgggggacaaacaataaataataatctgacaataaaaaataataa

SEQ ID NO: 18486 - DNA, 577 bp, Homo sapiens
tagcatgtcccaagtaggggctgcccctttagtctaggaaccaggatgataagacacatggagcagagccacagaagctcacatgtaaccacaacggtcccacgtaatgttagagaaacaaatgctcttgtaacactgagattcttggtggtattattgcattaaagttgactaatgtacctcccaccaaccgtaagagataggaattgttattatcctgtgatattgtgaaatacatagttgatcttctccccgtttcctgacatacaacttctaaaatccttagaatctccaaagtgatgtctttttatatgctgatgagttgactgatgcctggcagcccctgggtagcttcaggatggggctggtcactggaaagaccacagcaggattagaaggatggcaatttcagctccaccccatcaacatctggggaggagggcaactgaaggtgaagtggatcaccaatggctgatggattaatcaatcatgcctgtgttacaaagtctccataaaagctcccaaaggactgggttcagagagcttctggatactgaacacatggatgttactggag

SEQ ID NO: 18487 - DNA, 493 bp, Homo sapiens
acatttttcacatcctgttattctgggttttgtgacttgctgccttgccactatgaagacgtttgatgcaaatgatttgtatcaggggcagaattttaacaaggtcctcagttccttagtgactctaaataaagtaacagcaggtaagactcttttttattgaactcgagggggtgggaagacatactggctgacacctttggttttcttgttttaccaaagccaggggagcattactgaatttaaaaaataagcttttgttgcattacgttttgattgttccttttgctgtgatattttatttgccttgttagaatagaatcttctttaaatgttctggtatatatcaggtgttttcctttctgtgggtggagagatttctcacctgaacgtatagcaggagaaaagtgtctagttcttatgggaaggctcatgggctgtgttggagctagaagcacctttctctcagtttttactgagtgtatgctggtta

SEQ ID NO: 18488 - DNA, 319 bp, Homo sapiens
caatcaattaacatgttttgtctggtagatatatactgtattcttacaataaagtaagttagaggaaagaaaaaggaaaatcataagggagagaaaataaatttactactcattaaatggaagtagatcataataaaattccttcatcctcatcattttcacattgagtaggctgaggaggtggaggaaaagtagaggttggtttttgttgcaggaagtcagggaccccgaacggagggaccggccgaagccatggcagaagaacgtggattgtgaagatttcatgaacatttattagttccccaaattaatactttta

SEQ ID NO: 18489 - DNA, 435 bp, Homo sapiens
aaagccgagggagccggctccggcctccgccagctcagagaagggctcccacagcgcvstcgggctgaagggctcctcaagcacggccagaatgggcgcctggacgaggccggggaggcaccgagaacgagtgagggctgcgagggctgccaggtccgccagcacgctgtcacctctcagtttgagaaccatgaactgaagttgttgcaggaagtcagggatcccgaatggagggaccggctgaagccctggcagaagaacataaattgtgaagatttcatggacatttatcagtttccaaaattaatacttttataatttcttatgcctgtctttactgcaatcttggaacataaattctttctggaacaatgtcaaaagtcattcatttggggggaactcattctctacaagcaaactacaaagcctttgcgt

SEQ ID NO: 18490 - DNA, 405 bp, Homo sapiens
tttttttatgattttggaactcttataagtcctgcatttcataagcaagaaatagtgtttctccaagcttgttgccttgtgtaagtatttgaaaagaatattgaggccggtcgcggtggctcacgcctgtaatcccagctctttgggaggccaaggcaggcagatcacctgaggtcaggagtttgagaccaccttgaccaacatggagaaaccctgtctctactaaaaatacaaaaaattagccaggtgtggtggcacatgcctgtaatcccagctactcaggaggctgaggcaggagaatcacttgaacctggaggcagaggttgcagtgagccgagatcatgccattgcactccagcctgagcaacaagagtgaaaaactccatctcaaaaaaaaaaaaaaaa

SEQ ID NO: 18491 - DNA, 680 bp, Homo sapiens
ttaatctacatcattgtagatactgttgcattttttctaatgatatcttaaggataaattttggagtgtgttattatgttaaggggtatcagtgtttttatggctcctcacatatattgtcctactgttttcaagggtgttataccagtttgtgctcctaacagatatatggatatacctgttttaccataagtagtagagaaaaccatttttcttcagaagtttttgtgaatttaatagtgtaaaatggcactttcatttctttgttatataatgttgaatttaactatttgagcctctttatggtgaactgtttgttgatatcagttgctatattatgcaattaactattgtaggctttgaatggtaaggctggtataatatggtcagtaaaaattgttcacaagagtgtgtggtcgaggctgggtgcagtggctcacgcctgtggtcccagcactttgggaggccgaggcgggcggatcgggaggtcgggagatcgagaccatcctggctaacacgatgaagccccgtctcttctaaaaatgcaaaaaattagccgggcgtggtggcgggtgctgtggtcccagctgctcgggagtctgaggcaggagaatgggtgtgggccccgggargtggagcttgcagtgagcctagatagagatagcaccactgcgtacagc

SEQ ID NO: 18492 - DNA, 553 bp, Homo sapiens
aattaaacgatttttcttgttgcaggggattgcagtggcaaagctaggctaggtcttggaggctggtgtaaggcgatgtgggtgaaggcaggaggctgatggaaagactggggggaagaaaagccgaaatggattcacggtgccttggatgaaggacgagaggggaactgcaagctccttcaactggttctgtccggtgagaagtgatcaagcttggggctgacaagatgctcagcgagccctcacgtttctttcgcttttttacctgccaatcaaactgctacaagacaacaccctgatctggcatggacatatccaacttagaaataatgtttcattcaagataaggctcgtggcttaggagattgtgacctggcttgcatcattctaagacttctatcgtctgttttcaaaacccaaggaggaccctccttttctgtgtgatagttcctcatgctttgccagccactgggtctttaaggaagcttgccaagagttcccggctgggaaggacagttcgagttcatcataggacaatgagctggcaccacag

SEQ ID NO: 18493 - DNA, 460 bp, Homo sapiens
  misc_feature 19: n=a, g, c or t
cacacacacaaaatcgttntttactttcattttgattcttttaaatctgtctagttgtaagtctaatatgatgcattttaagatggagtccctccctcctacttccctcactccctttctcctttgcttatttttcctaccttcccttcctcttgtctccccactccctccctctttgtttccttccttccttatttcctttagtttccttccttagccgttttgagtggtgggaatcaatgctgtttcactcaaaagtgttgcatgcaaacacttctctttattctgcatttattgtgatttttggaaacaggtatcaaccttcacagttgggtgaacaagtgttgtcctacagatgtccaatttatttgcatttttaaacattagcctatgatagtaatttaatgtagaatgaagatattaaaaacagaagcaaattatttgaagctctctaatttgt

SEQ ID NO: 18494 - DNA, 407 bp, Homo sapiens
  misc_feature 238: n=a, g, c or t
aagaaacccaatgatcctgcagcagcccttgcagcgaggcccccagggaggggccagcgcctcccgcgggccgccttgggggtgacttggggcctggacgccagctcccctctccgaggagctgtgcccatgagcaccaagcggcgcctggaggaggagcaggagcctctgcgcaacratttctgtctgaggagaacatggccacccacttctctcaactcagcctgcacaatgaccncccctactgcagsccccccatgaccttctccccagccctgcccccactcaggagcccttgctctgagctgcttctctggcgctatcctggcagcctcatccctgaggccctccgtctgctgaggctgggggacacccccatgttccccctaccctgcaaccccagctgg

SEQ ID NO: 18495 - DNA, 447 bp, Homo sapiens
  misc_feature 199: n=a, g, c or t
agatcccacccgcagaccccaaaacccaatgatcctgcagcagcccttgcagcgaggcccccagggaggggcccagcgcctcccgcgggccgccttgggggtgacttggggcctggacgccagggagcctctgcgcaagatttctgtctgaggagaacatggccacccacttctctcaactcagcctgcacaatgacsncccctactgcagcscccccatgaccttctccccagccctgccccmactcaggagcccttgctctgagctgcttctctggcgctatcctggcagcctcatccctgaggccctccgtctgctgaggctgggggacaccccagtcccccctaccctgcaaccccagctggggacataatggagctctagtgctggtggacagtgcccctcccacyttccttcttccccacaacagaagagaccagcgactc

SEQ ID NO: 18496 - DNA, 465 bp, Homo sapiens
aatgatcctgcagcagcccttgcagcgaggcccccagggaggggccagcgcctcccgcgggccgccttgggggtgacttggggcctggacgccaggagcccttgctctgagctgcttctctggcgctatcctggcagcctcatccctgaggccctccgtctgctgaggctgggggacacccccagtcccccctaccctgcaaccccagctggggacataatggagctctgagtgctggtggacagtgcccctcccaccttccttcttccccacaacagaagagaccagcgactcccgcaaagggacaaggttcctccctctcctgcagagtaggcatctgggcaccaagaccttccctcaacagaggacactgagcccaacggagttctgggatgggaggggtgggagcatgggaagggaggcatcccacccccaagaagaactgaataaagattgctgaccaaa

SEQ ID NO: 18497 - DNA, 469 bp, Homo sapiens
agaattgtgagaaaatgaattggttcagccactcagtctgtggtacttcgtcaaggcagccctagcaaaactcttccaccttctaatgacttttagtcatctctggaataaaacccacaggctctaagaagtttctaaggcctaggatgatctgactgactcttgcctctggtgcctcagccttaaacacttcctgcctctctctactccagccacactagcctcggtgcagttccacatacatcatcctccttcgtctggagcctctggatgtcctgtttctttggcttggaatcctcctacctgctcatgctacttactcacctcgtcagtagcaccacccttcaagtctcagcttaaacatcgctccttagagaagccatccttgttcccttagactagggaacaagggaatctgtggtaattctgtggtaatcttccacagaattttgtactggtaatttacagc

SEQ ID NO: 18498 - DNA, 422 bp, Homo sapiens
acgtgcggccggaagggaagtaacgtcagcctgagaactgagtagctgtactgtgtggcgccttattctaggcacttgttgggcagaatgtcacacctgccgatgaaactcctgcgtaagaagatcgagaagcggaacctcaaattgcggcasggaacctaaagtttcagggggcctcaaatctgaccctatcggaaactcaaaatggagatgtatctgaagaaacaatgggaagtagaaaggttaaaaaatcaaaacaaaagcccatgaatgtgggcttatcagaaactcaaaatggaggcatgtctcaagaagcagtgggaaatataaaagttacaaagtctccccagaaatccactgtattaaccaatggagaagcagcaatgcagtcttccaattcagaaccaaaaaaaaaaaaaaaa

SEQ ID NO: 18499 - DNA, 195 bp, Homo sapiens
ctaagctcgttcttccgccagcttccctcctcttcctttctcagccatcgtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactcc

SEQ ID NO: 18500 - DNA, 508 bp, Homo sapiens
acggttgcattcagctggcaggttggctgatggcggggctcagcagagaagctgggatggctggcctgactctcttcacataattttagtctcttcccaccatgtgttctctccagcagggtagccagacttcttacatagttgttcagggctcccacaaatgagcattccaagaggacaaaccccagtatgcaggcatttaccaagcctctgcttgcatcacaactgcgatataccattggccaacatttgtcacattgagggagaaggcaggactcaactccagaggtggggctgaaactctggaccagattgaagactaggtgaacagggaagcagtgaaagcacctctccatgagacatacccagcaacaccatgtcagtttaccacagtgatggcaacacctaaaagttaccacccctttccatggcaatggcctggaagtatcatcctttgtccagaaaattctgaataacctgccccttaatttgcatgtaattaaaaaaa

SEQ ID NO: 18501 - DNA, 476 bp, Homo sapiens
gcagaatctaaaatgcaactttgaagctggatcccttgctggctgcagggaaatgagaagcctgccactggtattagatgtgctgttcttgacgtccttacttctgtcctcagaatcatatcttcgcatctgaaagaaggcaacagcattgagcaacaatctgggactctatttgatatcttcccttgagaagtgttaaatgttgccataatcttgacagttcaaaagttagtcatgtggttgatattttaccaatgagatgaatgtgatgccttctgaaaagttttctgttcaacagagtcataaaatgttagccctagaaggtgccttgaagaccacgatgagttaactttcttcctttgccaaggaagaagcgattacttcagcaactggacttgcttgaatacaaggaacgccatctaatgaaaatcccatgccgcagtgragctggagggagcatcgtgagtggctcagac

SEQ ID NO: 18502 - DNA, 473 bp, Homo sapiens
  misc_feature 394,407: n=a, g, c or t
aagcagaatctaaaatgcaactttgaagctggatcccttgctggctgcagggaaatgagaaccctgccactggtattaggtggggaaatgatagcccctagcatgctatagcagtgcagttgttagaacttttacaagttctgagctggaataggacacgagtggaagatgtgctgttcttgacgtccttacttctgtcctcagaatcatatcttcgcatctgaaagaaggcaacagcattgagcaacaatctgggactctatttgatatcttcccttgagaagtgttaaatgttgccataatcttgacagttcaaaagttagtcatgtggttgatattttaccaatgagatgaatgtgactgtaatatgggcaaatcccacctaccataaaanctggcaatacttncctaatattgaaggaaaggagacatttagagcaagccaggaagctggaacaccggatcaggaacag

SEQ ID NO: 18503 - DNA, 445 bp, Homo sapiens
  misc_feature 197: n=a, g, c or t
catgttcctacagtcatacatattcattagaagttttatgttgttggtctgatctgattcttctttgtttgtgggtggaacggcactgagagaagtatagttttttaaacttgaacatgttcagtagttacattgccttagaaaacccagacacatagcagtggaaatgaaagaaatggcatcagaagtgacttaanttagcaattgtgattcctcttgtaaaacaaaacaaaaaaacaatgccatattttttggagaaaagttggcaatataggggtttcgttgtctgtttcacaagaagactcatttgttcttttgggggamccagtgccttacagattttgtatatactgtaattattcaggactagggaacaaacaattgtattgtatttgttacagattgtatatggctttgttttaacattcccctaaataaaatggct

SEQ ID NO: 18504 - DNA, 289 bp, Homo sapiens
matgttcctamagtyawtamawawtymatwagaargttttatgttgttggtctgatctgattcttctttgtttgtgggtggaacggcactgagagaagtatagttttttaaacttgaacatgttcagtagttacattgccttagaaaacccagacacatagcagtggaaatgaaagaaatggcatcagaagtgacttaatttagcaattgtgattcctcttgtaaaacaaaacaaaaaaacaatgccatattttttggagaaaagttggcaatataggggtttcgttgc

SEQ ID NO: 18505 - DNA, 554 bp, Homo sapiens
cctttggaattgttaccagggtgaactcaccagccaggggaataccccagaaagagctgccagtaggaggagggccagcctcactgagattggagtccagcagtcccactgattgggagtgctgagccaagcccatgtcgtgcttcgctgatgcatggctgggctgaagaaagagctctttgaatttttcatagaaaagactggtgcccaaaaggccagggctcgagaatgaggctgcctcaagcacagtgcttggcaggacaccagggctgaaaggtacagcaaagtcctcccagaatcgcttgtcagagcagggatttgcatcacagactggccactgcaaagacagatgggaactcacaggttttgtgtgtgtgtttgtggttcactgctgatggacgcatgtcagaagccacctgagccttggcccagccttcatgtggagtgaaaacccagacctgtgtgagcagcaggtacttgaagcaagagaagcaaggccgagcctccagggctttgtcagaggctccttccttcctggaatccaattgtacaac

SEQ ID NO: 18506 - DNA, 446 bp, Homo sapiens
  misc_feature 409: n=a, g, c or t
ggtttgccccaggggcaggttctctgacctcatgctcacgggatgcgacctgtgcagcccctggccttcgctctcttaacgagccgctctggctgacataaaaagcgcgagagggcttttctccatctctggtagggatagagcccctctgcagctkhcgatttgggaaatacctgaggttttttccacttgcacagaaaggctattctagccctgaagctggctagtaagacgctatagtcccagctactccggaggctgaggattaattcctggcaatgaaacaaaagcaaaattatcccattccacagtagattcggatgaaaactggaaataaaatcgggtacaactccaagaggagatattggagaagaaccaagctgggtctgcaaggaactgcatactmadnggcatacgtatttatgctgtctcaaggtcatgaccaa

SEQ ID NO: 18507 - DNA, 563 bp, Homo sapiens
ggaaggagtgcagcggctgccacggagctcgtagctgcagctttggaggagtaagcggcgtggtagcgaaggtcgccgaacccgcctggctagccggcgagttgagtggcgactcttttgaaacagatggtcaccatgtttagatattagcagtcccgtatgtgcatgtctgcatttgaaaatggaagagggaaacaacaatgaagaggtaattcacttgaacaactttcactgccatcggggacaagactttgtaattttcttctggaaaacccagattatccaaagagagaagacagaatcattataaatcccagtagcagtctgctggccagccaagatgagacaaagttgcctaaaataagacttttttgactattctaaattgactcctcttgaccagcactgcttcatccaagctgctgacctcctcatggccgacttcaaagtgctcagtagtcaggacatcatgtgggccctgcacgagctcaaaggacactatgcaatcacccgaaaggccttttctgatgccattaaaaaatggcaggagctatcaccagaaa

SEQ ID NO: 18508 - DNA, 485 bp, Homo sapiens
ggaaggagtgcagcggctgccacggagctcgtagctgcagctttggaggagtaagcggcgtggtagcgaaggtcgccgaacccgcctggctagccggcgagttgagtggcgactcttttgaaacagatggtcaccatgtttagatattagcagtcccgtatgtgcatgtctgcatttgaaaatggaagagggaaacaacaatgaagaggtaattcacttgaacaactttcactgccatcggggacaagactttgtaattttcttctggaaaacccagattatccaaagagagaagacagaatcattataaatcccagtagcagtctgctggccagccaagatgagacaaagttgcctaaaataagacttttttgactattctaaattgactcctcttgaccagcactgcttcatccaagctgctgacctcctcatggccgacttcaaagtgctcagtagtcaggacatcatgtgggcccctgcac

SEQ ID NO: 18509 - DNA, 505 bp, Homo sapiens
ggaaggagtgcagcggcctgccacggagctcgtagctgcagctttggaggagtaagcggcgtggtagcgaaggtcgccgaacccgcctggctagccggcgagttgagtggcgactcttttgaaacagatggtcaccatgtttagatattagcagtcccgtatgtgcatgtctgcatttgaaaatggaagagggaaacaacaatgaagaggtaattcacttgaacaactttcactgccatcggggacaagactttgtaattttcttctggaaaacccagattatccaaagagagaagacagaatcattataaatcccagtagcagtctgctggccagccaagatgagacaaagttgcctaaaataagacttttttgactattctaaattgactcctcttgaccagcactgcttcatccaagctgctgacctcctcatggccgacttcaaagtgctcagtagtcaggacatcatgtgggccctgcacgagctcaaaggacactatgc

SEQ ID NO: 18510 - DNA, 510 bp, Homo sapiens
ggaaggagtgcagcgctgccacggagctcgtagctgcagctttggaggagtaagcggcgtggtagcgaaggtcgccgaacccgcctggctagccggcgagttgagtggcgactcttttgaaacagatggtcaccatgtttagatattagcagtcccgtatgtgcatgtctgcatttgaaaatggaagagggaaacaacaatgaagaggtaattcacttgaacaactttcactgccatcggggacaagactttgtaattttcttctggaaaacccagattatccaaagagagaagacagaatcattataaatcccagtagcagtctgctggccagccaagatgagacaaagttgcctaaaataagacttttttgactattctaaattgactcctcttgaccagcactgcttcatccaagctgctgacctcctcatggccgacttcaaagtgctcagtagtcaggacatcatgtgggccctgcacgagctcaaaggacactatgcatcaccc

SEQ ID NO: 18511 - DNA, 488 bp, Homo sapiens
  misc_feature 17: n=a, g, c or t
ggaaggagtgcagcggnctgccacggagctcgtagctgcagctttggaggagtaagcggcgtggtagcgaaggtcgccgaacccgcctggctagccggcgagttgagtggcgactcttttgaaacagatggtcaccatgtttagatattagcagtcccgtatgtgcatgtctgcatttgaaaatggaagagggaaacaacaatgaagaggtaattcacttgaacaactttcactgccatcggggacaagactttgtaattttcttctggaaaacccagattatccaaagagagaagacagaatcattataaatcccagtagcagtctgctggccagccaagatgagacaaagttgcctaaaataagacttttttgactattctaaattgactcctcttgaccagcactgcttcatccaagctgctgacctcctcatggccgacttcaaagtgctcagtagtcaggacatcatgtgggccctgcacgag

SEQ ID NO: 18512 - DNA, 564 bp, Homo sapiens
gccattctcctgcgtcagctcctgagtagctgggactacaagcacccgccatcacgcccggctaattttttgtatttttagtagagacggggtttcaccgtgttagccaggatggtctcgatgtcctgaccttgtgattcgcccgcctcagcctccctgggattacaggcgctttatgaatacagaaacttcgtctgggtcattgattcatccctggaacctataagtgatgccaagaatatagtatcagctcactgactactttttaggatagttggttctcttccttctcagttgtttctcccgacaaaagttcccagcctctagcatcagagcagcctttgctggagtcatagaagccatcactagagaatacaccaaatgtattcaatttgaaggcatcatcacctccctcggccaatcacagcactattcacaatagcaaagacatggactcaacctagctgcccatcaacagtggattggataagaacacgtggattcccagaaagtgttgaatagcagtgatgaaaagcagactgtctcattcctgatgtcaagaga

SEQ ID NO: 18513 - DNA, 450 bp, Homo sapiens
ataaagtatgtgcactcaacagtaaaaaaggaaatatatgaagataatataagccacactgtaattcttaatcatgcttacatttttgaaactgaaacctaaccttaagtcaagtgataggagaatgatgtgtatttactacatttggacacccaggagagtcatgcatgggcagaaaccatagaagctactcaagaggagagcaagtctgaatgttttctccatgccaggtgctgtgctcaaagctttgcatacaatctcatttaatcctcacagcaatctactaccatctccatttcatagtttagaaactgtggcttcaagaggtgaagtgaactgctcaaggtcacataagggtaagtgacagaatttggactcaaacccaggacagatttcaaaacccagattcttataatgtatgctactgtaataagttcattaaaggaatga

SEQ ID NO: 18514 - DNA, 523 bp, Homo sapiens
cattatagttttatgctctgtggtttcgggcctagcctcttacccagcgaggatctgtggatgataatggtgaaggccgtctgctgcagggctgccgtctcggctgcacgactcttgaccccgctgcgtgtgtcttctcagctggaactcaccattgtgtaaatttgcctcactctgctttcctagttcttctgtcttctcttcttagagacagtccttctttcttctacctgtgaaatacctatttatctctcaaaacccagctcaaaagttttctcagtcaccttggaatggtagcatctcccycttgaaataatggcacattggactgtttatgtgacactgctttatgctttagatgtccgtgtgaacgtccctctattgtagcagagatggctctatccagttttgtgtcctcagagcttattatgacaccttatcagtatacttacatcttagttacacttcccattgctccgaaaaggacttggggctgctcacacaatacgtgaaataaaataag

SEQ ID NO: 18515 - DNA, 190 bp, Homo sapiens
ctttttttttcgcgtctgcggtgcycggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttccaaaaaaaaaaaaaaaa

SEQ ID NO: 18516 - DNA, 541 bp, Homo sapiens
ctttttttttcgcgtctgcggtgcycggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgagtaagtctttgtctcctatgggtctactgtagaaaacacgtgctttgagaagctttagttttctaggaaaacgtgggatttaacaaagcactttctatcgagcatttattaggtatttaaaaaagtgttctgacggccgggcgctgtggctgacgcctgtaaccccagcacttggggaggccaaggcagatgggtcacctgaggtcaagatttggagaccagcctggccaacatggtgaaaccctgactctattaaaaatacagaaattagctgggcgtggtggtacgcgcctgtaatcccagcaactcacaaggctgaggcaggagaattgcccgaacccgggcggcggaggtt

SEQ ID NO: 18517 - DNA, 387 bp, Homo sapiens
ctttttttttcgcgtctgcggtgcycggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgaaaactggcgatggaatatgagaggagccctctggaaagaaaaggacagaccctgtgctttcatgaaagtgaagatctggctgaaccagttccacaaggttactgtatacatagcctgagtttaaaaggctgtgccacttcaagaatgtcattgttagactttgaaatttctaactgcctacctgcataaagaaataaatct

SEQ ID NO: 18518 - DNA, 513 bp, Homo sapiens
ctttttttttcgcgtctgcggtgctcggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattgatagcatcagctctaaaaatatctgaattggaaatcacaactatttacttttatcaaaaagcatttgtttttttccctgaattttcacatttgtgctgatggtggacattaatggtgatgaaaacaaagaagagacatgtgagatggtcggcggagaactgtcccacagtcattcctcaagaggcccccagctcagactgcgtgttcagcaaagtgtttttggggagtgctgcttcctctg

SEQ ID NO: 18519 - DNA, 416 bp, Homo sapiens
ctttttttttcgcgtctgcggtgctcggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgaaaactggcgatggaatatgagaggagccctctggaaagaaaaggacagaccctgtgctttcatgaaagtgaagatctggctgaaccagttccacaaggttactgtatacatagcctgagtttaaaaggctgtgccacttcaagaatgtcattgttagactttgaaatttctaactgcctacctgcataaagaaaataaaatcttttaaatcaaaaaaaaaaaaaaaaagg

SEQ ID NO: 18520 - DNA, 487 bp, Homo sapiens
  misc_feature 82,421..422: n=a, g, c or t
ctttcgcgtctgcggtgctcggagtgtggtacttctcctagttgcagtcaggcttcatacgctattgtcctgcccgttagancagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccnnaaggttactgtatacatagcctgagtttaaaaggctgtgccgcttcaagaatgtcattgttagac

SEQ ID NO: 18521 - DNA, 471 bp, Homo sapiens
cttttcgcgtctgsgtgcccggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaaggctgtgccacttcaa

SEQ ID NO: 18522 - DNA, 481 bp, Homo sapiens
  misc_feature 141: n=a, g, c or t
ctttcgcgtctgsgtgctcggagtgtggtacttctcctagttgcagtcaggcttcatacgctattgtcctgcccgttagagcagccagcgggtacagaatggattttggaagagggagtcactactggacstccaaggaanccacgtgcagasatstasaaccttcgatctcctgacgagtttattgttggccaaaascaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgccacttcaagaatgtcattgt

SEQ ID NO: 18523 - DNA, 481 bp, Homo sapiens
acttttttcgcgtctgsgtgctcggagtgtggtacttctcctagttgcagtcaggcttcatacgctgttgtcctgcccgttagagcagccagcggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgccacttcaagaatgtcat

SEQ ID NO: 18524 - DNA, 508 bp, Homo sapiens
cttttttttttcgcgtctgsgtgcccggagtgtggtacttctcctagttgcagtcaggcttcatacgctattgtcctgcccgttagagcagccagcggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgccacttcaagaatgtcattgttagactttgaatttctaactg

SEQ ID NO: 18525 - DNA, 495 bp, Homo sapiens
ctttcgcgtctgcggtgctcggtgtggtacttctgctggttgcagtcaggcttcatacgctattgtcctgcccgttagagcagccagcgggtacagaatggattttggaagagggagtcaccactggacctccagggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacataggcctgagtttaaaaggctgtgccacttcaagaatgtcattgttagactttgaaatt

SEQ ID NO: 18526 - DNA, 507 bp, Homo sapiens
ctttttcgcgtctgsggtgctcggagtgtggtacttctcctagttgcagtcaggcttcatacgctattgtcctgcccgttagagcagccagcggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgccacttcaagaatgtcattgttagactttgaaatttttctaactg

SEQ ID NO: 18527 - DNA, 482 bp, Homo sapiens
ctttctttcgcgtctgsgtgctcggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataawattggttgggagccacgtgtactagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgccacttcaagaatgtcat

SEQ ID NO: 18528 - DNA, 450 bp, Homo sapiens
  misc_feature 437: n=a, g, c or t
ctttcgcgtctgsgtgcccggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacntagcctgagttta

SEQ ID NO: 18529 - DNA, 432 bp, Homo sapiens
  misc_feature 402: n=a, g, c or t
ctgggtttttgtcttctgtgtttactgtgacatgaagtcatttttagatgaaggttaaacattttgccaacgcaggtacaatatgggattcaataaaagtacagaattaaagttgtcttattagagattgggaagtttcccagctccgtttatcggtacttggccgtaccgataaaggggatggacttggagtgaccaggtcttagtcacatatattttcataccctaaacaagaagcggtatagaccagaatggagcactgattgtaatccaccttctttcttagaaactggcgatggaatatgagaggagccctctggaaagaaaaggacagaccctgtgctttcatgaaagtgaagatctggctgaaccagttccacaaggttactgtatacatagccndbagtttaaaaggctgtgccacttcaagaa

SEQ ID NO: 18530 - DNA, 393 bp, Homo sapiens
stttcgcgtctgsgtgcccggagtgtggtasttctcctagttgcagtcaggcttcatacgctattgtcstgcscgttagakcagccagcggtacagaatggattttggaagagggagtsascactggacctccaaggaagssacgtgcagacatctasaascttcgatctsstgacgagtttattgttggcsaaaaccaggctttgattgaaccaggatgaatgsgggttttggaagtagaatatatatatacatataaaattggttgggagcsacgtgtaccagtgtgtgttgatcttggcttgattcagtctgscttgtaasagaaactggsgatggaatatgagaggagcystctggaawgaaaaggacagassytgtgctttcatgaaa

SEQ ID NO: 18531 - DNA, 475 bp, Homo sapiens
  misc_feature 61: n=a, g, c or t
ctttcgcgtctgsggtgctcggagtgtggtacttctcctagttgcagtcaggcttcatacntattgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgccacttcaagaatgt

SEQ ID NO: 18532 - DNA, 493 bp, Homo sapiens
cttttttttcgcttctgcggtgsccggagtgtggtacttctcctagttgcagtcaggcttsatacgctattgtcstgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgcmtttcatgaaagtgaagatctggctgaaccagttccacaaggttactgtatacatagcctgagtttaaaaggctgtgccacttcaaggatgtcattgttagac

SEQ ID NO: 18533 - DNA, 492 bp, Homo sapiens
cttttttcgcgtctgggtgctcggagtgtggtacttctcctagttgcagtcaggcttcatacgctgttgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataawattggttgggagccacgtgtaccagtgtgtgttgatcttggcttgattcagtctgccttgtaacagaaactggcgatggaatatgagaggagccctctggaaagaaaaggacagaccctgtgctttcatggaaagtgaagatctggctgaaccagttccacaaggttactgtatacatagcctgagtttaaaaggctgtgccacttcaagaatgtcattgttagactt

SEQ ID NO: 18534 - DNA, 465 bp, Homo sapiens
cttctttcgcgtctgsgtgctcggagtgtggtacttctcctagttgcagtcaggcttcatacgctattgtcctgcccgttagagcagccagcggtacagaatggattttggaagagggagtcaccactggacctccaaggaagccacgtgcagacatcacaaccttcgatctcctgacgagtttattgttggccaaaaccaggctttgatttaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgccac

SEQ ID NO: 18535 - DNA, 59 bp, Homo sapiens
ctttctccgccatcrtggtgtgtkctkgastccgctgctcgccatgtcttstcacaaga

SEQ ID NO: 18536 - DNA, 485 bp, Homo sapiens
cttttcgcgtctgsgtgcccggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgccacttcaagaatgtcattgttag

SEQ ID NO: 18537 - DNA, 494 bp, Homo sapiens
cttttttcgcgtctgsgtgctcggagtgtggtacttctcctagttgcagtcaggcttcatacgctgttgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgccacttcaagaatgtcattgttagactttga

SEQ ID NO: 18538 - DNA, 478 bp, Homo sapiens
ctttcgcgtctgsgtgctcggagtgtggtacttctcctagttgcagtcaggcttcatacgctattgtcctgcccgtaagttcccgttttgtgtgtggttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattgaaactggcgatggaatatgagaggagccctctggaaagaaaaggacagaccctgtgctttcatgaaattgaagatctggctgaaccagttccacaaggttactgtatacatagcctgagtttaaaaggctgtgccacttcaagaagtcattgttagactttgaaatttctaactgcctacctgcataaaga

SEQ ID NO: 18539 - DNA, 460 bp, Homo sapiens
  misc_feature 261: n=a, g, c or t
ctttcgcgtctgcggtgctcggggtgtggtacttctgctggttgcagtcaggcttcatacgctattgtcctgcccgttagagcagccagcggtacagaatggattttggaagagggagtcaccactggacctccagggaagccacgtgcagacatctacaaccttcgatctcctgacgagtttattgttggccaaaaccaggctttgattgaaccaggatgaatgcgggtgttggaagtagaatatatatatacatataanaktggttgggagccacgtgtaccagtgtgtgttgatcttggcttgattcagtctgccttgtaacagaaactggcgatggaatatgagaggagccctcttggaacaaaaggacagaccctgtgctttcatgaaagtgaagatctggctgaaccagttccacaaggttactgtatacatagcctgagtttaaaaggctgtg

SEQ ID NO: 18540 - DNA, 477 bp, Homo sapiens
  misc_feature 262: n=a, g, c or t
actttcgcgtctgsgtgctcggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataanattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgccacttcaagaatgtc

SEQ ID NO: 18541 - DNA, 425 bp, Homo sapiens
ctttcgcgtctgsgtgctcggagtgtggtacttctcctagttgcagtcaggcttcatacgctattgtcctgcccgttagagcagccagcgggtacagaatggattttggaagagggagtcactactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggctkgattcagtctgccttgtaacagaaactggcgatggaatatgagaggagccctctggaaagaaaaggacagaccctgtgctttcatgaaagtgaagatctggctgaaccagttccacaagg

SEQ ID NO: 18542 - DNA, 479 bp, Homo sapiens
ctttcgcgtctgsgtgctcggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgccacttcaagaatgtcaat

SEQ ID NO: 18543 - DNA, 475 bp, Homo sapiens
gctttstttcgcgtctgsgtgctcggagtgtggtagcttstcctagttgcagtcaggsttcatacgkstgttgtcctgcccgttagagcagccagcgggtacagaatggattttggaagagggagtcaccactggacctccaaggaagccacgtgcagacatctacaaccttcgatgctcctgacgagtttattgttggccaaaaccaggctttgattgaaccaggatgaatgcgggtgttggaagtagaatatatatatasatataaaattggttgggagccacgtgtascagtgtgtgttgatsttgggcttgattcagtctgccttgtaacagaaactggcgatggaatatgagaggagccctctggaaagaaaaggacagmccctgtgctttcatgaaagtgaagatctggctgaaccagttccacaaggttabtgtatacatagcctgagtttaaaaggctgtgccactt

SEQ ID NO: 18544 - DNA, 416 bp, Homo sapiens
ctttcgcgtctgcggtgctcggagtgtggtacttctcctagttgcagtcaggcttcatacgctattgtcctgcccgttagagcagccagcggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataawattgaaactggcgatggaatatgagaggagccctctggaaagaaaaggacagaccctgtgctttcatgaaagtgargatctggctgaaccagttccacaaggttactgtatacatagcctgaagtttaaaaggctgtgccaacttcaaggaatgt

SEQ ID NO: 18545 - DNA, 472 bp, Homo sapiens
ctttcgcgtctgcggtgctcggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgccggcttcaag

SEQ ID NO: 18546 - DNA, 452 bp, Homo sapiens
  misc_feature 263: n=a, g, c or t
ctttttcgcgtctgsgtgctcggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataanattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagttta

SEQ ID NO: 18547 - DNA, 434 bp, Homo sapiens
agtctcgtatcgcgcccgggaggcscggagcccagcgctggcgccagatccaggctcctggaagaaccatgtccggcagctactggtcatgccaggcacacactgctgcccaagaggagctgctgtttgaattatctgtgaatgttgggaagaggaatgccagagctgccggctgaaaattacccaaccaagagaaatctgcaggatggactttctggtcctcttcttgttctacctggcttcggtgctgatgggtcttgttcttatctgcgtctgctcgaaaacccatagcttgaaaggcctggccaggggaggagcacagatattttcctgtataattccagaatgtcttcagagagccgtgcatggattgcttcattaccttttccatacgagaaaccacaccttcattgtcctgcacctggtcttgcaag

SEQ ID NO: 18548 - DNA, 509 bp, Homo sapiens
gactacggcgcaggcgcggagactattgcgcaggcaagcgcgtacgcagaagcgtgcgcgcgcccgttcaacgtccggagcatcggtgcagtttcgagggtaaagcctttggcgcggtgatgtggacttttgttctctaactacaactcccagcatacgtcacccctcacgtgggcgctaggtgtggtttcgtgggataggktcaccagtgaaaagttgtgcagagcccaacatgagcttcatttccaagctgccacctatctctgcctcctgcgtasatccggaaacatgtggccctacatcaggaatttcatggcaagggtgagcgctcggtggaggagtctgctggcttggtgggtctcaagttgccccatcagcctggagggaagggctgggagccatgaacatggagaatatccttggatgctgcattcataggagaattgaataatttctatcaatatgtatttatcattaaattttttttaagttcaaaaaaaaaaaaaaaa

SEQ ID NO: 18549 - DNA, 563 bp, Homo sapiens
agaaggacaggacaatggcggccttagggtccccggcgcacacttttcgaggacttctgcgggttttcagggtcgtaggacgccgttgggcaccacgctcggagaaggacaggacaatggcggccttagggtccccgtcgcacacttttcgaggacttctgcgggagttgcgctacctgagcgcggccaccggcgaccctatcgcgacaccgcggcctatcggtaccttgtgaaggctttccgtgcacatcgggtcaccagtgaaaagttgtgcagagcccaacatgagcttcatttccaagctgccacctatctctgcctcctgcgtasatccggaaacatgtggccctacatcaggaatttcatggcaagggtgagcgctcggtggaggagtctgctggcttggtgggtctcaagttgccccatcagcctggagggaagggctgggagccatgaacatggagaatatccttggatgctgcattcataggagaattgaataatttctatcaatatgtatttatcattaaattttttttaagtctaaaaaaaaaaaaaaaaag

SEQ ID NO: 18550 - DNA, 457 bp, Homo sapiens
accacgctcggagaaggacaggacaatggcggccttagggtccccgtcgcacacttttcgaggacttctgcgggagttgcgctacctgagcgcggccaccggsaaccctatcgcgacaccgcggcctatcggtaccttgtgaaggctttccgtgcacatcgggtcaccagtgaaaagttgtgcagagcccaacatgagcttcatttccaagctgccacctatctctgcctcctgcgtasatccggaaacatgttgccctacatcaggaatttcatggcaagggtgagcgctcggtggaggagtctgctggcttggtgggtctcaagttgccccatcagcctggagggaagggctgggagccatgaacatggagaatatccttggatgctgcattcataggagaattgaataatttctatcaatatgtatttatcattaaatttttttaagtctaaaa

SEQ ID NO: 18551 - DNA, 462 bp, Homo sapiens
agaaaccaccagctttatagtgtgcttgatagattttaaacattcctgggcaccactcaagagtgctctttttatcaccttctggaaatccgcaaagttgcaggggcctctggagtgtctcttctctagagagaattggtgggacccccctcagtgcagtggccccaactagtggagggagagaggacttaagtcagatggactcaacagaaatgggtttccagaagaataatgaaaagttgtgggtaggaaaatgaatcatttggactcttcaatgaaatggagtgagcccagggagagctcagccaacagagggcactctggggaacctgttagtaaagccaggctggccaaatgccatttgattttgaacctcgtaggtccccactcaccctctgccaggagctaagtaaggcaggagagctgacttgggactcctggctcggcccaacaggagcccct

SEQ ID NO: 18552 - DNA, 472 bp, Homo sapiens
attatcatggctgtaaacacaggttctgcacgtgtctaagttcagccccaaacccacatgaagaacttatttccagacagctcctactcttatggtggctccagaccctgccccatgcagaaggcacttctcaagttccaggaccagggcttcagcacagcactcgcaaaaccccacagatacagtgccaatgacagaaattaagattaactgggggcgacacagatttctgtgaatgccagtgctgtcagatgcttcctgatagtactttctagagtaaaagaacttcgggaaaagtaaaagcagcaaatggtaacaccctcatggagatctcagggtgtagaggcaagcactgaaggcccatgatcagccgtgggagccacgggaatcaattgcttccagtacgactggatgcatcggaaagagcctggggcaaggctggaggcacaagaggagctgccaggccacataa

SEQ ID NO: 18553 - DNA, 350 bp, Homo sapiens
acacgtggctcttgagctcttgagatgtgactagtgcaactgaggcactgagttctaagttttatttcatttttaattcactaaactttaaatagccacacatagctagtggttacaagtgggcagcacaggcctagggtttgactgagggaatatggggcatagagtccaagatctttggaagcaaggaaataagaactgaaagacacgtttttgggaaatgtcatctgagtagggattgatatcatcaagacaggcagggctgctgtagcastgtggtcggaggagttgtggctgtggggactgtgctcgtggcgctcagtgccatgggcttcacctcagtaggaatc

SEQ ID NO: 18554 - DNA, 459 bp, Homo sapiens
aacacatccaagcttaagacggtgaggtcagcttcacattctcaggaactctccttctttggggagcctcagatgggaagggactcgagccccacctgtccctggactctggaatgtctggctgaagttgaggatctcttactctctaggccacggaattaacccgagcaggcatggaggcctctgctctcacctcatcagcagtgaccagtgtggccaaagtggtcagggtggcctctggctctgcgtagttttgcccctggccaggattgctacagttgtgattggaggagttgtggccatggcggctgtgccatggtgctcagtgccatgggcttcactgcggcgggaatcgctcgtcctccatagcagccaagatgatgtccgcggcggccattgccaatgggggtggagttgcctcgggcagccctggctactctgcagtcactgggagcaact

SEQ ID NO: 18555 - DNA, 509 bp, Homo sapiens
agatttaagaagcatctaaaatcaacatgatgccagttcttaggctgatgtgtgtttattaataagaagtaaaattgtccagcatgagccagctttaattaggcattttaaagaagtaagactgtgctacttaatatttgaaaattgatttaatttagaactgattatcaatggtgatttaagtattggtatcccatctttactcctgttgagcaacctgggtggccttatcttccgtgacagtggaatttacaattatttcaaactctgcctttaagtaacttagaatcttctagaagatacaacttataaacagatttaaagaacgatattttttaaagtgattattaaatgattacttatgtagctctagatcatgtaatggtttagaggaggagagaaaagtttcagaactgtgttgcaataagcccctttgatggggcttaacttgaaagggagcccttgtctgatcaaatgacatcagacagaagggagccagtgagtgtgga

SEQ ID NO: 18556 - DNA, 567 bp, Homo sapiens
  misc_feature 467: n=a, g, c or t
atggacctgattggaagcccagggaacttgagttcacagtgtttacaaagtcttcagtagtgtatagcaatatcccaggccttcaaattcactcaccactcctcactgactcacccagagcaacttccagttctgtaaactccattcatgggttccataccgctttatatttcccccggtagattgcatgatgaagaaatactggaaggaaaagtttgatttggctttgcaggaaacacttgacgtcattaccctaccttgaatattaacttcagcaacatgtggctcaaattctagatgttcatcagcttcagtgaggaggatacttaccttgtattatggccaagagaatgacaataacaaaaaagaagaaagtgatgtcaaagattcgatagatctcatattcatctcctgctgggtcttcgatttcatccccgatccctcctccagcacgaactccaacaadnrtgtggaacatatagcactggaaaaaagacatggtatcacttcttggagggacattacccatttttttttctcgacaaacccgagttatctctgtagttt

SEQ ID NO: 18557 - DNA, 467 bp, Homo sapiens
tcatttttctgatgtgaaaatatcctatgttatttactggttataattctaatctcctttgtgtgcattatttattttgattatttactttattatgattgatttgcaaaaattaatatttgttttaacaatgtgcataattatatttcataaaagttttattgttaaaattacatatctaagaaagttgattatctagtctgaaaaagcaggagtatgtcaagttgttaaattaaaatttaaaatgagtaatatattattttatatggataattaggccctttgggacatttactcaaaagtaggtcataattttattatactgtacattctgatatatatatatacacacacacatatacacacatttaagcataaatataaaatagttcatattcctctactaattatgcttttaaaaattatttacattaaattctcattagaaattataaaacgacactagg

SEQ ID NO: 18558 - DNA, 513 bp, Homo sapiens
gccggttcccgctcgcgcctctccctccacacctccctgcaagctgagggagtggactctggccttggcaccccagaaaggggctcccacagtgcagccgtgggctgaagggctcctcaagtgccgccaaagtgggagcccaggcagaggagtcgccgagagcgagcgcgggctgtgaggactgccagcacgctgtcacctctcaataacgcccatcccaacgtttcctgaggaataattttggtcgtgttcctgctactcagcttttcgtggttcctgctcattttcagagtctaacattccagcttttccggaaattctatactttgatgtaaaagttttcaaagaaatgctttgggcagaagagactcatggaaactgagtggtcttgaactcctggcctcaagtaatcctccccactgkgcttccaaagtgctgggactacagagaatcttaacccaaaagaagatgagccaagaacatgaacagacaattcaaagaaaaggaaatgac

SEQ ID NO: 18559 - DNA, 515 bp, Homo sapiens
attttttcttaacagcttatggaacttgaatgcaaactacacatgcagaaatacttaaaatactagcgtgtggaaagatttgagctgcaaactttagacaaaagaaacatggaaatcatattttaaacgggtcatcaaacacctcacaaaacccccggaacttttaaaatacctcttaaagcacttcttgtgttctcttgagggacagtaggtatagtttaccaccttttgaaggaagattaaagtgtgatagttcagggctttactttccattacgcaactgagccccagccttgcagggacggttgagaagtggcaaaatggcggactttctcccccaactgcttgcagtcctgcgacttgctcccaagacagccacacgttttgcttttttgttcgagaaatcggagcagcacgggctgtctgcttgggaaatcttagaaacgtgaaaacccactcttggaaaacgcctcaataccacaccacagagctgctccccgcctgagccccggggg

SEQ ID NO: 18560 - DNA, 511 bp, Homo sapiens
cagtcttgttgagacagacttttcttattctgtggctgtcctgtgggaatttattgtgtctctatacctatatttattctcccttctagtgtcctctgtggttctgggctcacaagagggcacctggcaagggtacagaattgtagagtgagggatacctcaagcaccaactattccaccacctcattttatgaagagacaaagagatctgtgactggtgaccccagagtgagggagccacagagctggcttacaactcttaggcctgggtcctcttcattgcttctgctgctatgtaccctttgatagatgaagagaatgtaatrcagagctgtccattgcaaccctcttgttcaaaacccctcaatacttaccgtaatccaattaaagactttattctttaagcaagccctcacttctggcattcaaattgcttgtaaggattaactgagttaatacagacaaaacatttagaaagttcctgggacagactaaaacactatgtaagtct

SEQ ID NO: 18561 - DNA, 377 bp, Homo sapiens
accccggccgctgcctgcgctttcttccaggcgaggccctgctcggggttcttccggcctccccccaggcaaaacccgcaagagcggtttctggcgtggctgggtcccctgcggcggaagggcgcctcccggccacgctcgctgtagtgaaggagcgcggcagcctggggctcgtttgggtgatttccctcggcggtggaggtcgctcctaatagaggcggcggcggatcacccgaacagccttcagtcactccatgaattcctttgggcaacccagaccagaagataatcagtcagtagtcagaagaatgcaaaagaaatactggaaaactaaacaggtctttatcaaagcaacaggaaaaaaaaaaaaaaaaagg

SEQ ID NO: 18562 - DNA, 541 bp, Homo sapiens
  misc_feature 423..425: n=a, g, c or t
aaaacccggaagcgggtcgcgtggagtgacggtcccaccgcgggggtgagttttgctctgtgttgtgttaagtctgcgcttcccgggtcccaggcgcttctgtacctgggacgtggggtcctcatagacctggaagttctcctccgtctttctttacccagagcaaattgagaagwccccgtgagagtctgggggtcgcttccttttgggtttaaagtcaccatagaccggtcccgtcccgaatctttctgctatagggtaacgtawacacttcccatmgcgtagttttcctgctcaaaacttttttctgactcctcccaacccgcactttttaaagtccttaccgcgagcggattcccgcctgggcgcctcccagtcttgtcttaaggcgccgtcgcccccacctccctcctcgtgccgggnnnvaatgctccccaggtcttccctccgtaatcaccgtttctcctgagcccgcgttggggaggtgcccggggctgtcctatgacaccgtgtgttcttgcctgccctgcaccagcctctg

SEQ ID NO: 18563 - DNA, 378 bp, Homo sapiens
ataacaaaacaatccaactatactgaataatacagaatcaaactgggatccaaaaacaatttaaaacaaagttggaaactcaaccgaaacaagaacaaatcgaatccgacatgaaacaagtctcacaagtgttcttaagctgacagaaagatggtcaaaaccaaacttaaaaccgtagtaatcgacataacggtcataccattcgccgacgattttttctgccctggagctccagccggcgtagagatatcaccagcggctgatggaccatctcctgaaggacccatcgccgagcctgacggagaatctgacggtgaagaagaagtagagcctcccggagccaacgatggagaaacggtgggtgagttttgaaaacag

SEQ ID NO: 18564 - DNA, 427 bp, Homo sapiens
agagcagattcgcacaaacccggaagcgggtcgcgtggagtgacggtcccaccgcggggatatctcttccaaatgsatgaatgaaggagttctcatccacagcgcaaggcaatacagaagtgatccacacagggacattgcaaagacatgaaagtcatcacattagagatttttgcttccaggaaattgagaaagatattcataactttgagtttcagtggcaagaagaggaaaggaatggtcacgaagcacccatgacagaaatcaaagagttgactggtagtacagaccgacatgatcaaaggcatgctggaaacaagcctattaaagatcagcttggatccagctttcattcgcatctgcctgaactccacatatttcagcctgaatggaaaattggtaatcaagttgagaagtctatcatcaa

SEQ ID NO: 18565 - DNA, 110 bp, Homo sapiens
aatatcttcatgagaacctccctattcctcagagaaacaccaactgaaaagagccaggaaaacccgggaattttccaaaaggtcttcacgttaaacttgtcttatctcag

SEQ ID NO: 18566 - DNA, 449 bp, Homo sapiens
gtttgaaatcacatatagttcactgaaaacccgtatatgcatcatgtaatacatatctaaagttatcttcgttccttgaatgtatactttccttgggatttctgtttagctttcaggagcagtacagtgggggtggggacgggggtaatatagaactgttgacactcgatagctttatactattttctcatctgtagtaaggagacagaaaatctgcactttctttttgctctttaaaaattcttgctttacaggctggacacggtggctcacgtctgtagtcccagtactgtgggaggctgagatgggtggatcacctggggtcagcagtgtgagaccagcctggccggcatggcggaatcccgtctctactaaaaataaaagaattggctgggtgtggtggcaggcgcgtgtaatcccagctacacgggaggctgaggcaggagaat

SEQ ID NO: 18567 - DNA, 495 bp, Homo sapiens
cacaaaaataaatagataactctagtagtcctagaaacttaaaaaaatggaaccatgaaaaccatcttctcatagcaaaagatgtaagcctggtggctctaattgctaaattatactaaatatttaggaaagaaattattctatgttcatacagattcttctactagggaacagaaaagcagatatactccccagatagtcttgtagaaacatgatatagcctagggcagtggctcatgcctgtaatcccaacactttgggaggccaaggtggaaggatcacttgagctcaggagttcgagatcatcctgggcaacatagcaaaaccctgtctctaaaaaacaattaagaaattggctgggtgttgtggtgggtgcctgtaagtcctagctacttgggaggctgaggtgggaggactgcttgagcccaggaggttgaggttatagtgaactatgatggcaccactgcactccagctgggtcaacagattgagact

SEQ ID NO: 18568 - DNA, 414 bp, Homo sapiens
attcatatattcttatctacccagtctcttgatttttgaaaagatttcacctacagtagaatattacagaaacaaaatataaatgcatgtctttctaaatgaaacttacatagactaaaagtagagaatatttttaaacaaatatacaatgtgcaggcagacaaagcaggaaaacggccattcaaatgtataataaaaaactaaaaattgactatctccagaaaactatgaagcgcctcaactaaaaggaatgcataatgaaattctaatctaatacaggtcaaaaatgtaaaaaggttataaaccttaacaggaaaaataaaacaacttttactggccattcctgttgaaatgagaatcataaagtaacagaaaagtggctacaaacccacttagagcaaaaaaaaaaaaaaa

SEQ ID NO: 18569 - DNA, 352 bp, Homo sapiens
attttcatttcatatgatgctagccactgagaactgggctgaatctaagcttatcaaccttccttctagttacagagatggaaagggaatatgaccatcactcatgtggaagttgagccattagaagaaagtccacacatcttatctgccagtaaaaacctactctcaccagatgtctcttcattcaagcaaggaaactgccacagccgccccaaatttctgcaaccaccactttgaacagtcabcagccattaacattgaggcaaaaccctctaacagcaaaaaggttactacttgctaaaggcttagatgattgttaagactttttgcaataaagtgtttttttttaaaa

SEQ ID NO: 18570 - DNA, 359 bp, Homo sapiens
attttcatttcatatgatgctagccactgagaactgggctgaatctaagcttatcaaccttccttctagttacagagatggaaagggaatatgaccatcactcatgtggaagttgagccattagaagaaagtccacacatcttatctgccagtaaaaacctactctcaccagatgtctcttcattcaagcaaggaaactgccacagccgccccaaatttctgcaaccaccactttgaacagtcagcagccattaacattgaggcaaaaccctctaacagcaaaaaggttactacttgctaaaggcttagatgattgttaagactttttgcaataaagtgtttttttttaaaaaaaaaaa

SEQ ID NO: 18571 - DNA, 397 bp, Homo sapiens
attttcatttcatatgatgctagccactgagaactgggctgaatctaagcttatcaaccttccttctagttacagagatggaaagggaatatgaccatcactcatgtggaagttgagccattagaagaaagtccacacatcttatctgccagtaaaaacctactctcaccagatgtctcttcattcaagcaaggaaactgccacagccgccccaaatttctgcaaccaccactttgaacagtcagcagccattaacattgaggcadmaccctctaacagcaaaaaggttactacttgctaaaggcttagatgattgttaagactttttgcaataaagtgtttttttttaaaaaaaaaaaaaaaaaaaaaaaaaaaaaaaaraaaaaaaaaaaaaaaa

SEQ ID NO: 18572 - DNA, 359 bp, Homo sapiens
attttcatttcatatgatgctagccactgagaactgggctgaatctaagcttatcaaccttccttctagttacagagatggaaagggaatatgaccatcactcatgtggaagttgagccattagaagaragtccacacatcttatctgccagtraaaacctactctcaccagatgtctcttcattcaagcaaggaaactgccacagccgccccaaatttctgcaaccaccactttgaacagtcagcagccattaacattgaggcaaaaccctctaacagcaaaaaggttactacttgctaaaggcttagatgattgttaagactttttgcaataaagtgtttttttttaaaaaaaaaar

SEQ ID NO: 18573 - DNA, 388 bp, Homo sapiens
attttcatttcatatgatgctagccactgagaactgggctgaatctaagcttatcaaccttccttctagttacagagatggaaagggaatatgaccatcactcatgtggaatttgagccattagaagaaagtccacacatcttatctgccagymaaaacctactctcaccagatgtctcttcattcaagcaaggaaactgccacagccgccccaaatttctgcaaccaccactttgaacagtcagcagccattaacattgaggcaaaaccctctaacagcaaaaaggttactacttgctaaaggcttagatgattgttaagactttttgcaataaagtgtttttttttaaaaaaaaaaaaaaaaaaaaaaaaaaaaaaaaaaaaaaaw

SEQ ID NO: 18574 - DNA, 400 bp, Homo sapiens
ttggaactatggtagccagatgataaatatggttaatttcatgtaaaacagaaaaaaagagtgaaaaagagaatatacatgaagaatagaaacaagcctgccataatcctttggaaaagatgtattataccagtgaaaaggtgttatatctatgcaaacctactaacaaattatactgttgcacaattttgataaaaatttaggacagcattggcccyckgaggttggtwaaatgttaatggatttcagaagcctaattccagtatcatacttactagttgatttctgcttacccatcttcaaatgaaaattccatttttgtaagccataatgaactgtagtacatggacaataagtgtgtggtagaaacaaactccattactctgatttttgatacagt

SEQ ID NO: 18575 - DNA, 487 bp, Homo sapiens
aatgagtaaagaaagaaaggattttaggttatagcattttacaccaaattaatgtgtttagctgcaatttgaaagcttaatgtgtttttgttatttctctattttaaattgagctgctgaatattttatagattatgagaaacagaaaacaaaaaaattgaaaaaacaatggcaattttgtgatgttacatttgcaaatgcaatgaaaaaggtaacaactcattgggagaatttcaaaatatgacaggatgttcagctaaaagtaaaaacctacttgcttggaactgatttgtctatattcaaatatgatgatttcatctttgttttggatataatcagcaggttgatgcaagttggagaagaattttgtggtagcaagtctgaagttttacaggaatctattagaaaacaaagtgtcaattatttcaagaattaccatagaacacggctcgatgaactgagaatgttcttagagaatgagacttgg

SEQ ID NO: 18576 - DNA, 499 bp, Homo sapiens
tagttctatcatttggtactatcattaatgtattatatacactgatactttaaaacttgtgtggaaaaaactaacttataattttgtatcacacaccctggatatgtgttctgtttctaagcgacatttgtgagagattattgtaaaatgagagcgagcaaataaaacttaatttaatctttgcagatacatacttatgggaaatttgaacaaatgagtgaaactctgtgtttttagtaggctgtgataaacatttccggagcacttgcagaggacttgctatttgccaggtgctttatgtatcattaaatttttctcatagttcagaaaaatgtgcaaaggaaactattgtctcgctccttcaaaacagtcttaattaactttcatattagcagattaaactagcagagcaggttcaagggaaattaaatgatatggaccctaatttgtatcattctgagttgattgtgtggkttattcattctggaaacatgttgat

SEQ ID NO: 18577 - DNA, 497 bp, Homo sapiens
agcgagactccagcagctccagcctccaggattctcagctccctcccgggcgagacctcggacgttcactgcgagcagccgctccgcccgccaccgcctccatctcctcctctggacccctstccaataaattggaggtcccggcggccaggaaagccacgtctcctccgggctgggtcagggaggcaggggccagagcctcagggtcccgtggcaccaacctggcttctggcccactggtcccggaaccgctgcggacgctgcgccccagccgccaagacgccgcgtatcttgtaccgcgggaaaagcgggtcctcgtccaagatgggccggcaggcttggggggtgccagcgctgcgggcgctccatgcagcgctcccagagccggagtagcctgtctgcctccttcgaggcactggccggctactttccctgcatgaactccctggaggaggaagaaggagaagcaggaggtaaaaaactaaggagcactgtcc

SEQ ID NO: 18578 - DNA, 494 bp, Homo sapiens
ttggaataatatgataccagagagagagagcttctatgtgaagctttgtggatttgaaaactgctatactgaatattttatgatcttgtcaaggcctccccttatcatgtgacctcaaggcgctaccatggctttcatcttgtgaagtcttgaacatttgtagttgcagaaaaacctcaagagactcagtatttcaaaagccatagtttaggttttattttctaggctgggatgtttgtgggttttcttattataaaattagagttgtcatagtgatgttgtgtatttcaaaccagatattctgtggtcgcagcaaagtctcactttaggaaatggatttctttatgaatgtgctaacattgtgcacagaaagtagcacaatacagataaacaggcatctttggtaggtggggtgtttgggtaaatttaaatttctgaggattgaacaaaaactcctttaccttaagaactgtgcaagcactttgggaggccga

SEQ ID NO: 18579 - DNA, 427 bp, Homo sapiens
agagttccgggagggtgcaggcaggagagggaaaggcagcagcggcggcactggaggatgaagaaggagcatgtgcttcactgccagttctccgcgtggtacccgttcttccgaggcgttaccatcaagagtgtcattcttccacttcctcagaatgtgaaggattatttactcgatgatggaactctggtggtttcaggaagggatgatccaccaacacattctcagccagacagtgatgatgaagcagaagaaatacagtggtctgatgatgagaacacagccacgcttacggatgcgtattggatagcaatgaatagttctctgaaatgtaaaaccctcagcgacatctttctgcttttcaagagttccgatttcatcactcgtgacttcactcagccgtttattcattgtactgatgattctc

SEQ ID NO: 18580 - DNA, 266 bp, Homo sapiens
actacgcatgtgtgtcaactctagggttgggtgctggggttgcggctttcggttaacaccgcagcaccacacctgttggtgttcagatggagcggcacactagtcatcctaacagaaaagttccagccaaagaggaagctaatgctgtgcctctctgtagagcaaaaccctcccccagctatattaatctttcaagcaagttccccaccagccacttttctgaacatccagacaacaaagctgccctcggcccaaggaatgcctag

SEQ ID NO: 18581 - DNA, 507 bp, Homo sapiens
atctcgacccaggaagtccagctggcttcacctctcaggaacaggctcatattctaacgaaacatatatgtctcttcagcagtgatgaaattgccatataaaatgcacacctgacaattagaatagcaccaaacatttgaatccatttgatgctaaggctttttctcaatatccaatttgtaatgcttatgagtcaggtcaaatggaaacattgcascaaagatcatgactataaccacagccacttggaaattaataactttttttaaaaaaagaaatttctggaaaggaaaacctttagaaaagatgtggctctgaagcatttatcctctaagtctgtaattgccctgatcaatggagtttagctccatgaaagtgaaggctttccccagaagatgatggagaccggccttgtcctgcagctgtttcataaaggcctagaataaatttcaatttcaataacttcattggcatgacaggggagacttgttttgtgaaggtcaatat

SEQ ID NO: 18582 - DNA, 364 bp, Homo sapiens
caccatggagtaacaagtatgaccctcccttggaggatggggccatgccgtcagctcggctgagaaagctggaggtggaagccaacaatgcctttgaccagtatcgagacctgtgcttctgaattgttggatcctgatgaatcgcaatcaggactatgtttggcttgagctccagcctcatgaccaccaaccccatcgaatgactgagagctgccaggctcctgccacgttggagctcagaatcctcccgtggggacactgtgctgcagccagcctccagggagccgcttgttttatggccyaaaaagtctctttatgctgagaaggtcacactggactttgctcacacagagatttgacccaa

SEQ ID NO: 18583 - DNA, 434 bp, Homo sapiens
ggtcgatcctgggccagcatggcggcgccatgtaacccggtccgtgccgcaaagcgaacggcggccgcggcgcggccccgcgggggtttagaggtcaccatgctgagggtcgcgtggaggacgctgagtttgattcggacccgggcagttacccaggtcctagtacccgggctgccgggcggtgggagcgccaagtttcctttcaaccagtggggcttgcagcctcgaagtctcctcctccaggccgcgcgcggatatgtcgtccggaaaccaggtaggagttcctaaggtgggacttggggcggaagagagacctcctggaaggctggggtgggtaaggggaccgatgtggcgaattagagccactagatgaggtgagccaaaggtcctgagcaaaagaccccacgtccaccttacacaaagccctaggcctg

SEQ ID NO: 18584 - DNA, 410 bp, Homo sapiens
tttttttcgagaccggaagtgagtgatcgaaagcatggcgtcggtggtgttggcgctgaggacccggacagccgttacatccttgctaagccccactccggctacagctcttgctgtcagatacgcatccaagaagtcgggtggtagctccaaaaacctcggtggaaagtcatcaggcagacgccaaggcattaagaaaatggaaggtcactatgttcatgctgggaacatcattgcaacacagcgccatttccgctggcacccaggtgccatgtgagttgctccgttgctgcccccctttttccttttctaggttgacctctccttgcccctaagcatggtaataacagttgcatgtattgagtgcttaccaaatggcaagcattgtgccaaaaaaaaaaaaaaaaagg

SEQ ID NO: 18585 - DNA, 441 bp, Homo sapiens
agaaacttttcgagaccggaagtgagtgatcgaaagcatggcgtcggtggtgttggcgctgaggacccggacagccgttacatccttgctaagccccactccggctacagctcttgctgtcagatacgcatccaagaagtcgggtggtaagctccaaaaacctcggtggaaagtcatcaggcagacgccaaggcattaagaaaatggaaggtcactatgttcatgctgggaacatcattgcaacacagcgccatttccgctggcacccaggtgcccatgtgggtgttgggaagaataaatgtctgtatgccctggaagaggggatagtccgctacactaaggaggtctacgtgcctcatcccagaaacacggaggctgtggatctgatcaccaggctgcccaagggtgctgtgctctacaagacttttgtccacgtggttc

SEQ ID NO: 18586 - DNA, 67 bp, Homo sapiens
  misc_feature 2,4: n=a, g, c or t
andnccctccgcccaagttcttctaactcaggctgcgctccgatctgtcatcgcgttatttcgcact

SEQ ID NO: 18587 - DNA, 180 bp, Homo sapiens
  misc_feature 71: n=a, g, c or t
aaaaccctccgcccaagttcttctaactcaggctgcgctccgatctgtcatcgcgttatttcgcactccancccyccccccacccccgaaaagtgaagttmaaytccctaamagttctsgyttccccaaamaaaagggaaaaaagtgaaaaaaaaaaaaaaaaaaaaaaaaaaaaaaaar

SEQ ID NO: 18588 - DNA, 193 bp, Homo sapiens
aaaaccctccgcccaagttcttctaactcaggctgcgctccgatctgtcatcgcgttatttcgcactccacccccccccccacccccgaaaagtraagttmaactccctaamagttctcgyttccccaaamaaaagggaaaaaagtraaaaaaaaaaaaaaaaaaaaaaaaaaaaaaaaaaaaaaaaaaaaam

SEQ ID NO: 18589 - DNA, 456 bp, Homo sapiens
  misc_feature 90: n=a, g, c or t
ckgtggacggttgaccaccagccaccacatcatcccagagctgagctcctccagcgggatgacgccgtccccaccacctccctcttcttntttttcatccttctgtctctttgtttctgagctttcctgtctttccttttttctgagagattcaaagcctccacgactctgtttcccccgtcccttctgaatttaatttgcactaagtcatttgcactggttggagttgtggagacggccttgagtctcagtacgagtgtgcgtgagtgtgagccaccttggcaagtgcctgtgcagggcccggccgccctccatctgggccgggtgactgggcgccggctgtgtgcccgaggcctcaccctgccctcgcctagtctggaagctccgaccgacatcacggagcagccttcaagcattccattacgccccatctcgctctgtgcccctccccaccag

SEQ ID NO: 18590 - DNA, 498 bp, Homo sapiens
atatgttgggatgtcacaaatggacttagcctacagagatttatattcaacttttgaccagagagttccattttaatgtgacactgagagtaaaaaactatcttttcctccttacctatttctcttcctacattcttggccaggaggaaggcactgctacatacccagtcttccccagcagagcctgagcagctctgttttccttctacttcccctcttctttcacatctcatgaccaagcacttcctattctgtctcccaaatgatcacagactttttcctccgcttttgtcactgccactgcccttagcattactctgcctttagagaaagtctcttaatttgtttggttgcttccttcagtccttattatacagaccactacacacacatctgacagagacttttcaccttttcatggttgaatgactgaaattcccagaataaaattaaaaccaccccagcatcaaatttgaggtcaaatagaggtgggtttgt

SEQ ID NO: 18591 - DNA, 452 bp, Homo sapiens
aaccttaaaacctgcatacctcttcttacagtgaggagtatgcaaaatctggaaagatattctaktttttttatataggtagataggatcgccatttatttcctatttagatatactgacattcatccatatgaaaatatgcaggtcattagcttactataatttacttttgacttaatggggcataaataaaactttcatagtacacatgaggtggatatttgatacacagaacatttgcggtgggctttctgtgggttagatgtaaagcccacatattttaatattcactattttaaatgagcdatgcatgaggggaatgcagtgtcagtacctggcctatttttaaactagtgtaatcaccctagtcataccattcagtatgtttgctttttaaaataagtaaccacaattaagttgttgtagccttgcacttcaagagatctagtctt

SEQ ID NO: 18592 - DNA, 584 bp, Homo sapiens
aaaatagctgctattctatgtggagtcacattaagctttttcttatctttttctatggggaagctatagggtgggtaaggaaaaaatgttgaatgcttttactttgctgaaaatattagaactctcttgtgacaggatacagcaaattataattaaatataaattaccagaaccagagctacctctaagtcatacttcctcaagcacaaagctctcaggcatatgagacccaccttaatgaagggtctctgatttcttgagcatcagcgagtttcagaagtgactatttttttgtactcttctagtttccttgtaactatacactttttcccattccacactgtgcttaaatgacaaagactcttctgagaagccaaattctgtccaagtattaactagagatattgttgattaaagaaaatctagaactgaagtgaaagaagagagttccagttctaatagtcttttgattaacaattcttttctgagaaatgatttttataagaaatggggtgattctttaaatgcttttcttaagttgaaggcacaacagttaatggctgtattgttgstattccgttgct

SEQ ID NO: 18593 - DNA, 288 bp, Homo sapiens
attaataaacctccaagatgaagatgacacgttgatttcttgtttgaaattaaccaagtcccgagaaaagaaagtgaatagtgttagcacgaggaggaaggaagaaatggagattagattggatactctttctgcatcactgggtagatccagcactttaaataactgcaacttggaagataaattagcttggtatgaaggtgaagcttacatgtggcatcactggaagccttttcctgaaaaccctctctggacatgtcttgatttccaaatagcacaagttggacc

SEQ ID NO: 18594 - DNA, 450 bp, Homo sapiens
aatgagtgtgtttcagtctacctggattaaacgtttgcttctcttcgtctaccttgattaaacgtgcacttcgcagtcctcggttctccatacccgtgacctggggatcgctacggaccttaaaatacccgcaacagccccttcgtcccaagtaagtaggagaattgcttccctttcggtttaaaatctctctgaggccgttccttgctctctgcctttcttccttaggaccatgtagacaaccccattcaggtagtgttcccgcttaaaaccctctgcttgggccccgcgccaagtcgagtcctcattcgggatgtggactagcgcccttcgcgatccccgagctcctccgtcgtctgcccctggaggggagcgcccactgtccggctcctgaaggagcsctttctcctcccacgtcctgggattctgcagaccctccctgtcgtgagg

SEQ ID NO: 18595 - DNA, 510 bp, Homo sapiens
gcgccagggaaaggccttatcgctgtgtgtgtgtttcagtctacgtggattaaacattacttcgctccgtctgcctggattaaacgtgcactttgcagtcctcacttctccgtaccagtgatctggggatcgctacggaccttaaaatacccatagccccttcgcccctgcaacaggcacttctccccacgtttgatgtgtgaataattacattgactgagaaagaaacccagaagaggaagaagaggaaggaaaaggagtcagtgatggctactcaggtagagtgatactttactcaagtgaagtgatattcttggtgggtcattctgtctccttcctttgtgaagtacagggcgtcggagttgcaaatcttctctgagtctgaagtgtccttcctgacacatttgctcatgctcatccatgcttttcctcagttcctctcatcttatttagattccatctcaccatgatccagtgacatgaacttgggaagaggctgcactgggcatg

SEQ ID NO: 18596 - DNA, 553 bp, Homo sapiens
ttcatatttgtatttattaatcactgtgacaacattaaccatttgttcttaccaggaagtggtcagattatcatctgagttacagttagactggctaagtttggtattagatcaaggggaatgtccagtaaacagagaggtaagcatgatggaaataatgaagtggggtacacaggaaaaacctgactagtgaggaggagcagctgagagatagggtcagtgaatgcggttcagcctgctacctctcctgtcttcatagaaccattgccttagaattattgtatgacacgttttttgttggttaagctgtaaggttttgttctttgtgaacatgggtattttgaggggagggtggagggagtagggaagtggtccttttacaagaattttgatgcataagtgtctattgtagggtttggatgatctagtaaagtgttttagaacccctttttatcccatgcaccattcagtaaacataaaaatcacaattctgctaatgtcatttggaacttcaaaataaatatcttgtctaaaaacaataaaaaaaaaaaaa

SEQ ID NO: 18597 - DNA, 437 bp, Homo sapiens
gatttctggatattagcatctacatttttaacatgaaagttttaaattatatgatctccaaagtcactttctttctaagactgtatgactttgttattctaaggaaattccaaaatatttgctgtacagtgagaccaggaatgataactctgggaaaaggaaaatcagtgaataaagagacaacttcaactaatgttgaatgccaaagtgtaaacgttgatcgtgtgacaaatgtaaattgattcatgaggagagactgtggtttggtgcaaagaaagtgttctggaattggaagatctggatcagactcaggctctgtcagataatggctgtatcatctttgaaaagcaaaacaatctactaatgaaatcagaaggatttccagtgatgctgcccacatttctgtgaaaagaggaagttttttwagtcagatggaa

SEQ ID NO: 18598 - DNA, 406 bp, Homo sapiens
cacaaaatggtagccgccgtgggggatgtccagttttttttcctcttcccaagtacagacgcagagcagacttgtctttccgcttaacctcaacctcgtgtgatctgccagtttcgctcccgacgccaaattccagcgaaacagctgatgccagccagcttgaagacccctgccacagaagaagggaatcagcatgagaatacatcttcttcatctcgctgtcccatgacttcgccctgtactcttcagccaattaatgatctccacacttgggaccactctaaaacccttaagaacctgagactcaaagtcctcctggagacgaatttgaggtttcctcctatctgtgtttggtggccctatgattaaacctctttctcttctgcaaaaaaaaaaaaaaaaaggc

SEQ ID NO: 18599 - DNA, 531 bp, Homo sapiens
agtagctaaggtattgccctttcacactggcagtcagatttgattccctacttagaaaaacctgattggatcttctgagaatatcagagaaagactgtccttgccatccacactacagcaaaactggatccttgaactttggggtcataatctcacaactgagaagagttcctcaacactcctggaactgtacctccattggtacccttaagcctccaactgcaattctcaacacacgcttaacactactatccgccagtgaggaaggactttccacgacttctgaagcaacatattaaggacaaagaataaacacagaagaatcaggtatactcgcaagaggaagaagaggtcaggaaagccttcacataagaagtggtgcttcttgaaggaacagaggtgcttcttgaaggaacagaaccatgtgcctgcctcaccttgctgttctgaagatttagtaacatcatttatttcaagcattcagcatacctgcagtccacaaatgttagtgaaaaacaaaaaaaaaaaaaa

SEQ ID NO: 18600 - DNA, 516 bp, Homo sapiens
acatctccacaggcttggcgacgcatgtttcaagggcagcgcggttggttttgcggcasgttascaggatctgaggcaattctgggtggctgaagggggaacgatcagtgacccgcgagccgccgacttcttgttcagctgtgatgcctcgcacccagacacgctgagaatatatcagagccttgattacatagaagataatgctacagtttttcatgcctactatctctctgctgtagctaatgccaaaataaaaaactcggtggctttgggtcatttcattcttcctcctgcgtgcctgcaaaaagaaataagaagaaaaattggtagttttatttgggaacaagaccaacattttctgatagaaaagcatgatgaagtaacaccaaatgaaataaagacccttagggaaaacagtgaactagcaacagagcacaaaaaagaattatccaaaaggtggagtctcgttctgttgcccaagctggagtgcagtggtacgatcttggctcactgcaa

SEQ ID NO: 18601 - DNA, 496 bp, Homo sapiens
aattaggaaaacaggtggtgggaagtcattctgagcagagggaagaacatgcgggaagccatagagcgtcataaggcatgaccctatcccagcgctgctagagggcccctatttgtgaccaattgtaagatcatctgaagatcgagtccgattgcctggccaggccgggctgggtggtatgtgcccccgtcacgccggagttcctgctttagcgacgccaaagattgggtgtgagggcagcccgcggtgacagagacacggatcggaccgagagaaaaaggctgtgggcttcactgagcagagtgacgtcaattcacaggacctccacagtgtgccttttgctgggtaggaaaatgccagccagcttggaaaacaagaagacacatttatgtctaccatgagcattggcatcagccaattatcccacacgttttcggctagccagtgctgaagagagcaagaatttcaacccttcttgctacattcaagacataga

SEQ ID NO: 18602 - DNA, 314 bp, Homo sapiens
cataactcaacttggcacttgcataaatatatacaactataatttgtgagcttacaataaaaaatgtctgggacatattaacactgagatttttctattaagcctatgtgcaccaatggtgagaaccactgaacttaggattcgaagattatactgcaacctccaagagactagaggtacctccaaagcaagaggtactacataaaataggaaagtccctgaatcttctgtattcaatttaatgaattaatgcaaatgataatgtaaccaccaccctgatcatctgcttctcaaagggtggtccaaggactagc

SEQ ID NO: 18603 - DNA, 433 bp, Homo sapiens
gatatggttttagaagagtttaattttactggtattttggaggtgttatacagaaaaaggctttgtaacttgtagcttttccaaacagtacctaccatgaccagtaagaatgatgttaatagatatggtggtagagaaggctttctcctaggcggcgggcctcatgaaaatagatgcaggctgggcgcggtggctcacgcctgtaatcccagcactttggaaggctgaggcaggtggatcacctgaggtcaggagttcaagaccaacttggccaacatggtgaaacctgtctctgctgaaaatgcaaaaattagctgggtgtggtggcaggcgcctgtaatcccagctactcgggaagctggggcaggagaatcgtttgaacctgggaggcagaggttgcagtgagccgagatcgtgccactgcactccagca

SEQ ID NO: 18604 - DNA, 419 bp, Homo sapiens
atgtgacttcggcaagatggctgccctgacagcggasattttgcagcactccagagcctgctcaaggcctcctcgaaagatgttgtcagacagctgtgtcaagaaagcttttccagttcagcccttggcttgaaaaaactcttggatgttacatgttccagcttgtctgtgacccaggaggaggcagaggaactgctccaggctctgcascgcctcactaggctggtggcattccgtgacctgtcctctgccgaggcaattctggctctctttccagaaaatttccaccaaaccctcaaaaacctgctgacaaagatcatcctagaacatgtgtctacttggagaaccgaagcccaggcaaatcagatctctctgccacgcctggtcgatctggactggagagtggatatcaaaacctc

SEQ ID NO: 18605 - DNA, 176 bp, Homo sapiens
aaaaaattagcattacctgggaatctgtttaaaatcattgacaggcctgagagttttccatacggcctgcaccctaacctctgggaagaaaatatccacaatgaaatttctacaagattagaggaaggagagaggcaacggggattccatttctactaggagtatcaacctctgag

SEQ ID NO: 18606 - DNA, 390 bp, Homo sapiens
  misc_feature 84: n=a, g, c or t
gagcgcagasgtttggtcgttcgttgggcggtgctggtttttcgctcgtcgactgcggctcttcctcgggcagcggaascgcgncggtcggagaagtggcctaaaacttcggcgttgggtgaaagaaaatggcccgaaccaagcagactgctcgtaagtccaccggtgggaaagccccccgcaaacagctggccacgaaagccgccagaaaagcgctccctctaccggcggggtgaagaagcctcatcgctacaggcccgggaccgtggcgcttcgagagattcgtcgttatcagaagtcgaccgagctgctcatccggaagctgcccttccagaggttggtgagggagatcgcgcaggatttcaaaaccgacctgaggtttcagagcgc

SEQ ID NO: 18607 - DNA, 396 bp, Homo sapiens
  misc_feature 80,178: n=a, g, c or t
gagcgcagasgtttggtcgttcgttgggcggtgctggtttttcgctcgtcgactgcggctcttcctcgggcagcggaasnacgcgcggtcggagaagtggcctaaaacttcggcgttgggtgaaagaaaatggcccgaaccaagcagactgctcgtaagtccaccggtgggaaagcyncccgcaaacagctggccacgaaagcskccagaaaagcgctccctctaccggcggggtgaagaagccthatcgctacaggcccgggaccgtggcgcttcgagagattcgtcgttatcagaagtcgaccgagctgctcatccggaagctgcccttccagaggttggtgagggagatcgcgcaggatttcaaaaccgacctgaggtttcagagcgcascat

SEQ ID NO: 18608 - DNA, 469 bp, Homo sapiens
gtttagaatgcaaggsttcctcaattctccacccttcccctcttgacatcttgctcttcttcccttcatctattgtgttagtcaggtgcatgctggtcttccctctatcaaactgtaagctacttggagacttgggatgcctcactcatctctattcccaaacctcagggtctatcattctaccttctgtatagacaggactttcatagttttgaacaagtcagaacctgaaagaatttgcttccagaacaggacattgacaggaaaattaagcatgatcatgcagtaaaataggaataagaattggacctacctcaagatctgttgagaagattatgagagagctgatggatctaaaarrwttggcgcttggtaatgactgtcaattctttctattacttctgtgtgtaattcatcacctattcttgttcatcacttgcgaaaattgtamccctttctgtactgagta

SEQ ID NO: 18609 - DNA, 254 bp, Homo sapiens
svdatgtatcgccgctcagctttccctaaggcagccatcaaaaggcactggatgtgtgtgagaagtggggagaaatgccaccactacaacccaaacatatgagggaagccgttagaaggttaaagtcaaaaggacagatccctaactcgaagcacaaaaaaatcatcttcttctagaccaaagtctagaaaggcctatgttactgacggaagaagtattggttccagacttcctataagactgtctgcattggt

SEQ ID NO: 18610 - DNA, 417 bp, Homo sapiens
gctctctgctcctcctgttcgacagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccctttcattgacctcaactacatggtttacatgttccaatatgattccacccatggcaaattccaaccgcaatagtgactctgtgcttgtctgtttagttctgtgtataaatggaatgttgtggagatgacccctccctgtgccggctggttcctctcccttttcccctggtcacggctactcatggaagcaggaccagtaagggaccttcgattaaaaaaaaaaaagccattaaa

SEQ ID NO: 18611 - DNA, 222 bp, Homo sapiens
taacaacatccccattccccacctggtcctcccccttcccatgctgccaacttctaaccgcaatagtgactctgtgcttgtctgtttagttctgtgtataaatggaatgttgtggagatgacccctccctgtgccggctggttcctctcccttttcccctggtcacggctactcatggaagcaggaccagtaagggaccttcgattaaaaaaaaaaaagaca

SEQ ID NO: 18612 - DNA, 346 bp, Homo sapiens
ttataatttataattatgaaggaattataaaaagggaattttgtttttatgactagaggtagatttactgtgaagctaacaaagctgaagctgcagagcccttgcttgtctaggttttctctgaccctgttcttaatttaatttaatttaaaaaagtgttttttttgagacggagtcctgctctgttacccaggctgtgtagagcagtggtgcaatctcagctcactgcaacctccgtctcccaggagagtcgcttgagcctgggaggtggaggttgcattgagcctacattgtgccactgtactctaacctggcgacagagtaagactctgtctcaaaaaaaaaa

SEQ ID NO: 18613 - DNA, 480 bp, Homo sapiens
attttctgtggtccaactaccctcggcgatcccaggcttggcggggcaccgcctggcctctcccgttcctttaggctgccgccgctgcctgccgccatggctggtggaggacaccttcaccatagatgaagtctctgaagtcctcaatggattacaagctgtggttcatagtgaggtggaatctgagctcatcaacactgcctataccaatgtgttacttctgcgacactgtttgcacaagctgagaagtggtatcttaagctacagacagacatctctgaacttgaaaaccgagaattattagaacaagttgcagaatttgaaaaagcagagattacatcttcaaacaaaaagcccatcttagatgtcacaaagccaaaacttgctccacttaatgaaggtggaacagcagaactcctaaacaaggaaattttaagacttcaagaagagaatgagaaattgaagtcaaggttgaagacc

SEQ ID NO: 18614 - DNA, 410 bp, Homo sapiens
agacatatgacagaagactgaacaaccagaagttatgaagataggtactgtgggtgttagaaagattcacggcaaaacagggaagcatctaggctgcttgtggaagtcagaccaaaatagcaggaaggtattgcagcaagatggatttgggaaaggaccaatctcatttgaagcaccatcagacacctgaccctcatcaagaagagaaccattctccagggaccaagtcatatgctgagggggagggagagcatcaggaagaatagataatagatgctgggcttaatacctaggtgatgggatgatctgcacagcaaaccaccatggcacatgtatacctatgtaacaaacctgcatatcctgcacatgaacccctgaacttaaaataaaagttgaaaaaaaaaaaaaar

SEQ ID NO: 18615 - DNA, 269 bp, Homo sapiens
gtgcgtgccgctcggcgwssgggacgggcctgcgttctctcctccttcctccccgcctccagctgccggcagsacctttctctcgctgccgctgggaccccgtgtcatcgcccaggccgagcacgatgccccctaaaaagggaggtgatggaattaaaccacccccaatcattggaagatttggaacctcactgaaaattggtattgttggattgccaaatgttgggaaatctactttcttcaatgtgttaaccaaaaaaaaaaaaaaa

SEQ ID NO: 18616 - DNA, 517 bp, Homo sapiens
agtctacattttgatgccacgttgggcaaatctccttacctctatggtagtcatcactattttttaaagctaggagattatctcagttccttttaaaacagcttttatagaaggtggttgagttttccactggaatttcaaactgtaatcctagcaaatcgaatgacctctttacactggccaattattcatctgccaaataataacagccaccactgatcacgtgggagcttacccaatgccatgcgtgcactatgttctgaacgtgcacaccaggcgatctctctcatttagtgctcacaattttgaggtagacattagctccatttaactgatgaaaaaactgaggctgaacgaagttaaaaacccatcatgcagcatctgcagagcggcggttctaaaaacgcctcacagtaagaaagaattgctaacaaacagtagctttgcctctaagcgcccgcttttcctctaatattcacagacgggtatttagaacgttaaagagccggaagccttg

SEQ ID NO: 18617 - DNA, 500 bp, Homo sapiens
  misc_feature 163: n=a, g, c or t
agtctacattttgatgccacgttgggcaaatctccttacctctatggtagtcatcactattttttaaagctaggagattatctcagttccttttaaaacagcttttatagaaggtggttgagttttccactggaatttcaaactgtaatcctagcaaatcgantgacctctttacactggccaattattcatctgccaaataataacagccaccactgatcacgtgggagcttacccaatgccatgcgtgcactatgttctgaacgtgcacaccaggcgatctctctcatttagtgctcacaattttgaggtagacattagctccatttaactgatgaaaaaactgaggctgaacgaattaaaaacccatcatgcagcatctgcagagcggcggttctaaaaacgcctcacagtaagaaagaattgctaacaaacagtagctttgcctctaagcgcccgcttttcctctaatattcacagacgggtatttagaaacgttt

SEQ ID NO: 18618 - DNA, 508 bp, Homo sapiens
cagatatttgatggaaagtccttaaaggccaatgagttggatggcaagaatgcaggcagaagctgctggataaaataggctacagccacctcagatgctttcagtgctctgtctgaggatgtgtatatgcatatgcaaactcgacccccgttcctgcccagataatggctcaataactctgaggcatggttgctcagcctctgagggcaatacaggcatttaaaaaattaaaatgaccaggcacagtggctcacgcctgtaatctcggcactttgggagactgaggtgggagcatcgcttgagaccgggagtttgggaccaggctgggcagcacggggagaccccctctctacaaaaacatttttaaaaaattagctgggtgtggtgatgcgtgcctgtggtcccagttacttgggaggctgacgtgggtggctcacttgggcacaggagtttgaggctgcagtgacctatgaccacatcactgtacgccagcccgggtgagagaggg

SEQ ID NO: 18619 - DNA, 483 bp, Homo sapiens
tgtttaatataattgtatttataaatgctgatagatttaaaggttttaaagttttatatttttattattgcaggatagaaggataaaggatgcatgtgtagtatttttattttgaaaggaaaatgtacaatgtgtgaacaaaaacattaagagatttaatatactattttcttattttagatttttacattcaataagtataaattctcatctatataaggtattgtgtgcaaatttgggaaaaaactgattagcagccatttagtagaagctatgcctctgatttttaaagaatggtttcaatctggtttaagcttctgagagaattttggataatgggatagatggtaacatttttttcttatccctgttacaggattctagatttgtgcagtaggattgtgggactgtgttttaggagagaaggatgtcttggatgtccagtttctgtggttaatccttacttgcttatccagtgacagc

SEQ ID NO: 18620 - DNA, 63 bp, Homo sapiens
gattggccgtgttgtacggcggsttctcgcgcmtgatgacctkgaagtgatgcctaaagctgt

SEQ ID NO: 18621 - DNA, 492 bp, Homo sapiens
aaaccaggagttctataaacgggttcagctgtgggagtaaaataggagtaatttcatagcttctccgtataattgcactgtatctgtaagagtagaagacgtcaatcttaaaagatttgaggaggttatttccacacattaaaagtgggtcaaccaaaaccgcatggcgtactactctctgaagcctctactaccctgctcctccgtgttgacatgtggtcaggcaagccaggacttactcacatcagctacatcagttactgggatggagaaaattgaagcctagaaggatcaagaaactttctccaggccataaatagaggaatcaggattcaaatcagatagaccccagggcttgttctcttcaacaccacattaccctacattattattcaattattaaataaaaccttgcattagtggcatttccaaatgcataacaaaaaaataaaaaaaagtaacactggtaaaaaagaaaaaaaaaaaaaaatg

SEQ ID NO: 18622 - DNA, 470 bp, Homo sapiens
cagatatttgatggaaagtccttaaaggccaatgagttggatggcaagaatgcaggcagaagctgctggataaaataggctacagccacctcagatgctttcagtgctctgtctgaggatgtgtatatgcatatgcaaactcgacccccgttcctgcccagataatggctcaataactctgaggctggttgctcagcctctgagggcaatacaggcatttaaaaaattaaaatgaccaggcacagtggctcacgcctgtaatctcggcactttgggagactgaggtgggagcatcgcttgagaccgggagtttgggaccaggctgggcagcacggggagaccccctctctacaaaaacatttttaaaaaattagctgggtgtggtgatgcgtgcctgtggtcccagttacttgggaggctgacgtgggtggctcacttgggcacaggagtttgaggctgcagtggaccta

SEQ ID NO: 18623 - DNA, 437 bp, Homo sapiens
aaaattatgcttgctcacattaatggtcaggaaaaacagcaactgcagaaagcagataatctatgccatgtccattagacactaacaccagtattggttttagctctattttttgtaccaccatatggatttgtacattttcccccaaacctggtcacctattgccaaagactgggactttttacatcccatggagaagtttcccagcatgattgatcacccactggaaaactctaatattgtacagtgggctcttgaaagtgaagcaaagaacvttcttggtgaaggaggaattggacaagccctaagataaaattttgcctggagaagtgaacagttattgaagacatcttcctgattttaaggcaaagttgttatctatgcaacaagccagagaaactgcagttcaacagtacaaaaaactggaagaggaaatc

SEQ ID NO: 18624 - DNA, 479 bp, Homo sapiens
acttccggttctctgtcagtcgcgagcgaacgaccaagagggtgttcgactgctagagccgagcgaagkttgcctaaatcaaaggaacttgtttcttcaagctcttctggcagtgattctgacagtgaggttgacaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggattgcagaagaatttgtaagatgaatacttttttttaatgtgcattattaaaaatattgagtgaagctaattgtcaactttattaaggattactttgtctgcccaccacctagtgtaaaataaaatcaagtaatacaaaaraaaa

SEQ ID NO: 18625 - DNA, 405 bp, Homo sapiens
acttccggttctctgtcagtcgcgagcgaacgaccaagagggtgttcgactgctagagccgagcgamgttgcctaaatcaaaggaacttgtttcttcaagctcttctggcagtgattctgacagtgaggttgacaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacttttttttaatgtgcattattaaaaatattgagtgaagctaattgtcaactttattaaggattactttgtctgcccaccacctagtgtaaaataaaatcaagtaatacaaaaraaaaaaaaattgc

SEQ ID NO: 18626 - DNA, 325 bp, Homo sapiens
aacgaccaagagggtgttcgactgctagagccgagcgamstgcctaaatcaaaggaacttgtttcttcaagctcttctggcagtgattctgacagtgaggttgacaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatg

SEQ ID NO: 18627 - DNA, 331 bp, Homo sapiens
  misc_feature 41,322: n=a, g, c or t
aacgaccaagagggtgttcgactgctagagccgagcgvstngccctaaatcaaaggaacttgtttcttcaagctcttctggcagtgattctgacagtgaggttgacaaagttaaagaggaaaaagcaggttgctccagaaaracctghaaaggaacaaargacaggtgagacttcgagagccctgtcatcttctaaacagagcagcagcagcagagatgataacatgtttcagattgggaaaatgaggtacgttagtgttcgcgattttaaggcaaagtgctaattgatattagagaatattggatrgatcctgaaggtganatggaacca

SEQ ID NO: 18628 - DNA, 474 bp, Homo sapiens
tccctgtgatggactggagtctgtctaggatgggttcccgccttgccttctgagctgctaaaataggctgcagcgatccactactgtaaactggaataagcatgtaaataattatcttgttcttattgttcttaattctatgcatagcttatatttatttcagtgtttaatattagaagtattttagtctttagaagtttggtgatgctgtaaccagaaatatttggtaggaacttaactcttatctatttcaattagcctgttggtaaaattggtttccttatgtgtcgcttaacttaaaattacagtttctaaaaatctgtcaacgatgttaagtgaggacttactgtactttatttcttctaatgcctgaataatattctgttaatataccacattatgtttgttgatgggcatttgggttttctccatgtttttttcaattataaacaataatgctgcgaaaaaaaaaaa

SEQ ID NO: 18629 - DNA, 452 bp, Homo sapiens
aacgaccaagagggtgttcgactgctagagccgagcgamstgcctaaatcaaaggaacttgtttcttcaagctcttctggcagtgattctgacagtgaggttgacaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttatgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgt

SEQ ID NO: 18630 - DNA, 493 bp, Homo sapiens
actggcagattattgcaaaaagggcacggggcagagggactatgttgtgagcctgcgaaagaagtttgtgtggggactgtgggcagtgaatgcgttgggaacaatatggaaaactgggagctgccttggaatctacagggccgggctgaagaaaagaagaatggtattcatgcagttcccattttacagatgaaaacaagaggactttttctgtgaagtcaagaaagtggttacaatggtactttcagcctgtccgaattatgtattgcccctcccctttttattaataacattgaagtgtgatgggacaaccactgaagccgtctgttgaaacctgctgggactttttagccattctcttcaacataaagaatgggtgtttttggagggggtgagaggaatggggaaatgttgtcaaagagtacaatgttttagttgagacaggaggaatatattttgttgagatctacagcacagcatggtgactgtagtt

SEQ ID NO: 18631 - DNA, 471 bp, Homo sapiens
gttttgagccccggaggcagagcggctgccatggccaagtacctggcccagatcattgtgatgggcgtgcaggtggtgggcagggcctttgcacgggccttgcggcaggagtttgcagcctctaccccctaaraaaggraaccactcctggagaagaggcagctcctagccacctgtccctgtgtctctcatcctgtgctggtggcaggggtgagccaccaactcggaaggcccagggtgaagtgtgggctgctgaggactgagcgatcacccacatgtccacacagccagccgggccgcagctgatgcccgaggacgcgctggacaccggtctgcagccgcttccaacctctccggcctcagcctccaggaggcacagcagattctcaacgtgtccaagctgagccctgaggaggtccagaagaactatgaacacttatttaaggtgaatgataaatccgtgggtggctc

SEQ ID NO: 18632 - DNA, 441 bp, Homo sapiens
acccgccgacsacgcttgatccccggccgcggggccaggaagtcggagtttgagccccggagcagagcggctgccatggccaagtacctggtccagatcattgtgatgggcgtgcaggtggtgggcagggcctttgcacgggccttgcggcaggagtttgcagccagccgggccgcagctgatgcccgaggacgcgctggacaccggtctgcagccgcttccaacctctccggcctcagcctccaggaggcacagcagattctcaacgtgtccaagctgagccctgaggaggtccagaagaactatgaacacttatttaaggtgaatgataaatccgtgggtggctccttctacctgcagtcaaaggtggtccgcgcaaaggagcgcctggatgaggaactcaaaatccaggccaaggaggacagagaaaaaggggcagat

SEQ ID NO: 18633 - DNA, 442 bp, Homo sapiens
acccgccgaccacgcttgatccccggccgcggggccaggaagtcggagtttgagccccggagcagagcggctgccatggccaagtacctggtccagatcattgtgatgggcgtgcaggtggtgggcagggcctttgcacgggccttgcggcaggagtttgcagccagccgggccgcagctgatctccgaggacgcgctggacaccggtctgcagccgcttccaacctctccggcctcagcctccaggaggcacagcagattctcaacgtgtccaagctgagccctgaggaggtccagaagaactatgaacacttatttaaggtgaatgataaatccgtgggtggctccttctacctgcagtcaaaggtggtccgcgcaaaggagcgcctggatgaggaactcaaaatcccaggccaaggaggacagagaaaaaggggcagat

SEQ ID NO: 18634 - DNA, 441 bp, Homo sapiens
acccgccgaccacgcttgatccccggccgcggggccaggaagtcggagtttgagccccggagcagagcggctgccatggccaagtacctggtccagatcattgtgatgggcgtgcaggtggtgggcagggcctttgcacgggccttgcggcaggagtttgcagccagccgggccgcagctgatgcccgaggacgcgctggacaccggtctgcagccgcttccaacctctccggcctcagcctccaggaggcacagcagattctcaacgtgtccaagctgagccctgaggaggtccagaagaactatgaacacttatttaaggtgaatgataaatccgtgggtggctccttctacctgcagtcaaaggtggtccgcgcaaaggagcgcctggatgaggaactcaaaatccaggccaaggaggacagagaaaaaggggcagat

SEQ ID NO: 18635 - DNA, 104 bp, Homo sapiens
  misc_feature 68,76..77: n=a, g, c or t
gaggcaatgcgcatgcccagcgccgtatcgcgcacgsctctctgcggctttccttgacctctgacccnycgaccanncttgatccccggcsgcggggccaggaa

SEQ ID NO: 18636 - DNA, 433 bp, Homo sapiens
  misc_feature 421: n=a, g, c or t
acgaagacgaccgggctctcaagatggcggccccatgcggaaacagctccagggagcagccatgttgcttcctgaacaaagcctctgaagatgcggaacgggcaaaaccgcccagtacggaacggcgcastcgggagcccggtgtggtgctcgcggacaggaagcaggagagtttgccaatagggatgtgacagcggttcccattaagcggtgatggtggttttgggacctgataatcgagctgggagtcagaggcgggatgtgtgcggtgaagggtgagtctgtgggattggtaatgggaggagaggagcccgtgaggtcagtggtaggaggtttatgaaatcactggtgggggaagtaggtgggattaatgttggatttatgtgggaktccgagatgtgattagtaacagggaagtganaggtgagggggt

SEQ ID NO: 18637 - DNA, 489 bp, Homo sapiens
agaaattgggaacctgggcttctcagaagctgttaactagatggggaataaaaaactgtgtagataatggcaaattgggcagaaatttctaagaattgccttgaatgtgctattacacatttatttatgtagtgctaacaagataaatgtatgtgtaaaaagctagatatttaaaaattcacttagatgattacgaaatacggttttgatttgatgtgtatttcaataagaaaaggttgaaacagccttacagtattaaggatgttattagagataattctgatattactcagaacaaatatatttgctatcaatggcaatttctatttagctctttctccttgtaaatgattttgtgaggtgcctggcagatgatatccgcagatggcatacaaaggcacattggcacacaggaacagcctttgctggccagttctgccatagccaaatttagggagcaggaagatggtaaaacgacaaatcattaag

SEQ ID NO: 18638 - DNA, 383 bp, Homo sapiens
gcctagtggagtgaggggtaacaagatggcgaccgagacggtggagctccataagctaaagcttgccgaactaaagcaagaatgycttgctcgtggtttggagaccaagggaataaagcaagatcttatccacagactccaggcatatcttgaagaacatgctgaagaggaggcaaatgaagaagatgtactgggagatgaaacagaggaagaagaaacaaagcccattgagctccctgtcaaagaggaagaaccccctgaaaaaactgttgatgtggcagcagagaagaaagtggtgaaaattacatctgaaataccacagactgagagaatgcagacacctcatggcacttcaaactattaaaatgcattttatcttaaaa

SEQ ID NO: 18639 - DNA, 405 bp, Homo sapiens
  misc_feature 126..127: n=a, g, c or t
ggagtgaggggtaacaagatggcgaccgagacggtggagctccataagctaaagcttgccgaactaaagcaagaatgkycttksskcgtggtttggagaccaagggaataaagcaagatctkatvnncagactccaggcatatcttgaagaacatgctgaagaggaggcaaatgaagaagatgtactgggagatgaaacagaggaagaagaaacaaagcccattgagctccctgtcaaagaggaagaaccccctgaaaaaactgttgatgtggcagcagagaagaaagtggtgaaaakkacatctgaaataccacagactgagagaatgcagaagagggctgaacgattcaatgtacctgtgagcttggagagtaagaaagctgctcgggcastaggtttgggat

SEQ ID NO: 18640 - DNA, 474 bp, Homo sapiens
atcaggcattcgcctgcctctcacaaatgtttcagggaggccagttctgcagggtgtcagctccaggacccacagggccagaaccagctgggagaattggttatttgagatgtggtactgcttcctcacaagtctcccacaggccatgtaaagggtatttttttgtggcttgctgtgttrctgagatcatcgtatgcaacagctgggtaataagactagcatagctcaaactatcctgccaaacgctctcatctgatttttcctcccttctcccccaacctccaatcaccctgagtcacctgtaaattcatttgtcattcaaagcggaataacaagttgtccctagcaaaaccgctgagcgctttataattttgtggtgtatttttgtcagtaggtagcagaggcggaagtattttttggtgtaattcttgaaattttctgacaggraacaaataaagatagatgtgtctgagt

SEQ ID NO: 18641 - DNA, 540 bp, Homo sapiens
aaccagggagactgcagtttgcagtgatgtggctaagatacccttgtgctattaaaggcacatttacgtatctttcaacgcagtttgtacctttgtttagggttctattgaactttctctgtgctctttagaaaaccgtcgaatgaaggtaaccatctttttgggtgcctgggcatggtcattgtcccagagttttaacataagtctctactaaagtatcctgatttgcaagggaggtcatggaccaagtacaaagcggcaaaaggatggaattaagggatatttccagtgaaagaaagaagaaagcatgcttttctcttgactgtgcagaaaaaaaaactatgtttctttgattctccattttactagatgccatacctttgcaattacttcatgtggagtcttgaccaasattcaggaaatactagaactttcagtcccagaaggttactctgggcattactagtccccatcattatgagttgagttttastagttaatttcagacgaaaaatattgttttcccaaaatctgggttag

SEQ ID NO: 18642 - DNA, 443 bp, Homo sapiens
aagtcatatgcccacttttggggaccttcatttaggtgagctgccacgtccggagagggcagcaagaatgaaagacctctagttttccagactcccggagccctsgtctctacaccacatggacgttatccacctcctctgtgtcctcccagcatttcagaaggtgatccacggcaaagcgtcccttcaaatccgtctttgtgcccactgccatagtcaaccccgtgagaagcacagccggcmctgggactttaggacaagggtctcttcggaaagggcggasagcatgagaaagagtaagtggtggcagagagatggatccctgcagagacccctccagtccgggatccccactctcgtggtaggctccctcagacgcagccccaccatggtccttcggcctcagcagttccaattctaccagccacaggggatcccctcct

SEQ ID NO: 18643 - DNA, 459 bp, Homo sapiens
acacaccctcacaggactgcatccacacaagctactcggcgtggtgggctgggccgagagacagtcagctggtctctttgctaagctaccagaagtcggctaacaaaatgaaaaaacttctccagcagggggcgctrgttcctaagtcagakaaaggatttcggggaacacaaggyacggatgcttcatctcccgaggacccgggaggcctcctgagcctttgctgagctttccctggtgctcctttttgcagtccagcgaatccaggggactggggcacactgcaaggggttgtggtggtgctggggctgccagaggagtgtcccaaccaagaaactggcgactgcagactcgacctagcaktcccccacctctggcccacagagttggagccaggccctgtcttggttctcaatgcactcaaaagcttaaatcctagtaaaccctccactgcggaga

SEQ ID NO: 18644 - DNA, 424 bp, Homo sapiens
gtcagctttcctcagcaacatgaagtctcgttcggctggaaaactctgggaactgcagcacgagatcgaggtgtaccgcaaaaccgtgattgcccagtgggagggcgctggacctggatgtggtgctgacccccatgmtggcccctgctctggacttgaatgccccaggcagggccacagggcatgaagaagagtgtggggctgccggtggccgtgcagtgtgtggctctgcctggcaagaagagttgtgtctgcggttcatgcgggaggtggagcgactgatgacccctgaaaagcagtcatcctgatggctctggctccagaggacctgagactcacactctctgcagcccagcctagtcagggcacagctgcctgctgccacagcaaggaaatgtcctgcatggggcagaggcttccgtgt

SEQ ID NO: 18645 - DNA, 477 bp, Homo sapiens
gaaaaggagcaagatggctgactccaaagagggtgttttgccgctgacggctgcttccactgccccaatttcattcggcttcactcgcacgtccgcacggaggcggctggccgactcgggagacggcgcggggccatctccggagraarggatttcttgaaaaccgtggaagggagggagctgcagaggtgacgcgccgggtctttcaccccttggaaatctctgcggtgggctgtgaagccaggaggcccccaaggaactcgtcatccctttgatccagaatggccatcgcaggcagccaccagcccggccccctgggcattccacagatactggggccttggcggatggggtggtgtcccaggctgtgaaggagctcattgcggaatccaagaagtctctggaagagagagagaatgcgggtgtcgaccccacgctcgctatccccatgatccagaaaggatgcacccccagcgg

SEQ ID NO: 18646 - DNA, 223 bp, Homo sapiens
  misc_feature 223: n=a, g, c or t
akcttattagcaaccagggagatttctccattttcctcttgtctacagtgcggctacaaatctgggatttttttattacttctttttttttcgaactacacttgggctcctttttttgtgctcgacttttccaccctttttccctccctcctgtgctgctgctttttgatctcttcgactaaaatttttttatccggagtgtatttaatcggttctgttctgn

SEQ ID NO: 18647 - DNA, 335 bp, Homo sapiens
aatttagcaaccagggagatttctccattttcctcttgtctacagtgcggctacaaatctgggattgcttcagatggtttgctgtatcatttttcttctttttcttttcctggggacttgtttccattaaatgagagtaattaaaatcccttgtaaatgagggcatacaagcatttgcaacaaatattcaaatagaggctcacagcggcataagctggactttgtcgccactagatgacaagatgttataactaagttaaaccacatctgtgtatctcaagggacttaattcagctgtctgtagtgaataaaagtgggaaattttcaaaagttca

SEQ ID NO: 18648 - DNA, 282 bp, Homo sapiens
agcttttctcttctgtcaaccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaattttgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 18649 - DNA, 516 bp, Homo sapiens
  misc_feature 479: n=a, g, c or t
agagacagttacgtgttcagtcatacaagtagtttcctctggtaatgcttcactaactccctttcatgagttgaatagtgaagtcagtaattaggcagtttttgcttctcaaagtgctccagacatctgcatacctgttgccctttcacagaaaataggggttgaagtggtttgccccaagtcgtgaggatcgaatcatcaatttagttgttggcagcttaacatccttattgattctagtaacgctgataagtgcttttgttttccctcaactacctccaaaaccgttgaatatattctttgctgtctgcatctctttgagtagtattactgcctgcatacttatctactggtatcgacaaggagacttagaaccgaaatttagaaagctaatttactatatcatattttctatcatcatgttgtgtatatgtgcaaacctgtacttccatgatgtgggraggtgaggctgccaaggngaagtacttaccaagactcttcaaaatgatacattag

SEQ ID NO: 18650 - DNA, 263 bp, Homo sapiens
agtcagtggtgtggtaccgggtaccgragacgtgtatcggacggtgggccgcagccatggcmgagagaaaacctaacggtggcagcggcggcgcctccacttcctcatcgggcactaacttacttttctcctcmtcggccacggagttcagcttcaatgtgcccttcatcccagtcacccaggcctccgcttctccggcctccctgctcttaccgggagtttttcatttctaagaagcaagttttcaaaaaaaaaaaaaaaaa

SEQ ID NO: 18651 - DNA, 518 bp, Homo sapiens
atatatacggagtcacctctccccagagaggtcacagccaacattcagaggcctcccagggccccctctccctggataaaccacttcagctgccccccatttttctcgagggagaaaaaggggaatcctctgtccagaatgagcaggaaggagagccaagcctacagtcacccagcttagagctccagtcccctgcgtggccacccatgcagrrktggctcaggagcccctgaaagtgtccagcagctacctcagtgacacccagagcagcgagagtcatgtttccagcgtgcagcacccgaggccagaggagggcagccatgccagcctgagcagcgggtacgcaggggacaaggagggcagcgacatcagcttggtgggcagccaccggagagtgcggctgaacagaaggctcaacacccaggcggccagtaaccaaaccagccagctgggctccatagaccctcccagctctctaaagagscggctgactggcccgccacagcaccaagcagact

SEQ ID NO: 18652 - DNA, 507 bp, Homo sapiens
ttgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggttgcttttcttaagtgcccacatttgatggagggtggaaataatttgaatgtatttgatttataagttttt

SEQ ID NO: 18653 - DNA, 397 bp, Homo sapiens
cggtgttagttccactcttggtctttcacgctccccttgcctgtggaacattgtctggtcctagctgtggttcccattgttcccccttcacccttctctgttaaccttgtgcctgtctcctgtatgatcacatcaccaaaaagggggaggggggagaagactctttttttttggccattttgtaatcgtataaaaatagtagacaactgcttaatggttggggttttttcacaattttcaacattagtgatttttttttctgtttgcaagttaaagggtttgtcatagtttctttaaaaaaaaatacaataatgcaccatatccctatgcataaagkgcttcttctatttataaggttgaaaattctgaataacccttttagcattgaaaaaaaaaa

SEQ ID NO: 18654 - DNA, 218 bp, Homo sapiens
agattccagcgagctacgcaagcaatcctggcccagccgagcttgcttccccaaatcccgtaatccttgaccttattcccccaaagaagcggcctcccgggaaggagcgccctggcgagaagactcgaacggctcccacagccgggcgttgggggaaaggtgggcgrtcttggtcgtgcgaggtcggggagggaaggtsctccgctctccattgcgga

SEQ ID NO: 18655 - DNA, 361 bp, Homo sapiens
caacccgttctgctggctcgagaacgaagtaggccgtctcgctctgggtctccaggcccgcgaccgtccgccagtcgtcccgaggccactcttcacctccaccatgagcctggacatccagtgtgaggagctgagcgacgctagatgggccgagctcctccctctgctccagcagtgccaagtggtcargctggacgamtgtggscytcacggaagcacggtgcaaggacatcagctctgcacttcgagtcaaccctgcactggcagagctcaacctgcgcagaacgagctgggcgatgtcggcgtgcattgcgtgctccagggcctgcagaccccctcctgcaagatccagaagctgagc

SEQ ID NO: 18656 - DNA, 507 bp, Homo sapiens
agattccagcgagctacgcaagcaatcctggcycagccgagcttgcttccccaaatcccgtaatccttgaccttattcccccaaagaagcggcctcccgggaaggagcgccctggcggagaagactcgaacggctcccacagccgggcgttgggggaaaggcatgaagaactcttgactgacagaaacggagggtgtgtccaaagttttgaggacggccgagcggcgctccaaaacccgtcctcacagcctcgccccgttcgcctcagctacaacaaatcatcgtcaacctgttccaccttctccagtctggtagcaaaaaggggtgtctcagaatctccggcctgtgaaactgtgaggggattcggccaagacgtcctcttccctctgcctcccacccaggccactcttcacctccaccatgagcctggacatccagagcctggacatccagtgtgaggagctgagcgacgctagatgggccgagctcctccctctgctccagcag

SEQ ID NO: 18657 - DNA, 727 bp, Homo sapiens
ctcaagctggaggacgtagaatttcactggatcagcaatgacgagcctacacagtactggagaacttggcattttctgatatagaaaaaggctttccttggtatcgtgttatcatgtgtcgtcatctatgcattagagttgatgtgttttgtactagtgtcacagcataaaatcatattacaagtacgtaaggattcagggtctcttgatagacttatcatagctctatattgaatgaaagccactgtgcttgtgttttgattggaaattcctttagtgtcagttttttggaagccaatgatgtttgccactgatacattcatagaagtgtattatattttcatgaagctttgctttaagtgacactacgcgtgcagttcatttctagttcttgatagaactgcacttaattttcagtagtagtcttgactttttaagggctgtgttatattaagttctcccttactgttaaaacctaattaaatatgctttagaattttctaagacartcctctggatcctctaaatgtgaattttgatgtaataactgctaataaaattatattgaagcagtgttttatagaaagttttttccaaagttttctatgtttggctcaattagggcagtatcatcagttctataatgtamaagaaattttckktcttttgaggtattccataaaagtagttgggaaaattattatgtaaaataataagactcttccaa

SEQ ID NO: 18658 - DNA, 325 bp, Homo sapiens
ctctgtactaggaaggatccaaggcagattttctttggtcttgctccaggatgggtggtgaatatggccgataagaaaatcctaaaacctacagatgaaaatctccttaagtattatacctcatgaattcccgtccaaggaagcagagttgttaaagagtactggaataggggctgaaggatctatattcccttattgcattttccttatgtataattttccagatggtgatgttacttttcagtgtactcatatgtctcattttcatctaaaattaaatggcaggaaacaaggactgcatagacaaaaaaaaaaaaaaaaaggc

SEQ ID NO: 18659 - DNA, 431 bp, Homo sapiens
tagcgcctagttctctcccggccgcagagctggccgcccagggggagtcgcagagtttggaagatctctctaacacctctcggccaacttcagaagtgtataagatcagctttatctttccaaatggagacaagtatgatggtgactgtacaagaacatcttctggaatctacgagagaaatggaataggtattcataccactcctaatgggattgtctacacaggaagctggaaagatgacaagatgaatggttttggaagacttgagcatttttcaggagcagtatatgaaggacaatttaaggataatatgtttcatggactggggacttacacattcccaaatggggcaaagtatactggaaatttcaatgaaaatagggtggaaggtgaaggggaatatactgatatccaaggactagaatggagt

SEQ ID NO: 18660 - DNA, 411 bp, Homo sapiens
  misc_feature 337: n=a, g, c or t
agttgtgttgtgccaatggtggagaagaaaacttcggttcgctcccaggaccccgggcagcggcgggctgctggaccgggstgcccggsacgtcgcatcarscggcagctggaggccctggagaatgacaacttccaggatgacccccacgcgggactccctcagckrsggcaagagactgcctcagtttgatgacgatgcggacactggaaagaaaaagaagaaaacccgaggtgatcattttaaacttcgcttccgaaaaaactttcaggccctgttggaggagcagaacttgagtgtggccgagggcctaactacctgacggcctgtgcggkanccccatcgcggccccagcgccccttctgtgctgtctgtggcttcccatccccctacacctgtgtsagctgcggt

SEQ ID NO: 18661 - DNA, 209 bp, Homo sapiens
aaagataatcacggatattaaccagtgtcccatcagaacacctttctccatgtcccaacccatgcttcccccaaaaagggtctgtacttaaattataagctcctcccccttaaattggtacagtagacccaggacttttgtgtctgtgcacagaaaaatgtaaaagactctagaacagtgaagcagttcatcataatgagtacttacta

SEQ ID NO: 18662 - DNA, 501 bp, Homo sapiens
agaacgcccttgttttttccaccacgtgatggcgcagacagaagacaaccagcatctatgaaccaggaagcccccaccaggcactgaatctgcccctgcgtggatcttagacttgcagactccagaactaaccttacaatgtctcttctccattaagaaaacctacttcaacatctccattggttctcaacatagagattctcttaatttaaaggatccaacgcaatgaccaatctccaattgtcaaatattgagtgaggaaaataatcatatttcatcacagtatttaagtaaggatcaaagactctaagataactgaaagcactaaattaattttcttcaccaagatcacaggaaaaacagaaactacaaggagaaatggaaaaagctggaccttccctatggacatggggaaaagtggctatctggaagtcaagggaaaagagagatttttctttataaaataaaagaaatgcctgaaccaccaaaaaaaaaaaaaat

SEQ ID NO: 18663 - DNA, 485 bp, Homo sapiens
gacgtccttggcgtggctgcaggggaggccgcggcggggaaaatggcggacgggaaggcgggagacgagaagcctgaaaagtcgcagcgagctggagccgccggagacctgaagaagaagcagaaaaacctgtgaaaactaagactgtttcttccagtaatggaggggaaagttccagtcgcagcgctgagaagcgatcagctgaagaagaagctgccgacctcccaacaaagcctacaaagatctccaagtttggatttgccataggtagtcagacgacaaagaaagcatcagccatatccatcaaacttggatcaagtaagcctaaagaaactgttccaactcttgctccaaaaactctttcagtagcagcagcttttaatgaagatgaagatagtgaaccagaggaaatgcctccagaagcaaagatgaggatgaagaatattggaagggatacaccaacatcagctggaccaaactccttc

SEQ ID NO: 18664 - DNA, 389 bp, Homo sapiens
gaaattagccccgccccgctgcggctgattcgtctagttaaaccctggtgttcctgacacaaacttcaggaaaggattttgcacttgtsagaccgggcgagcagagtaagaagcaggtcccgcataccaacaaaactaaggacgccaacttgtctggaaggcccaataaaaagctgattcatggaggaatgcaattgtcacatcctaatgatttcatctcccttaccccaacgaatcgataaccccaaattttccagcccctcaccctccacaaatccccttaaaaaactttgcctagaaccccttgatgaaatggattgaagcttgagaactcttcctgtttcctggcttgtwacttgtgattattaaaactttctctgctgcaaaaa

SEQ ID NO: 18665 - DNA, 348 bp, Homo sapiens
gggaaaggattttgcacttgtgcagaccgggcgagcagagtaagaagcaggtcccgcataccaacaaaactaaggacgccaacttgtctggaaggcccaataaaaagctgattcatggaggaatgcaattgtcacatcctaatgatttcatctcccttasccccaacgaatcgataaccccaaattttccagcccctcaccctccacaaatccccttaaaaaactttgcctagaaccccttgatgaaatggatwraagcttgagaactcttcctgtttcctggcttgtaacttgtgattattaaaactttctctgctgcaaaaaaaaaaaaaaaaaaaaaaaaaaaar

SEQ ID NO: 18666 - DNA, 483 bp, Homo sapiens
aaaggcaaggaagcggaagssagaggcggtcgggatccgctgcgcgagctgtctcggtcccacgtgtgcgagttgctacgatggaagttaaagggaaaaagcaattcacaggaaagagtacaaagacagcacaagaaaaaaaacagatttcataaaaatagtgattctggttcttcaaagacatttccaacaaggaaagttgctaaagaaggcacctaaagtcacatctaggaactttgagaaaagtatcacaaaacttgggaaaaagggtgtaaagcagttcaagaataagcagcaaggggacaaatcaccaaagaacaaattccagccggcaaataaattcaacaagaagagaaaattccagccagatggtagaagcgatgaatcagcagccaagaagcccaaatgggatgacttcaaaaagaggagaaagaactgaagcaaagcagacaactcagtgataaaaccaactatgacattgtt

SEQ ID NO: 18667 - DNA, 403 bp, Homo sapiens
  misc_feature 21,396: n=a, g, c or t
aaaggcaaggaagcggaagsnagaggcggtcgggatccgctgcgcgagctgtctcggtcccacgtgtgcgagttgctacgatggaagttaaagggaaaaagcaattcacaggaaagagtacaaagacagcacaagaaaaaaaacagatttcataaaaatagtgattctggttcttcaaagacatttccaacaaggaaagttgctaaagaaggcacctaaagtcacatctaggaactttgagaaaagtatcacaaaacttgggaaaaagggtgtaaagcagttcaagaataagcagcaaggggacaaatcaccaaagaacaaattccagccggcaaataaattcaacaagaagagaaaattccagccagatggtagaagcgatgaatcagcagccangaagccc

SEQ ID NO: 18668 - DNA, 512 bp, Homo sapiens
ataccaagacataccagaattttaggaatctaaaataattttggaatatgtataacaacacatccataaaaatgtaactcaaggagaccacctggccaacatggcgaaaccctgtctcttctaaacatacaaaaattagccgggcgtggtggcatgcgcctgtagtcctcggcctcccaaagtgctgggattacaggcgtaggccactgtgcccggcctgccatggaatttctaagtggcatggctagttcactgtaccggggcattctgacaagagtatgggttcctccccaaagcaaaacctagactccagctagcagtgttaatgctgtgtgtgggtgaccactgatgggcagagaggagacacagcagtgcctcacagatctgagttgcatgggaatctccattcagacccagggttggggtctgggttaggtaggaactcctgccacttgttggtgacatggccctaaatagggctctgagattaggttataaaaataatatggcct

SEQ ID NO: 18669 - DNA, 552 bp, Homo sapiens
agtatacacgtacatccaaagccggttctaccgatccccagaagtgatcctgggccacccctacgacgtggccattgacatgtggagcctgggctgcatcacggcggagttgtacacgggctaccccctgttccccggggagaatgaggtggagcagctggcctgcatcatggagattccaaaggttttcctaaaaatataaccaacaacagggggaaaaaaagatacccarattccaaggacctcacgatggtgctgaaaacctatgacaccagcttcctggactttctcagaagatgggaaccttctcttcgcatgaccccggaccaggccctcaagcatgcttggattcatcagtctcggaacctcaagccacagcccaggccccagaccctgaggaaatccaattcctttttcccctctgagacaaggaaggacaaggttcaaggctgtcatcactcgagcagaaaagcagatgagatcaccaaagagactacagagaaaacaaaagatagccccacgaagcatgttcagcattcaggtgatcagcag

SEQ ID NO: 18670 - DNA, 463 bp, Homo sapiens
  misc_feature 406..407: n=a, g, c or t
accagcaaaacaacaacaataggtggaagactggggccaatagtcaattgtctttaatggaggtggggaaggggataactgtatttatagcaatttaatattatgtctaagagtttagcttcaccgatgaaaccccatgattacttatacttagtcgaatgtgtttacatacatttagttgaaatctagcaacatatctaagaactagtgaagaaagcatacagtagtagcagtaataatatatgaagagaaaatattgtattgaaaaaatttttcaaaagaaaataacttgacactggaaagtggggaatagtccataaaagaaaaaaatcattgttataatgattactaaacataaaaattaaccaagtgtacatgtgaaagccaccatacacaaactgaatannaaggtatgagtctttgcwtcttgtgcamttgtgatttttcaggggggtggggatat

SEQ ID NO: 18671 - DNA, 421 bp, Homo sapiens
atcacggggaggcagggcctcgccacaccaaacctgtggacgccgacccgggaccgccgctggctggctgctggctcactcgaccgtcatggagaccctgggggcccttctggtgctggagtttctgctcctctccccggtggaggcccagcaggggtggtgggggaagggggtcttctgaccttttcttcctctgagtcgaacctccccaacttcctgcagccacggagcatcgcctgaagccgtggctggtgggcctggctgcggtagtcggcttcctgttcatcgtctatttggtcttgctggccaaccgcctctggtgttccaaggccagggctgaggacgaggaggagaccacgttcagaatggagtccaacctataccaggaccagagtgaagacaagagagagaagaaagaggc

SEQ ID NO: 18672 - DNA, 436 bp, Homo sapiens
aatctaggttttgctctccaaatggtagaagcaaccagaaataatgtaattaaagttttgaaactgtaaattatctagcatcttggcctacttcaatatactttatctgattatgtacttcactgcataattttattctatttaccactttacaattttactgccactaatgtacaaaaaatcaacacagaaacatatgatatggacgtatcacattctttatcagcctaagaacaaaagttagattaaaattagaatggataattagaatacctgctgcttaaacagatggtgaaaaaactttggaaaagctggatctgatgctaacggatggctaatgatggaggagcaacttcacttattttatgtacagaaaggaagatggttggtatctgtgcattaaaaatccaccaggataatctaaaaaaaaaaaaaa

SEQ ID NO: 18673 - DNA, 441 bp, Homo sapiens
atctaggttttgctctccaaatggtagaagcaaccagaaataatgtaattaaagttttgaaactgtaaattatctagcatcttggcctacttcaatatactttatctgattatgtacttcactgcataattttattctatttaccactttacaattttactgccactaatgtacaaaaaatcaacacagaaacatatgatatggacgtatcacattctttatcagcctaagaacaaaagttagattaaaattagaatggataattagaatacctgctgcttaaacagatggtgaaaaaactttggaaaagctggatctgatgctaacggatggctaatgatggaggagcaacttcacttattttatgtacagaaaggaagatggttggtatctgtgcattaaaaatccaccaggataatctaaaaaaaaaaaaaawtgsga

SEQ ID NO: 18674 - DNA, 270 bp, Homo sapiens
gactacgctcataaaaggaaaaaaagcgtgtgcggttctcgacgtgccgccaatcttcgaacgcaggtctgtgatcatccgcagactccgaaaaagggttcgaggaacgcgcctgctcccctcgtcgcagtttccagcycgacgagcttgttttgtcccggactcggtgcccctgtagacaatggccctcgtgtctgccgattcccgcattgcagaacttctcacagagctccatcagctgatcaaacaaacccaggaagagcgttcgcg

SEQ ID NO: 18675 - DNA, 493 bp, Homo sapiens
tcttgccaaatcagactcaaagacttctcatttgaacctgaaatggacactaattcatcttcttattaacatgcttgtaacttctggtactcccttggaaagcttttggagaagatccaacttcatgttgctactaacacaagcaagtttataccacgagatatgtatcctgttacagtaacatgaatacatgtcaattataattcccagtgcttaggtttatgtttttataattgtccccaatcacaaccattccttgtcttatacagaatttaaaaaactttgtatctattattctatagatgattggtctccctgtgtcaaagttttacaaataactggtttggatgttttctcctcatttttctgcctacctatatgttcagccagacataagacttcattgattctttcctgcacagatttaattaccaccagttccttctctgaataacatagtttgttcaaagaacatctcctgggtaatgtacat

SEQ ID NO: 18676 - DNA, 179 bp, Homo sapiens
cgtgttttaatgtattcagagccattgggcaataagcagtccagaacattgaaaactcaagcaggtaaagcacctaacacccttagtttctagaattactttaaaaaacttttatattgctgcatcttccacagttctttgggtagtctctgaacttaaaatttgtaggagttgtagac

SEQ ID NO: 18677 - DNA, 405 bp, Homo sapiens
ctggacagagcacagaattgcttcttaagtcagcccggcgcggttgcaatagacagcaaaaaggtaaacgtttgcctgaaatccgcacgccagctccaccgccccgcccgatggtcccagttcctctgggaatcgtcctgtatgcaacatcttcacaagagtggcaggcagttgaatctctggccttcgtgggaccactggacatctggcagagaaccaggaaaccacggttcccttctgtgagtccctcagccggaaaactacaaggtgtgtgactgtaggatgaggctttttgaaagatgaagtacgacactttgagaaagtgtttggaaagaaactggctgatgtcgaatggaaatctgaacattcacagatttcttttcctagatatagaaacgcaaaagc

SEQ ID NO: 18678 - DNA, 357 bp, Homo sapiens
  misc_feature 343: n=a, g, c or t
aattggggccgtaccatggcggagaagactcaaaagagtgtgaagattgctcctggagcagttgtatgtgtagaaagtgaaatcagaggagatgtaactatcggtaagaaatagtttatttactgtttttcaagaattgatgtgatttaatctattttagtgctttacaattagataccgtcttccatgtttatttcactgatgtcctagttttattgacaaaataatgcattttctcctatgtgtttaaattttctgaaagaatgtagtgtgatggaggctgtgtttaaactcctatctgagatactaatgaggctgtataacaaagtcattcatgtatttnaagagagatctgtt

SEQ ID NO: 18679 - DNA, 474 bp, Homo sapiens
  misc_feature 342,404,449: n=a, g, c or t
aagtcgcacctggagctgtcctagcgcctagttctctcccggccgcagagctggccgcccagggggagtcgcagagtttggaagatctctctaacacctctcggccaacttcagaagtgtataagatcagctttatctttccaaatggagacaagtatgatggtgactatacaagaacatcttctggaatctacgagagaaatggaataggtattcataccactcctaatgggattgtctacacaggaagctggaaagatgacaagatgaatggttttggaagacttgagcatttttcaggagcagtatatgaaggacaatttaaggataatatgtttcatngactgggggacttacacattcccaaatgggcaaagtatactgggaaatttcaatgaaaatanggtggaaggtgaaggggcatatactgatatccaaggactagaatngagttgtaactttcattttacagct

SEQ ID NO: 18680 - DNA, 498 bp, Homo sapiens
gaaacgttaacgatgcccctacagatttaggagtaacaaggcggctctcacgagatgctagacagatcaaacagaaaggtggatatttggaaagaacagtcttctcccactgatgaggtaaacctcgagaccaatccagaaataaattgccaagcttctatcaaataattcaaaakgagacccaggactcttgatgatacacttgaagtcactaaatatgaaagatgatagcatcttggaaggcaagagcagaggaaaggagaattttcacagggaagaagaaagagttggtgaaagtgaaattgctttaacaaaataatgatctctatacctccttctcgaactgtggtttgaaggacagtatcatcagcattacttggagcttgtgagaaatttagaatttcaaggccccctcgaccccaacttactggtgcaactctgtattgtaacccgatccccaaggtgattctagtgtacattaaagtgtgagagtcttgt

SEQ ID NO: 18681 - DNA, 501 bp, Homo sapiens
gaaaacgttaacgatgcccctacagatttaggagtaacaaggcggctctcacgagatgctagacagatcaaacagaaaggtggatatttggaaagaacagtcttctcccactgatgaggtaaacctcgagaccaatccagaaataaatacattaatgcgagaagacacctttcctgaaatttgttttatgtttgcaatattttaaaaaacttttcaaacagatttttacacttcacaggggactcatggctgtgatagaaaacccaagtgagatatggatacgttaatgaattaatacctgcttcatttaccaaagtaaatatcctttccttgtaaccgcaattgtctgagtccttgacacgttactcagctaacttcaaagtgaacaatcatacagtcccatcctcactactgcgtcctgctccgccaaaacacaaatcacaacaacacaatggttcggcacctagaactttctcaccgggaaacaatccaccgtgatgg

SEQ ID NO: 18682 - DNA, 458 bp, Homo sapiens
tttttaattttgtgatttatcattttattttttcttgaaatttcaaacacaaggaaagcatagaatagcttttaaaagtagctatgccttcttccaaatgttattttattcaaaaaggtaaccaggttgtgttttaaacctgtgaaatattgtgatgcattttattactgaaagttatttaactgcctttacttgcacataaaaactctcatttacggccaggtgctgtggctcatgcctgtaatcccagcactttgggaggccaaggcgggcatatcacctgatgtcaggagttcaagaccagcatggccagcagtttggtgaaacccatctctactaaaaatacaaaaattagcctggcgtggtggtgtgcgcctgtaatcctagctactcgggaggctgaggcaggagtattgcttgaacctgggaggtggaggttacaatgagccaagattgtg

SEQ ID NO: 18683 - DNA, 377 bp, Homo sapiens
tttcttactggtgtagaaattaatgcctttttttatttttcagttattttataataacgaaataaaaagaaccccccagctgccaggcgggttttggtgtttgaaatgcggggcaaagcactacatcactgcaaatagatacagagttagtctgcatgtctgtaggctgtgtgattgcggaaaatataaatgctgctaatatatttcctttttacaaaagcatatctaaatagatgattgttttgatgttaatctttgtaaattatgtattaccaattttaacattggatgtaattgcatacaaagcttgcatctcaatccttgaaagtctagtattaaatggaaaaaacttttcccaaaaaaaaaaaaaaaaaggc

SEQ ID NO: 18684 - DNA, 354 bp, Homo sapiens
tttcttactggtgtagaaattaatgcctttttttatttttcagttattttataataacgaaataaaaagaaccccccagctgccaggcgggttttggtgtttgaaatgcggggcaaagcactacatcactgcaaatagatacagagttagtctgcatgtctgtaggctgtgtgattgcggaaaatataaatgctgctaatatatttcctttttacaaaagcatatctaaatagatgattgttttgatgttaatctttgtaaattatgtattaccaattttaacattggatgtaattgcatacaaagcttgcatctcaatccttgaaagtctagtattaaatggagaadactttt

SEQ ID NO: 18685 - DNA, 509 bp, Homo sapiens
tactctgtgcggtggagcgaccctggataacagctccagggacactccttgctcaagacgctggggttagacgtgctccggctacacagcggagtgtcagggggccaagaatatccctctcctttttcttccctcctgctggctttggttgctttcctaaacattgccccaggcggcaaagtcggcttcactcttagcccttgttagggaaacgctggatccaagattagctgcgcccttctttgcttcagttgaacaagcaccagagtcgctgatttggcagtgtcggagcgggaggaactggtcttaaaaaggtacctcctgaactcgggaagactgctaaccctccagattattgttttgcatctgtgtgctgttcatgaacatacctcagagctgctcactgcaacttgaaatttcattatatttttaatcacaaagtttgcatcctacccttgatacatctgtgtttccttgacaaaaagagacaaactctgtaaaataaaaaa

SEQ ID NO: 18686 - DNA, 360 bp, Homo sapiens
aagtcgcacctggagctgtcctagcgcctagttctctcccggccgcagagctggccgcccagggggagtcgcagagtttggaagaactctctaacacctctcggccaacttcagaagtgtataagatcagctttatctttccaaatggagacaagtatgatggtgactgtacaagaacatcttctggaatctacgagagaaatggaataggtattcataccactcctaatgggattgtctacacaggaagctggaaagatgacaagatgaatggttttggaagacttgagcatttttcaggagcagtatatgaaggacaatttaaggataatatgtttcatggactggggacttacacat

SEQ ID NO: 18687 - DNA, 510 bp, Homo sapiens
agacgctgtgttctaggcaagggggatacacctgatggaagaaggtccttccctagacgtagctaacatcccagtgtgggagatgacacgaaacaagtatggtggaaatgatgtcacgcccactccaggcctaacctctaggaggactggcagtttctgctatggcctctgggagccatgagctgccatgaaaaaggtcaaactactctgctggagacacccacctggagaagccctgggattccatggagaggcagacggacccagctgagctcagtgttccagccatccccacgaaagcaccaggaacctgagtgaaaccatctcgatcctccagcatagcacaatcagcagctgaagatcactgagtgactctagtcggcgctccatggatcactgaaggatcacccagctgagccctgcgcaaatttctgactcacaaaactgtagacgatacaattgggttgttgtttgggggcagtttgttatgctgtagcaataaatagccag

SEQ ID NO: 18688 - DNA, 503 bp, Homo sapiens
gtagctgaggcccacggtttggagttaggtccctgcaccgccacctactatgaccctggtacatggcccctcattctccttagcctagacctggggcctcttgatctcaagaaggccagcacacagatgggtcggtatagacccatcttccctctgggagtgaccctcagcacaggccctgcagaggaggccttgctgtgacacccccgcagtgaaggcttggacaagtaatcagcacagtgcctcttacgtcatcgcctccaaaacctcagagcccagcatgcactggagacccggccctgccctgtgggtgctcccggaagcaggggatgcaggagccctcccacacctcctccttacctgccggagtgaagcggtcaggaggagggccggcggcttctctccttgttcagagcccgggcacagagccctagaggtgcattccaggtgcctagatgtccactcactgcctgtgaagccccgaagccactgggtcattggta

SEQ ID NO: 18689 - DNA, 399 bp, Homo sapiens
  misc_feature 288,375: n=a, g, c or t
aagaaaaggaccatccgttcatccaagatcatctcacctcccatgaagggaacggtcttctaaatgcagttttccttccagcagggtggatggggagcatcgctggctgacaggctggtcagaaaatgtgatgttctgratcgtggattttcaggttacaataccaggtgggccaaaattatccttccaagattaatcaggaaaggaaacagtttggacatcccagtagcagttacaattttctttggggccaatgacagtgcactaaaagatgagaatcccaagcancacattcccctggaggagtacgctgcgaacctaaagagcatggtgcagtacctgaagtccgttgacatccctgagaatcgagtcatnctcatcacgccgaccccactttgt

SEQ ID NO: 18690 - DNA, 368 bp, Homo sapiens
aagtcgcacctggagctgtcctagcgcctagttctctcccggccgcagagctggccgcccagggggagtcgcagagtttggaagaactctctaacacctctcggccaacttcagaagtgtataagatcagctttatctttccaaatggagacaagtatgatggtgactgtacaagaacatcttctggaatctacgagagaaatggaataggtattcataccactcctaatgggattgtctacacaggaagctggaaagatgacaagatgaatggttttggaagacttgagcatttttcaggagcagtatatgaakgacaatttaaggataatatgtttcatggacttgggacttacacattcccaaat

SEQ ID NO: 18691 - DNA, 70 bp, Homo sapiens
acccactggctgctctgaaaagccatcttkcacattgttcctcatccgcctccttgctcgccgtaaccac

SEQ ID NO: 18692 - DNA, 373 bp, Homo sapiens
agcaaccaagtcgcacctggagctgtcctagcgcctagttctctcccggccgcagagctggccgcccagggggagtcgcagagtttggaagatctctctaacacctctcggccaacttcagaagtgtataagatcagctttatctttccaaatggagacaagtatgatggtgactgtacaagaacatcttctggaatctacgagagaaatggaataggtattcataccactcctaatgggattgtctacacaggaagctggaaagatgacaagatgaatggttttggaagacttgagcatttttcaggagcagtatatgaaggacaatttaaggataatatgtttcatggactggggacttacacattcccaa

SEQ ID NO: 18693 - DNA, 355 bp, Homo sapiens
  misc_feature 73: n=a, g, c or t
actgggctgctctgaaaagccatttttgcattgttcctcatccgcctccttgcccgccgcagtcgcctccgcngcgcgcctmctccgccgccgcgactccggcagctttatcgccagagtccctgaactctcgctgttctttttaatcccctgcatcggatcaccggcgtgccccaccatgtcagacgcagccgtagacaccagctccgaaatcaccaccaaggacttaaaggagaagaaggaagttgtggaagaggcagaaaatggaagagacgcccctgctaacgggaatgctaatgaggaaaatggggagcaggaggctgacaatgaggtagacgaagaagaggaagaaggt

SEQ ID NO: 18694 - DNA, 337 bp, Homo sapiens
  misc_feature 236,268: n=a, g, c or t
actggctgctctgaaaagccatctttgcattgttcctcatccgcctccttgctcgcsgcagccgcctccgccgcgcgcctcctccgccgccgcgactccggcagctttatcgccagagtccctgaactctcgctttctttttaatcccctgcatcggatcaccggcgtgccccaccatgtcagacgcagccgtagacaccagctccgaaatcaccaccaaggacttaaaggagaanaaggaagttgtggaagaggcagaaaatggaanakacgcccctgctaacgggaatgctaatgaggaaaatggggatcaggaggctgacaatgaggtagacga

SEQ ID NO: 18695 - DNA, 81 bp, Homo sapiens
ccccactggctgctctgaaaagccatctttgcattgttcctcatccgcctccttgctcgccgcagcckcctccgccgcggm

SEQ ID NO: 18696 - DNA, 161 bp, Homo sapiens
actggctgctctgaaaagccatctttgcattgttcctcatccgcctccttgcccgccgcagtcgcctccgccgcgscctcctccgccgccgcgaactccggcagctttatcgccagagtccctgaactctcgctttctttttarkcccctgcatcggatca

SEQ ID NO: 18697 - DNA, 302 bp, Homo sapiens
  misc_feature 40: n=a, g, c or t
attgttcctcatccgcctccttgctcgccgcagccgcctncgccgcgcgvctcctccgccgccgcgactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaagttgtggaagaggcagaaaatggaagagacgcccctgctaaacgggaatgctaatgaggaaaatggggagcaggaggctgacaatgag

SEQ ID NO: 18698 - DNA, 51 bp, Homo sapiens
ctggctgctctgaaaagccatctttgcattgttcctcatcctccttgctcg

SEQ ID NO: 18699 - DNA, 79 bp, Homo sapiens
ccactggctgctctgaaaagccatctttgcattgttcctcatccgcctccttgctcgccgcagccgcctccgccgcgcg

SEQ ID NO: 18700 - DNA, 242 bp, Homo sapiens
attttatggttttgatttcagattgcaaacatgtaaaacctgcatagcagcgagtcctcggttttgccggtttctttagttctttactgtcactgtcatgtaatcagctaattctctgtggatgttgctgtaaagtatgcatgttcctttcatgtgtatttaatcatgatgtttaattttgcacacttatttgtaatgtttcttttaaataaaagtgactaattttgttgtaaaaaaaaaaa

SEQ ID NO: 18701 - DNA, 393 bp, Homo sapiens
  misc_feature 171: n=a, g, c or t
tytggctgctctgaaaagccatctttgcattgttcctcatccgcctccttgctcgcygcagccgcctccgccgcgygcctcctscgssygccgcgactccgcagctttatcgccagagtccctgaactctcgctttctttttaatcccctgcatcggatcaccggcgtgcnccaccatgtcagacgcagccgtagacaccagctccgaaatcaccaccaaggacttaagggaggaagaggaggaggaagaagaaggtgatggtgaggdagaggatggagatgaagatgaggaagctgagtcagctacgggcaagcbggcagctgaagatgatgaggatgacgatgtcgataccaagrwgcagaagaccgacgargatgactagacagcataar

SEQ ID NO: 18702 - DNA, 71 bp, Homo sapiens
actggctgctctgaaaagccatctttgcattgttcctcatccgcctccttgctcgccgcagccgcctccgc

SEQ ID NO: 18703 - DNA, 69 bp, Homo sapiens
atctggctgctctgaaaagccatctttgcattgttcctcatccgcctccttgctcgccgcagccgcctc

SEQ ID NO: 18704 - DNA, 476 bp, Homo sapiens
  misc_feature 81: n=a, g, c or t
actggctgctctgaaaagccatctttgcattgttcctcatccgcctccttgctcgcsgcagccgcctccgcsgcgcgcctndtccaccgccgcggactccggcagctttatcgccagagtccctgaactctcgctttctttttaatcccctgcatcggatcaccggcgtgccccascatgtcagacgcagccgtagacaccagctccgaaatcaccaccaaggacaaaggagaagaaggaagttgtggaagaggcagaaaatggaagagacgccccggctaacgggaatgctaatgaggaaaatggggagcaggaggctgacaatgaggtagacgaagaagaggaagaaggtggggaggaagaggaggaggaagaagaaggtgatggtgaggaagaggatggagatgaagatgaggaagctgagtcagctacgggcaagcgggcagctgaagatgatgaggatgacgatgtcgata

SEQ ID NO: 18705 - DNA, 61 bp, Homo sapiens
cccccactggctgctctgaaaagccatctttgcattgttcctcatccgcctccttgctcgc

SEQ ID NO: 18706 - DNA, 525 bp, Homo sapiens
gttttctgcgcttccttctccctctctccagacgtcgtggtcgttcggtcctatgtcgcgccgggccctccggaagctgaagggggraacagcgcgggccaggagcccctcgggcccggcgccttgcatttcgatctccgtgatgacgatgacgcggaagaagaagggcccaagcgggagcttggtgtccggcgtcccgggggcgaagggaaggagggcgtccgagtcaacaaccgcttcgagctgataaacattgacgatcttgaggatgaccctgtggtgaacggggagaggtctggctgtgcgctcacagacgctgtgggrkaaagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcggaaaacggactagaagatatcgatcgcatcctagagaggat

SEQ ID NO: 18707 - DNA, 203 bp, Homo sapiens
  misc_feature 81..82: n=a, g, c or t
tctggctgctctgaaaagccatctttgcattgttcctcatccgcctccttgctcgccgcagccgcctccgccgcgcgccknntccgccgccgcgactccggcagctttatcgccagagtccctgaactctcgctttctttttaatcccctgcatcggatcaccggcgtgccccaccatgtcagacgcagccgtagacaccagc

SEQ ID NO: 18708 - DNA, 67 bp, Homo sapiens
tctggctgctctgaaaagccatctttgcattgttcctcatccgcctccttgctcgccgcagccgcct

SEQ ID NO: 18709 - DNA, 487 bp, Homo sapiens
  misc_feature 80..81,298: n=a, g, c or t
actggctgctctgaaaagccatctttgcattgttcctcatccgcctccttgctcgccgcagccgcctcggccgcgsgccnntccgccgccgcgactccggcagctttatcgccagagtccctgaactctcgctttctttttaatcccctgcatcggatcaccggcgtgccccacmatgtcagacgcagccgtagacaccagctccgaaatcaccaccaaggacttaaaggagaagaaggaagttgtggaagaggcagaaaatggaagagacgcccctgctaacgggaatgctaatganggaaaatggggagcaggaggctgacaatgaggtagacgaagaagaggaagaaggtggggaggaagaggmggaggaacgaagaaggtgatggtgaggaagaggatggagatgaagatgaggaagctgagtcagctacggggcaagccgggcagctgaagatgatgaggatgacgatgtcgataccaagaa

SEQ ID NO: 18710 - DNA, 236 bp, Homo sapiens
  misc_feature 82: n=a, g, c or t
actggctgctctgaaaagccatctttgcattgttcctcatccgcctccttgctcgccgcagccgcctccgccgcgcgcctyntccgccgccgcgactccggcagctttatcgccagagtccctgaactctcgctsttctttttaatccccctgcatcggatcaccggcgtgcsccamcatgtcagacgcagcsgtagacaccagctccgaaatcaccaccaaggactyaaaggaga

SEQ ID NO: 18711 - DNA, 427 bp, Homo sapiens
  misc_feature 72,215,229: n=a, g, c or t
actggctgctctgaaaagccatctttgcattgttcctcatccgcctccttgcccgccgcagtcgcctccgsngcgcgcctmmtccgccgccgcgactccggcagctttatcgccagagtccctgaactctcgctttctttttaatcccctgcatcggatcaccggcgtgccccaccatgtcagacgcagscgtagacaccagctccgaaatcaynaccaaggacttaankvgagaagaaggaagttgtggaagaggcagaaaatggaagagacgcccctgctaacgggaatgctaatgaggaaaatggggagcaggaggctgacaatgaggtagacgaagaagaggaagaaggtggggaggaagaggaggaggaagaagaaggtgatggtgaggaagaggatggagatgaagatgaggagctgagtc

SEQ ID NO: 18712 - DNA, 68 bp, Homo sapiens
tctggctgctctgaaaagccatctttgcattgttcctcatccgcctccttgctcgccgcagccgcctc

SEQ ID NO: 18713 - DNA, 62 bp, Homo sapiens
cccccactggctgctctgbaaaagccatctttgcattgttcctcatccgcctccttgctcgc

SEQ ID NO: 18714 - DNA, 67 bp, Homo sapiens
actggctgctctgaaaagccatctttgcattgttcctcatccgcctccttgctcgccgcagccgcct

SEQ ID NO: 18715 - DNA, 204 bp, Homo sapiens
  misc_feature 185: n=a, g, c or t
actggctgctctgaaaagccatctttgcattgttcctcatccgcstccttgcscgcsgcagtcgcctccgccgcgcgcctcctccgccgccgcgactccggcagctttatcgccagagtccctgaactctcgctttctttttaatcccctgcatcggatsaccggcgtgccccaccatgtcagangcagcsgtagacaccagct

SEQ ID NO: 18716 - DNA, 314 bp, Homo sapiens
  misc_feature 85: n=a, g, c or t
ccccactggctgctctgaaaagccatctttgcattgttcctcatccgcctccttgctcgcsgcagccgcctccgccgcgcgcctnvtccgccgccgcgactccggcagctttatcgccagagtccctgaactctcgstttctttttaatcccctgcatcggatcaccggcgtgccccaccatgtcagacgcagccgtagacaccagctccgaaatcaccaccaasgacttaaaggagaagaaggaasttgtggaggcagaaaatggaagagacgcccctgctaacgggaatgctaatgaggaaaatggggagca

SEQ ID NO: 18717 - DNA, 337 bp, Homo sapiens
  misc_feature 82: n=a, g, c or t
actggctgctctgaaaagccatctttgcattgttcctcatccgcctccttgctcgccgcagccgcctccgcsgcgcgccttntccgccgccgcgactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaagttgtggaagaggcagaaaatggaagagacgcccctgctaacgggaatgctaatgaggaaaatggggagcaggaggctgacaatgaggtagacga

SEQ ID NO: 18718 - DNA, 62 bp, Homo sapiens
  misc_feature 19: n=a, g, c or t
ccccactggctgctctdrnaagccatcttttcattgttcctcacccgcctccttgctcgcsg

SEQ ID NO: 18719 - DNA, 69 bp, Homo sapiens
ccccactggctgctctgaaaagccatctttgcattgttcctcatccgcctccttgctcgcsgcagccgc

SEQ ID NO: 18720 - DNA, 235 bp, Homo sapiens
cccccactggctgctctgaaaagccatctttgcattgytcctcatccgcctccttgctcgccgyagccgmctccgccgcgcgcctcctccgccgccgcggactmcggcagctttatcghcagagtccctgaactctcgctttctttwkaatcccctgcatmggatcaccggcgtgccccaccatgtcagacgcadccgymkacaccagctscgaaatcaccaccaaggacttaaa

SEQ ID NO: 18721 - DNA, 341 bp, Homo sapiens
agtggtttgcgttttcaagatggcgactccctatgttactgacgagaccggcggggtgggaacgccaaacctctcccttctttttgacttcacccttggataccatcaaggccagaggatggaaccaagataacataaaataggtgctcctttgtgataatgggctatttgtatctctgagggcttccacacaggatggccattcaagaagcttctgctctgcctttcattacagtctatctttagtcctcctaaaccttcagctataatctctatgcaatcaacttaaatatatgtttgtagtattgtccctttctcccaaattccatgtaaaacacttg

SEQ ID NO: 18722 - DNA, 203 bp, Homo sapiens
tctggctgctctgaaaagccatctttgcattgttcctcatccgcctccttgctcgccgcagccgcctccgscgcgcgccthhtccgccgccgcgactccggcagctttatcgccagagtccctgaactctcgctttctttttaatcccctgcatcggatcaccggcgtgccccaccatgtcagacgcagccgtagacaccagc

SEQ ID NO: 18723 - DNA, 67 bp, Homo sapiens; identical to SEQ ID NO: 18714

SEQ ID NO: 18724 - DNA, 202 bp, Homo sapiens
  misc_feature 81: n=a, g, c or t
tctggctgctctgaaaagccatctttgcattgttcctcatccgcctccttgctcgccgcagccgcctccgccgcgcgcctntccgccgccgcgactccggcagctttatcgccagagtccctgaactctcgctttctttttaatcccctgcatcggatcaccggcgtgccccaccatgtcagacgcagccgtagacaccagc

SEQ ID NO: 18725 - DNA, 260 bp, Homo sapiens
tctggctgctctgaaaagccatctttgcattgttcctcatccgcctccttgctcgcsgcagccgcctssgcsgcgcgsstcctccgccgccgcgactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaagttgtggaagaggcagaa

SEQ ID NO: 18726 - DNA, 486 bp, Homo sapiens
  misc_feature 174,193: n=a, g, c or t
agatggcgactccctatgttactgacgagaccggcggcaagtatatcgcgtcaacacagcgacctgacgggacctggcgcaasagcggagggtgaaagaaggatatgtgccccaggaggaggtcccagtatatgawaacaagtatgtgaagtttttcaagagtaaaccagagtngcccccagggctaavcmtnaggccactgacwcctgtmaccccatccaggcctgaaggtggtgaaccaggcctctccaagacagccaaacgtaacctgaagcgaaaggagaagaggcggcagcagcaagagaaaggagaggcagaggccttgagcaggactcttgataaggtgtccctggaagagacagcccaactccccagtgctccacagggctctcgggcagcccccacagctgcatctgaccagcctgactcagctgccaccactgagaaagccaagaagataaagaacctaaagaagaaactccggca

SEQ ID NO: 18727 - DNA, 210 bp, Homo sapiens
ccccactggctgctctgaaaagccatctttgcattgttcctcatccgcctccttgcccgccgcagtcgcctccgccgcgcgcctcctccgccgccgcgactccggcagctttatcgccagagtccctgaactctcgctttctttttaatcccctgcatcggatcaccggcgtgccccaccatgtcagacgcagccgtagacaccagctcc

SEQ ID NO: 18728 - DNA, 361 bp, Homo sapiens
actggctgctctgaaaagccatctttgcattgttcctcatccgcctccttgcccgccgcagtcgcctccgccgcgcgcctcctccgccgccgcgaactccggcagctttatcgccagagtccctgaactctcgctttctttttaatcccctgcatcggatcaccggcgtgcccacaccatgtcagacgcagccgtagacaccagctccgaaatcaccaccaaggacttaaaggagaagaaggaagttgtggaagaggcagaaaatggaagagacgcccctgctaacgggaatgctaatgaggaaaatggggagcaggaggctgacaatgaggtagacgaagaagaggaagaaggtggggag

SEQ ID NO: 18729 - DNA, 67 bp, Homo sapiens
cactggctgctctgaaaagccatctttgcattgttcctcatccgcctccttgctcgccgcagccgcc

SEQ ID NO: 18730 - DNA, 63 bp, Homo sapiens
  misc_feature 13: n=a, g, c or t
stggstgctctgnaaagccatctttgcattgttcctcatscgsctccttgctcgccgcagccg

SEQ ID NO: 18731 - DNA, 403 bp, Homo sapiens
actggctgctctgaaaagccatctttgcattgttcctcatccgcctccttgctcgccgcagccgcctccgccgcgcgcctcctccaccgccgcggactccggcagctttatcgccagagtccctgaactctcgctttctttttaatcccctgcatcggatcaccggcgtgccccaccatgtcagacgcagccgtagacaccagctccgaaatcaccaccaaggacaaaggagaagaaggaagttgtggaagaggcagaaaatggaagagacgccccggctaacgggaatgctaatgaggaaaatggggagcaggaggctgacaatgaggtagacgaagaagaggaagaaggtggggaggaagaggaggaggaagaagaaggtgatggtgaggaagaggatgga

SEQ ID NO: 18732 - DNA, 70 bp, Homo sapiens
tctggctgctctgaaaagccatctttgcattgttcctcatccgcctccttgctcgccgcagccgcctcsg

SEQ ID NO: 18733 - DNA, 63 bp, Homo sapiens
  misc_feature 18..19: n=a, g, c or t
cccccastggstgctctnnaaagccatctttgcattgttcctcatccgcctccttgcccgccg

SEQ ID NO: 18734 - DNA, 70 bp, Homo sapiens
actggctgctctgaaaagccatctttgcattgttcctcatccgcctccttgctcgcsgcagccgcctcyg

SEQ ID NO: 18735 - DNA, 374 bp, Homo sapiens
attttggagcaaaaccattcaaatacccaccatctatgaaatttagcacttttaatgactacgccttcctaacagctgaagaaaaaatcattttgccaaggcacaggcgtcttgctctgttgaagcaagtcagtatccgagaaaactgctgttccctttgttgtgatgaggtagcagacacacaattgaagccatgtggacacagtgacctgtgcatggattgtgccttgcagctggagacctgcccattgtgtcgtaaagaaatagtatctagaatcagacagatttctcatatttcatgacacatgtgaagaggcatcgtggacttttttctactcaattccagccaatgttgaaaaaaaaaaaaaaaaagg

SEQ ID NO: 18736 - DNA, 384 bp, Homo sapiens
  misc_feature 72,235..237,263..264: n=a, g, c or t
ccccactggctgctctgaaaagccatctttgcattgttcctcatccgcctccttgctcgccgcagccgcctncgccgcgcrmctcctccgccgccgcggactccggcagctttatcgccagagtccctgaactctcgctttctttttaatcccctgcatcggatcaccgggcgtgccccaccatgtcagacgcagccgtagacaccagctccgaaatcaccaccaaggacttavnnnmgaagaaggaagttgtggaggcagmnnatggaagagacgcccctgctaacgggaatgctaatgaggaaaatggggagcaggaggctgacaatgaggtagacgaagaagaggaagaaggtggggaggaagaggaggaggaagaagaag

SEQ ID NO: 18737 - DNA, 313 bp, Homo sapiens
actggctgctctgaaaagccatctttgcattgttcctcatccgcctccttgctcgccgcagccgcctmmgccgcgcgcctcctccgccgccgsgactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaagttgtggaagaggcagaaaatggaagagacgcccctgctaacgggaatgctaatgaggaaaatggggagca

SEQ ID NO: 18738 - DNA, 253 bp, Homo sapiens
actggctgctctgaaaagccatctttgcattgttcctcatccgcctccttgctcgccgcagccgcctccgccgcgcgcctcctccgccgccgcgactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaagttgtggaaga

SEQ ID NO: 18739 - DNA, 68 bp, Homo sapiens
actggctgctctgaaaagccatctttgcattgttcctcatccgcctccttgctcgccgcagccgcctc

SEQ ID NO: 18740 - DNA, 406 bp, Homo sapiens
attttggagcaaaaccattcaaatacccaccatctatgaaatttagcacttttaatgactacgccttcctaacagctgaagaaaaaatcattttgccaaggcacaggcgtcttgctctgttgaagcaagtcagtatccgagaaaactgctgttccctttgttgtgatgaggtagcagacacacaattgaagccatgtggacacagtgacctgtgcatggattgtgccttgcagctggagacctgccccattgtgtcktaaagaaatagtatctagaatcagacagatttctcatgaaatatgagaaatctgtctgattctagatactatttctttatttcatgacacatgtgaagaggcatcgtggacttttttctactcaattccagccaatgttgaaaaaaaaa

SEQ ID NO: 18741 - DNA, 253 bp, Homo sapiens; identical to SEQ ID NO: 18738

SEQ ID NO: 18742 - DNA, 63 bp, Homo sapiens
cccccactggctgctctgaaaagccatctttgcattgttcctcatccgsctccttgctcgccg

SEQ ID NO: 18743 - DNA, 255 bp, Homo sapiens
attttatggttttgatttcagattgcaaacatgtaaaacctgcatagcagcgagtcctcggttttgccggtttctttagttctttactgtcactgtcatgtaatcagctaattctctgtggatgttgctgtaaagtatgcatgttcctttcatgtgtatttaatcatgatgtttaattttgcacacttatttgtaatgtttcttttaaataaaagtgactaattttgttgtaaaaaaaaaaaaaaaaaaaaaaaa

SEQ ID NO: 18744 - DNA, 331 bp, Homo sapiens
actggctgctctgaaaagccatctttgcattgttcctcatccgcctccttgctcgccgcagccgcctccgccgcgcgcctcctccgccgcccgcggactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaagttgtggaagaggcagaaaatggaagagacgcccctgctaacgggaatgctaatgaggaaaatggggagcaggaggctgacaatgag

SEQ ID NO: 18745 - DNA, 289 bp, Homo sapiens
ccccactggctgctctgaaaagccatctttgcattgttcctcatccgcctccttgctcgccgcagccgcctccgccgcgcgcctcctccgccgccgcggactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaagttgtggaggcagaaaatggaagagacgcccctgctaacggg

SEQ ID NO: 18746 - DNA, 202 bp, Homo sapiens
  misc_feature 81: n=a, g, c or t
tctggctgctctgaaaagccatctttgcattgttcctcatccgcctccttgctcgccgcagccgcctccgccgcgcgcckntccgccgccgcgactccggcagctttatcgccagagtccctgaactctcgctttctttttaatcccctgcatcggatcaccggcgtgccccaccatgtcagacgcagccgtagacaccagc

SEQ ID NO: 18747 - DNA, 51 bp, Homo sapiens
  misc_feature 38: n=a, g, c or t
actggctgstctgaaaagccatctttgcattgttcmtnatmcgcctccttg

SEQ ID NO: 18748 - DNA, 64 bp, Homo sapiens
actggctgctctgaaaagccatctttgcattgttcctcatccgcctccttgctcgccgsagccg

SEQ ID NO: 18749 - DNA, 431 bp, Homo sapiens
agttgatgcagtttcttcatagcgtcgatggtcttcacaatttggtatgtttttgcagtggctggtacttgtttttcctttccgtatttagtgcttccttgaggagctcttgtaaggcaggcctggtggtgacaaaatctctcagcatttgcttatctgtaaaggattttattgctccttcacttatgaagcttagtttggctggagatgaaattctaggttaaaaattcttttattcccactggctgctctgaaaagccatctttgcattgttcctcgtccgcctccttgctcgcggcacctccttgctcgcggcasctccttgctcgccgcagccgcctccgccacgcgcctcctccgccgccgcgmctccggcagctttatcgccagagtccctgaactctcgctttctttttaatcgcctgcatcgg

SEQ ID NO: 18750 - DNA, 247 bp, Homo sapiens
  misc_feature 68,77: n=a, g, c or t
actggctgctctgaaaagccatctttgcattgttcctcatccgcctccttgctcgccgsagccgsggnsgssgcggnstcctccgccgccgcgactccggcagctttatcgccagagtccctgaactctcgctttctttttaatcccctgcatcggatcaccggcgtgccccaccatgtcagacgcagccgtagacaccagctccgaaatcaccaccaagtacttaaaggagaagaaggaagttgtk

SEQ ID NO: 18751 - DNA, 68 bp, Homo sapiens; identical to SEQ ID NO: 18739

SEQ ID NO: 18752 - DNA, 365 bp, Homo sapiens
atttgcaaccttsgccatctgtccagaacctgctcccacctcaggcccaggccaaccgtgcactgctgcaatgggctctgagctggagacggcgatggagaccctcatcaacgtrttccagcccactcgggcaaagagggggacaagtacaagctgagaaagarggagctgmaagagmtgctgcagacggagctctctggsttcctggatgtgaagagcttatgctgtaggcaacagaagccctcaagacttttgaggaggcctagaagagtccsataattcaatgcagttcctctcgctcatctttgcctcctgstcctcaaccacccccttgcmtctgactcagtgctgtacccttccctata

SEQ ID NO: 18753 - DNA, 50 bp, Homo sapiens
tctggctgctctgaaaascsatctttgsattgttcctcatccgcctcctt

SEQ ID NO: 18754 - DNA, 319 bp, Homo sapiens
tctgggtgctctgaaaagccatctttgcattgttcctcatccgcctccttgctcgccgcagccgcctccgccgcgcgcctcctccgccgccgcggactccggcagctttattcgscagagtccctgaactctcgctttctttttaatcccctgcatcggatcaccggcgtgccccaccatgtcagacgcagccgtagacacsagctccgaaatcaccaccaaggacttaaaggagaagaaggaagttgtggaagaggcagaaaatggaagagacgcccctgctaacgggaatgctaatgaggaaaatggggagcaggag

SEQ ID NO: 18755 - DNA, 64 bp, Homo sapiens
actggctgctctgaaaagccatctttgcattgttcctcatccgcctccttgctcgccgcagccg

SEQ ID NO: 18756 - DNA, 386 bp, Homo sapiens
aatcccctcgaccgctcgcgtcgcatttggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggtgaaaataaatagggaagatggagacaccctctggggtcctctctgagtcaaatccagtggtgggtaattgtacaataaattttttttggtcaaattcaaaaaaaaaaaaaaaaaa

SEQ ID NO: 18757 - DNA, 464 bp, Homo sapiens
  misc_feature 173,258: n=a, g, c or t
actggctgctctgaaaagccatctttgcattgttcctcatccgcctccttgctcgccgcagccgcctccgccgcgcgcctcctccgccgccgcggactccggcagctttatcgccagagtccctgaactctcgctttctttttaatcccctgcatcggatcaccggcgtgchncaccatgtcagacgcagccgtagacaccagctycggraattmacaaccarggmcttaaaggagaagaaggaagttgtggaaaayncagaaaatggaagagacgcccctgctaacgggaatgctaatgaggaaaatggggagcaggaggctgacaatgaggtagacgaagaagaggaagaaggtggggaggaagaggaggaggaagaagaaggtgatggtgaggaagaggatggagatgaagatgaggaagctgagtcagctacgggcaagcgggcagctgaagatgatgag

SEQ ID NO: 18758 - DNA, 219 bp, Homo sapiens
actggctgctctgaaaagccatctttgcattgttcctcatccgcctccttgcccgccgcagtsgcctccgcsgcgcgcctcctccgccgccgsgactccggcagctttatcgccagagtccctgaactctcgctttctttttaatcccctgcatcggatcaccggcgtgccccaccatgtcagacgcagccgtagacaccagctccgaaatcaccacca

SEQ ID NO: 18759 - DNA, 426 bp, Homo sapiens
atataaggccagtmggactgcgacacarcmcatcccctcgaccgctcgcgtcgcatttggccgcctccctaccgctccaagcccagccctcagccatggcatgccccctggatcaggccattggctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggacctttttgatctacaatgaagccctcaagggctgawaaataaatagggaagatggagacaccctctggggtcctctctgagtcaaatccagtggtgggtaattgtacaataaattttttttggtcaaatctaaaaaaaaaaaaaaaaaag

SEQ ID NO: 18760 - DNA, 461 bp, Homo sapiens
cccactggstgctctgaaaagccatctttgcattgttcctcatccgcctccttgctcgccgcagccgcctccgccgctcgcctcctmcgccgccgcgactccggcagctttatcgcmcagartccctgaactctcgctttctttttaatcccctgcatcggatcaccggcgtgccccascatrtcagacgcagccgtaraacaccagctccgaaatcaccaccaaggacttaaaggagaagaatgaagttgtggaagaggcagaaaatggaagagacgcccctgctaacgggaatgctaatgaggaaaatggggagcaggaggctgacaatgaggtagacgaagaagaggaagaaggtggggaggaagaggaggaggaagaagaaggtcgatgstgaggaagaggatggagatgaagatgaggaagctgagtcagctacgggcaagcgggcagctgaagat

SEQ ID NO: 18761 - DNA, 70 bp, Homo sapiens
actggctgctctgaaaagccatctttgcattgttcctcatccgcctccttgctcgcsgcagccgcctcsg

SEQ ID NO: 18762 - DNA, 487 bp, Homo sapiens
actggctgctctgaaaagccatctttgcattgttcctcatccgcctccttgcccgccgcagtcgcctccgccgcgcgcctcctccgccgccgcgactccggcagctttatcgccagagtccctgaactctcgctttctttttaatcccctgcatcggatcaccggcgtgccccaccatgtcagacgcagccgtagacaccagctccgaaatcacsaccaaggacttaaaggagaagaaggaagttgtaggaagaggcagaaaatggaagagacgcccctgctaacgggaatgctgagaatgaggaaaatggggagcaggaggctgacaatgaggtagacgaagaagaggaagaaggtggggaggaagaggaggaggaagaagaaggtsgatggtsaggaagaggatggagatgaagatgaggaagctgagtcagctacgggcaagcgggcagctgaagatgatgaggatgacgatgtcgataccaag

SEQ ID NO: 18763 - DNA, 405 bp, Homo sapiens
atcccctcgaccgctcgcgtcgcattttggccgcctccctaccggccctctgctgccagctccaagcccagccctcagccatggcatgccccctggatcaggccattggctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatc

SEQ ID NO: 18764 - DNA, 359 bp, Homo sapiens
tctggctgctctgaaaagccatctttgcattgttcctcatccgcctccttgctcgccgcagccgcctccgssgcgcgcctsctccgccgccgcgactccggcagctttatcgccagagtccctgaactctcgctttctttttaatcccctgcatcggatcaccggcgtgccccadvcatgtcagacgcagccgtagacaccagctccgaaatcaccaccaaggacttaaaggagaagaaggaagttgtggaagaggcagaaaatggaagagacgcccctgctaacgggaatgctaatgaggaaaaatggggagcaggaggctgacaatgaggtagacgagaagaggaagaaggtgggga

SEQ ID NO: 18765 - DNA, 376 bp, Homo sapiens
  misc_feature 175,256..257,284..285: n=a, g, c or t
ccccactggctgctctgaaaagccatctttgcattgttcctcatccgcctccttgctcgcmgcagccgcctccgccgcgcgcctcctccgccgccgcggactccggcagcwttatcgccagagtccctgaactctcgctttctttttaatcccctgcatcggatcaccggcgtgnhccaccatgtcagacgcagccgtagacaccagctccgaaatcaccaccaaggacttaaaggagaagaaggaagttgtgganncagaaaatggaagagacgccctgcybnnygggaatgctaatgaggaaaatggggagcaggaggctgacaatgaggtagacgaagaagaggaagaaggtggggaggaagaggaggaggaa

SEQ ID NO: 18766 - DNA, 414 bp, Homo sapiens
atcccctcgaccgctcgcgtcgcatttggccgcctccctaccgctccaagcccagccctcagccatggcatgccccctggatcaggccattggctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctggggtcctctctgagtcaaatccagtggtgggtaattgtacataaatt

SEQ ID NO: 18767 - DNA, 64 bp, Homo sapiens; identical to SEQ ID NO: 18755

SEQ ID NO: 18768 - DNA, 68 bp, Homo sapiens
actggctgctctgaaaagccatctttgcattgttcctcatccgcctccttgctcgccgsagccgcctc

SEQ ID NO: 18769 - DNA, 404 bp, Homo sapiens
ccccactggctgctctgaaaagccatctttgcattgttcctcatccgcctccttgcccgccgcagtcgcctccgccgcgcgcctcctccgccgccgcggactccggcagctttatcgccagagtccctgaactctcgctttctttttaatcccctgcatcggatcaccggcgtgccccaccatgtcagacgcagcagacaccagctccgaaatcaaccaccaaggacttaaaggagaagaaggaagttgtggaagaggcagaaaatggaagagacgcccctgctaacgggaatgctgagaatgaggaaaatggggagcaggaggctgacaatgaggtagacgaagaagaggaagaaggtggggaggaagaggaggaggaagaagaatgtgatggtgaggaagaa

SEQ ID NO: 18770 - DNA, 59 bp, Homo sapiens
gaaaaaaaagccatctttgcattgttcctcatccgcctccttgctcgccgsagccgcct

SEQ ID NO: 18771 - DNA, 362 bp, Homo sapiens
  misc_feature 111,175,263: n=a, g, c or t
ccccactggctgctctgaaaagccatctttgcattgttcctcatccgcctccttgctcgccgcagccgsctccggcgcgsgcctcctccgccgccgcggactccggcagcnttatcgccagagtccctgaactctcgctttctttttaatcccctgcatcggatcaccggcgtgncccaccatgtcagacgcagccgtagacaccagctccgaaatcaccaccaaggacttaaaggagaagaaggaagttgtgvaggcavkwntmtggaagagacgcccctgctaacgggaatgctaatgaggaaaatggggagcaggaggctgacaatgaggtagacgaagaagaggaagaaggtggggag

SEQ ID NO: 18772 - DNA, 521 bp, Homo sapiens
cccactggctgctctgaaaagccatctttgcattgttcctcatccgcctccttgctcgccgcagccgcctccgccgcgcgcctcttccgccgccgcgactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaagttgtggaagaggcagaaaaagggaagacgcccctgctaacgggaatgctgagaatgaggaaaatggggagcaggaggctgacaatgaggtagacgaagaagaggaagaaggtggggaggaagaggaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactagacagcaa

SEQ ID NO: 18773 - DNA, 457 bp, Homo sapiens
aatcccctcgaccgctcgcgtcgcatttggccgcctccctaccgctccaagcccagccctcagccatggcatgccccctggatcaggccattggctcctcgtggccatcttccacaagtactccggcagggagggtgacaagcacaccctgagcaagaaggagctgaaggagctgatccagggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaatttaaaaaaaaaaaaaaaaargcttttyc

SEQ ID NO: 18774 - DNA, 339 bp, Homo sapiens
  misc_feature 81,180..181: n=a, g, c or t
cccccactggctgctctgataaagccatctttgcattgttcctcatccgcctccttgctcgccgcagccgsctycggcgsngbgccttcctccgccgccgcggactccggcagctttatcgccagagtccctgaactctcgctttctttttaatcccctgcatcggatcaccggcgtgcnncaccatgtcagacgcagccgtagacaccagctccgaaatcaccaccaaggacttaaaggagaagaaggaagttgtggaagaggcagaaaatggaagagacgcccctgctaacgggaatgctaatgaggaaaatggggagcaggaggctgacaatgagr

SEQ ID NO: 18775 - DNA, 71 bp, Homo sapiens
ccccactggctgctctgaaaagccatctttgcattgttcctcatccgcstccttgctcgcsgcagccgcct

SEQ ID NO: 18776 - DNA, 63 bp, Homo sapiens
cccccactggctgctctgaaaagccatctttgcattgttcctcatccgcctccttgctcgccg

SEQ ID NO: 18777 - DNA, 390 bp, Homo sapiens
tctggctgctctgaaaagccatctttgcattgttcctcatccgcctccttgctcgccgcagccgcctccgccgcgcgcstycctccgccgccgcgactccgcagctttatcgccagagtccctgaactctcgctttctttttaatcccctgcatcggatcaccggcgtgccccaccatgtcagacgcagccgtagacaccagctccgaaatcaccaccaaggacttaagggaggaagaggaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactagacagcaa

SEQ ID NO: 18778 - DNA, 253 bp, Homo sapiens
actggctgctctgaaaagccatctttgcattgttcctcatccgcctccttgctcgcsgcagccgcctccgccgcgcgcctcctccgccgccgcgactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaagttgtggaaga

SEQ ID NO: 18779 - DNA, 390 bp, Homo sapiens
tcgaatcattgagttctttttaagggtctccccgattctctcaacttcaggcttttttctggccagtgccctggaaactataagcaatagtaaacgatccagggaggaatcccctgcgaaggaagcccagtggggctttgggacactagcacgtgtgagtaatcatacccagtgttgtatgaagtgtcttctcatacactggcatcccaggaagacagacggatggaacggatgttcttacttcatggaataaaagttttgctgactgcctgaggaaagctgagagcagggaatgaggtgccccggtgtggagggtcagggggagaatgtactcggggtgggtgctgacaggcaagaaggaggggactcctgttgagtagtaagtagctg

SEQ ID NO: 18780 - DNA, 346 bp, Homo sapiens
atcccctcgaccgctcgcgtcgcatttggccgcctccctaccgctccaagcccagccctcagccatggcatgccccctggatcaggccattggctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggscttggctttgatctacaatgaagccctcaagggctgaaaaataaata

SEQ ID NO: 18781 - DNA, 326 bp, Homo sapiens
tctggctgctctgaaaagccatctttgcattgttcctcatccgcctccttgctcgccgcagccgcskmmgccgcgkvctcctccgccgccgcgactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaagttgtggaagaggcagaaaatggaagagacgcccctgctaacgggaatgctaatgaggaaaatggggagcaggaggctgacaatg

SEQ ID NO: 18782 - DNA, 219 bp, Homo sapiens
actggctgctctgaaaagccatctttgcattgttcctcatccgcctccttgcccgccgcagtcgcctccgccgcgcgcctcctccgccgccgcggactccggcagctttatcgccagagtccctgaactctcgctttctttttaatcccctgcatcggatcaccggcgtgccccaccatgtcagacgcagccgtagacaccagctccgaaatcaccacc

SEQ ID NO: 18783 - DNA, 260 bp, Homo sapiens
tctggctgctctgaaaagccatctttgcattgttcctcatccgcctccttgctcgcsgcagccgcctccgccgcgcgcstcctccgccgccgcgactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaagttgtggaagaggcagaa

SEQ ID NO: 18784 - DNA, 66 bp, Homo sapiens
actggctgctctgaaaagccatctttgcattgttcctcatccgcctccttgctcgccgtaaccacc

SEQ ID NO: 18785 - DNA, 156 bp, Homo sapiens
actggctgctctgaaaagccatctttgcattgttcctcatccgcctccttgctcgccgcagccgcctccgccgcgcgcctcctccgccgccgcgactccggcagchttatcgccagagtccctgaactctcgctttctttttaatcccctgcatcg

SEQ ID NO: 18786 - DNA, 67 bp, Homo sapiens
actggctgctctgaaaagccatctttgcattgttcctcatccgcctccttgctcgcsgcagccgcct

SEQ ID NO: 18787 - DNA, 67 bp, Homo sapiens; identical to SEQ ID NO: 18786

SEQ ID NO: 18788 - DNA, 229 bp, Homo sapiens
actggctgctctgaaaagccatctttgcattgttcctcatccgcctccttgcccgccgcagtcgcctccgccgcgcgcctcctccgccgccgcgactccggcagctttatcgccagagtccctgaactctcgctttctttttaatcccctgcatcggatcaccggcgtgccccaccatgtcagacgcagccgtagacacsagctccgaaatcaccaccaaggacttaaa

SEQ ID NO: 18789 - DNA, 435 bp, Homo sapiens
  misc_feature 350,396: n=a, g, c or t
atcccctcgaccgctcgcgtcgcatttggccgcctccctaccgctccaagcccagccctcagccatggcatgccccctggatcaggccattggctcctcgtggccatcttccacaagtactccggcakggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaaggstgaaartaaatagggaanatggagacaccctctggggtcctctctgagtcaaatccagtggtgnggtaatttgtacaataaattttthttggtcaattcaaag

SEQ ID NO: 18790 - DNA, 70 bp, Homo sapiens
cccccactggctgctctgaaaagccatctttgcattgttcctcatccgcctccttgctcgccgcagccgc

SEQ ID NO: 18791 - DNA, 527 bp, Homo sapiens
agagggagctgcccagcggcctcacgctgtaaccctctgctggtgagttcccagaacccagcatcctgcaagctgccgcttctcagctggggagatggagccgctctgggcccttcttgattaggatatgttagggttgtcagggcaactgttaacggcagcatatcatattttcccctctctgctgtgggctgaatattttactgtgtggtagcaggaagaagattggaaaaaggtgctgcagcaggaagaagctgggatctgattgaacaggttgtgcagtggtgggaggcatcagaccctgcgtgtctgtagtagggcttttctggaaggagtgtgtgtgtgtgtgtgtgtgtgcgtgcgcgtgtacgtgcatgcatgagccggagcaatcaccagcgcatgtgcctgtcggggagtcagtgggagggggctggtaggggaggtggggaagctgctgctaggtgaggggaactgcagggcctcagttgccaagtggctggtactatctgtcagctgtttgcaaa

SEQ ID NO: 18792 - DNA, 466 bp, Homo sapiens
gagtcggcgccatgaccccatcgaggcttccctggttgcttagctgggtctcggccacggcgtgagagcggcaagatcaccccttctgtgtcattctctgaggaaaacaagttcttctcaaggaggaaagtctgaacttgtcaaacagtcccttaagaagccgaagttaccagaaggtcgttttgatgcaccagaggattcccatttagagaaagaaccactggaaaaatttccagatgatgttaatccagtgaccaaagaaaaaggtggacccaggggcccagaacctacccgatatggagattgggaacgaaaaggacgctgtattgatttttaagtcgcatattctttaacttcaatattgttttctgaatatgtacatctgaattaacttatttctgattattttctttctttatatcctttatgtcgtgtagtttgtgtatgtgtttaaatatatatatat

SEQ ID NO: 18793 - DNA, 510 bp, Homo sapiens
ttctaagaatcctgtccccaaattaaaatgtctttaaagccccctaaaaaggtgttctagtgttctaataccattaacctaggaagtattggtgctttgttctggtagtgcatgcaatattacaatgaaggagcttttatctgaattattgaataactgtacaactttggatttaaaaccatttccaacataagaggtgaaagttatttttttcctcaattttagtcttcttcaattgggccatataacctagttgagtttgtgactttgccttgagaaatgaggtaacacagcatggaacagtctatcttttccagaccttgaatgaggaaggcaaatgatctagacatttcttagaactagacgaaaaatagtcatagcatgactaggagtagttttatctgtagttaggcgaatgcgcttctttacattattggtgcaatgaaagtatgggaaagtctcaacagwacagactggacatttgagaccttccatttttcaaaatttcag

SEQ ID NO: 18794 - DNA, 453 bp, Homo sapiens
tatacttaccagttgggcatcccaaatctgaaatctgaaatgttccatgagcatttcctttgagtgtcatgttggcactcaaaaaggttcaacattgagtccacttaacacttaggtgttagaagacctaactttctgtaacaattaaccttatactttgtttgtcatcgaatatttgttgaatgcatgtcaggtaatggtcttgattgtgatagcttcaaggtggaacatactgtaatctccagatgctaggaagttagtctaataattcactgcagaaaattgattaagtggctgtccttttaattaagagtgtggagtcataaacttaagttcttcatatagtgacaagagtccttagagattgttattcaagttccttagaaattgttatttaggtataatatcatcttgtctttgactagagcttgaaaccttgttatctgattgtgt

SEQ ID NO: 18795 - DNA, 465 bp, Homo sapiens
ctttgaaaaaggttggtccagaccattttgatcaagaacctgtatatgtgttgtgttagaggcatctgcctcaagtctatgtacagtgtttgctgcgggtgtgttccaatattcattttacctctgcttgggggttttgtgtgtkcccctccccccatgccctgcctacccccttttccctgaaccacgtccttttgaataatttccagatggatttctgtagccataccaaagccagggtgttttcattcatgcggatactagtatttatagatgtctgactacctaacttaatttttgtctttgaacttctaattggggccagtgtaaggtcgatcccagaggctgatctgcaaatcaagctacatgtatttgtgtataagaccctgtgttcaggactgggtgacttttctaagaaatatggggtttagaatggggttgactgtattttttaacctcaattcc

SEQ ID NO: 18796 - DNA, 503 bp, Homo sapiens
ctttgaaaaaggttggtccagaccattttgatcaagaacctgtatatgtgttgtgttagaggcatctgcctcaagtctatgtacagtgtttgctgcgggtgtgttccaatattcattttacctctgcttgggggttttgtgtgtkcccctccccccatgccctgcctacccccttttccctgaaccacgtccttttgaataatttccagatggatttctgtagccataccaaagccagggtgttttcattcatgcggatactagtatttatagatgtctgactacctaacttaatttttgtctttgaacttctaattggggccagtgtaaggtcgatcccagaggctgatctgcaaatcaagctacatgtatttgtgtataagaccctgtgttcaggactgggtgacttttctaagaaatatggggtttagaatggggttgactgtattttttaacctaattccggagagaagattgtattttttacagttttttgggtttgg

SEQ ID NO: 18797 - DNA, 444 bp, Homo sapiens
  misc_feature 342: n=a, g, c or t
gcggaagtgttgcttactgggtcctgaatcggctgcgtgctgttctaggtggggacttgagagactgtagatgggtctagggagtggtcgaatataaataagctagattttttttttttttaattgcaagggaactccctaggaattccatccatggccttgtggaacgatctgccaaagaaaaaatatttatctctcctcgctgtgtcacccaggctggagtgaagaggtgcgatctcggctcactgsaacctccgcctcctggattcaagcatcagcctccctagaagctgggattatgggtgcmggcsatcacacctggctattatttgtacttttagnagagatggggtttcgcsatgttggccaggctggtctcgaacacctgacctcaagtgacgcacctgccttggcctcccaaagtgctgggattacaggcacggg

SEQ ID NO: 18798 - DNA, 482 bp, Homo sapiens
ctaatcgaaaataattaactaatctttgattaatttgcttaacctctataatcttaggtttcttcatcagtaaaatggaaatgataacaaagcctctggcccagggctgttgcctggatacaatttaggtaaagttctagcatagtgtctgacacatggtaagcactgaatagattctaatgtgttgattgatattcatctttttctaagatgctagaaattgcacacctttaccattgactattaaatgtgacatattcagtttaataggcaatgtgaaagaatgggttacatgtggtttaaccaaaaagtaacaacgtcatccctgatgttgtccatatgccatcacattcatctaataagtatcacaggttggtcattgcattgagaagcaggacccccattttggcacagagtgaccatctccacagtcacggccgttcctcagcctggcagttaagcacacaatcacgtctttctgt

SEQ ID NO: 18799 - DNA, 403 bp, Homo sapiens
aacacggaaagagctggcttgcgagctccctgcttaacagaaggctcagttgcccaagtgacgaaggcattgtggggcacgaaccaggctttggtgaatttatctcattatacaccaggagttataatttaaaaaccagtgtcatataaagaagaaaaaagatatggtgagatacaataccattaacacttcttcagaaacggattttaaagcagaacttccatgactgtgaaatccaaccgggtgcgcgaccacgaggaaggatggcgagggaggaaaccgcgctttgttgttgagcattcatcactatgagaaagacatacttgagctacccatttggtcctaaggaggatgaagcatgctgtgtgacagagacaaccagcagacatttgagccaggacag

SEQ ID NO: 18800 - DNA, 506 bp, Homo sapiens
cacagtgatttgttttgtttcttgtatatttcagtttgtattatgtaaaaagtaatagtgtatacatcagatttaaataataatttaaagcctttttctccgtgcctcctttatgttttttactcttaatccatttttcttttccatcattcttcaaatattaattaaatttaataatttatctaaaagcatatgtatttaaaaatatatttaaaagcataaaatacttttacagtgtaaaagaattatgtagggtgggtgtggtggctcacacctgtaatcccaacacttcaggaggctgaggcaggcggatcacctgaggtcaggagttcgagaccagcctggccagcctggtgaaacccgtctctattaaaaacacaaaaattggctgggcatggtggcgggcgtctgtagtcccagctacttgggagactgactcaggagaattgcttgaacccgggaggcggaggttgcagtgagccaagatcacacccactgcactcctg

SEQ ID NO: 18801 - DNA, 600 bp, Homo sapiens
cgaatacctcaactaagaaatgggagaggatgccagaaatagttggctaaaaagtaatatggcaagtatttagattgtacaagcaagcctttacagaaaatctaaatttcgaaaaattatattcaaaattatgcttgaagtataataaatcccaaaatatcaccttaaaacagtcatataaattaggatggcgcccacgggtctaggactaaggcagaacccatagccaatatttgtcggtkaagagacaaactgctgaatagagttagtacataaatttaggattacaaagttctaccttctaccagaacaactaggtcaaactgttcccactaacagattttccattcctcttttgcagtatcatgggctaaccaattcataatcgattttttaaaactttaacaggcccactatatgttaatcattgggttagggaacttatgaacaaaatatcaaaattctaagtaaagacaaaattagtattgccttaggctccaatatggcttggcaaggtactattactgattctatctttatttaaaatgtcaacattttgtttatcgtacatctttgcattgattttttaaatattgcatt

SEQ ID NO: 18802 - DNA, 499 bp, Homo sapiens
ttccgccgggctgctccgcgggcgcgtcggccatgagcgagttgccgggcgacgtgcgggcgtttctgcgggacacccgagcctgcgctccagacggacgcccgcaagtgaggtgcatcctgacaggtcacgagctgccctgccgcctgccggagctccaggtctacacccgcggcaaaaagtaccagcggctggtccgcgcctccccggccttcgactatgcagagttcgagccgcacatcgtcccagcaccaagaacccgcaccagttgttctgcaaactcaccctgcggcacatcaacaagtgcccagaacacgtgctgaggcacacccagggccggcggtaccagcgagctctgtgtaaatatgaagaatgtcagaagcaaggggtggagtacgtgcctgcctgcctggtgcaccggagaggaggagggaggaccagatggacggtgacgggcctcgccsccgggaagccttctggtagcccacatccagtgatg

SEQ ID NO: 18803 - DNA, 528 bp, Homo sapiens
cccggctccctcccccttcggatgtggcttgagctgtaggcgcggagggccggagacgctgcagacccgcgacccggagcagctcggaggcggtgaataatagctcttcaagtctgcaataaaaaatggcctccaacaaaactacattgcaaaaaatgggaaaaaaacagaatggaaagagtaaaaaagttgaagaggcagagctgaagaatttgtcgtggaaaaagtactagatcgacgtgtagtgaatgggaaagtggaatatttcctgaagtggaagggatttacagatgctgacaatacttgggaacctgaagaaaatttagattgtccagaattgattgaagcgtttcttaactctcagaaagctggcaaagaaaaagatggtacaaaaagaaaatctttatctgacagtgaatctgatgacagcaaatcaaagaagaaagagatgctgctgacaaaccaagaggatttgccagaggtcttgatcctgaaagaataattggtgccacagacagcagtgggaga

SEQ ID NO: 18804 - DNA, 83 bp, Homo sapiens
  misc_feature 43: n=a, g, c or t
aaaaagtagacggcctggtaggtgctctagggataacccttcnmcccccactccaccccccttcccgcacacccatttagact

SEQ ID NO: 18805 - DNA, 490 bp, Homo sapiens
  misc_feature 86: n=a, g, c or t
caaaaaatgcctgacctcaggtgatccacccgcctcggcctcccaaagtgttcgaattacaggcgtgacaccacacccagcccggnwttattcttaaagtgacctggtgagccagctggtgtggagatgaggcgggaagcagggctgatggagtccctggacagtggatggcagtggcttggccaggccgctaacagcaggggcactgggaagtgattggattctagatactgatttcaagggtagcacacacgtgatctgctgatagattccatgtcaggtgtgagagggaggagagtcaagctcatccacagctctggcagcggaagacggccaaagtgaagaaggtggcctcaagtttacctccaccttccaaacctcaactggtaaaacctcatgcatgcccagaatgctagcacaagagatttagggaaatgtgggtattttgctttctggccctgcagttcaggttccaccttataaaatggga

SEQ ID NO: 18806 - DNA, 447 bp, Homo sapiens
gcagataggggtagcctggaggcctgcagtccgcgcggccgsggggagggacgagagggcctgacgtacagattataagcgccatggctatggctagtgttaaattgcttgccggtgttttaagaaagccagatgcctggattggactctggggtgttctccgagggacaccttcatcatacaaactctgtacttcctggaatcgatacttgtatttttctagtaccaagttacgtgcaccaaattataaaacacttttttataatattttctcactgagactcccagggcttttactatctccagaatgtatttttcctttttccgtaagactcaaaagtaatataaggtctacaaaatctactaaaaagtctctgcaaaaagtagatgaagaggactctgatgaagaaagccatcatgatgagatgagtgagcaggaagaggagc

SEQ ID NO: 18807 - DNA, 447 bp, Homo sapiens
caatgaagatgctgaaaactgggaaaataaagcccgtcaatcagaggcagataacaataccctcaaactggaacttatcactgctgaggcagagggtaacagattaaaagaaaaagtagattccctcaacagagaggttgagcaacacttaaatgcagaaaggtcttacaagtcccagatttctaccttacataaatctgttgtaaaaatggaagaggagcttcagaaggttcagtttgaaaaagtgtccgctcttgcagatttgtcttctactagggaactctgtattaaacttgactcaagcaaagaacttcttaatcgacagctggttgctaaagatcaagaaatagaaatgagggagaatgagttagattctgctcattctgaaattgaactcctgaggagtcagatggcaaatgagagaatctccatgcagaatctagaagc

SEQ ID NO: 18808 - DNA, 495 bp, Homo sapiens
ctagtagtagattggagggaaagctttgtgacacttagtactgtgtttttaagaagaaataatttggttccagatgtgttagaggatcttttgtactgaggtttttaacactttacttgggtttaccaagcctcaactggacagaccataaacagtccacaggcaccgttcctgccaggccccaacccacagggagtctctccgcagagccttcttggtgttgccctaacttgccagtggcctttgctcagagcctcctcctgtgacatgtgaacaatgaagaggcctgcgcctcctgccttgccgcctgcaaagcaaagaaactgccttttattttttaaccttaaaaagtagccagatagtaacaagactggctggctgatgagcaaagcctttgctctcacgcagaggaaggcttggatgtacaatgaaactgcctggaactaaaagcagtgaagcaagggaggcaatcacactgaagcgggtcttcctcca

SEQ ID NO: 18809 - DNA, 384 bp, Homo sapiens
actcattgtgtctgtgtcgaggcgtcgggagggcctaagtccgtgtgcgtgcccttcggccggcctgagccccagagtcagctcccctttctcgcccagcgcccccaggccgctcccggggctcacggaatagtaaagaaacacatcataaaacctcccaggacataaaggtgagcacagaccctgtttggatcaagtcagttcctggagcctgaatgatgactgctgaatcacgggaagccacgggtctgtccccacaggctgcacaggagaaggatggtatcgtaatagtgaaggtggaagaggaagatcgaggaagaccacatgtgggggcaggattccaccctacaggacacgcctcctccagacccagagatcattccg

SEQ ID NO: 18810 - DNA, 297 bp, Homo sapiens
ctttttaaatttatgccgacagaggaagaagctgatatttaacaaataacaagaggttgcgataaatagaatttaaggtgggaaagcagccgccaaactgacaaatcgtcttcgagaccgacaagaaaatagtagtccggaatttggctaatggatggagaaggtggtcgtttttcatagacccttacggagaatatctagtgaagctaaagagatcaccataaacttatgcattcaaacgcatttctggaacagaggtcgtaaccgattttgtttccatcatcagtcctgaacagt

SEQ ID NO: 18811 - DNA, 87 bp, Homo sapiens
ttgtattaaaaagtaggatttattgagtatgtatcttctaatggaaaatattaaggaatttaatgccttaagaaatctagttaaagg

SEQ ID NO: 18812 - DNA, 506 bp, Homo sapiens
atatacccggctagggacacgagagacaggaatcggggtttctgggtgacggtgatctcggggtgggcaggactccaaaggcccgtcgacccggtggtggactccttgcactgggattggacatatgcaagcgggagatttgsggccggcgctcaaaatcggggggcgggggtggactcgggtttggaccccaggatccgatcagcggacccttgattcaacgtgaggtcccgaattgacgtccttccctcaaaacctccgggtctacaaaccaggaccctcaagacccttcagggctccagcgtgacatggctgaagcgcaccaggccgtgggcttccgaccctcgctgacctcggacggggctgaagtggaactcagtgcccctgtgctgcaggagatctacctctctggcctgcgctcctggaaaaggcatctctcacgtttctgaatgactttctcacsggtgtgtttcctgccagccccctcagttggcttttcctcttca

SEQ ID NO: 18813 - DNA, 484 bp, Homo sapiens
ttttaccgtggtttaaaaagtagtcagttacatagaaagtgtattggtatgtatttgaacctgctcttcattaaacaaacagattagatgtaccctcgactggcaataattgtatctattttcaagtacagctagctgtcaaagcatgaagctcttgtgtatacacactgacacttggttcacgcatgaagaacagtgcctatgcactttgtgtagctataatgtaggtatctaggtgtaatttcagtgaaatggtgtatagatgtattgtaatttaaatgtatatgttatttttggctattcatctaaatgcagtagacatgttgatcggtgttttgcaaacatttctttttccttcttagataactagtcgtgaatcatttctcctctttctcagtgtggcttgggaatatatatgagtgaagaatttatctgtgaatcctttgtactgatgattgtttgaaagtctgtgtgtgtccagcac

SEQ ID NO: 18814 - DNA, 991 bp, Homo sapiens
acacacttagcttttttgtcacacttatcctttgtctccgtaaatttcatttgcagtggttagtcatcagatattttagccacctacdaaagcaaactgcatttttaaaaatctttctgagatgggagaaaatgtattctcctttcctataccgctctcccaacaaaaaaacaactagttagttctactaattagaaacttgctgtactttttcttttcttttaggggtcaaggaccctctttatagctaccatttgcctacaataaattattgcagcagtttgcaatactaaaatattttttatagactttatatttttccttttgataaagggatgctgcatagtagagttggtgtaattaaactatctcagccgtttccctgctttcccttctgctccatatgcctcattgtccttccagggagctcttttaatcttaaagttctacatttcatgctcttagtcaaattctgttacctttttaatatctcttcccactgcatatttccatcttgaattggtggttctaaattctgaaactgtagttgagatacagctatttaatatttctgggagatgtgcatccctcttctttgtggttgcccaaggttgttttgcgtaactgagactccttgatatgcttcagagaatttaggcaaacactggccatggccgtgggagtactgggagtaaaataaaaatatcgaggtatagactagcatccacatagagcacttgaacctcctttgtacctgtttggggaaaaagtataatgagtgtactaccaatctaactaagattattatagtctggttgtttgaaataccatttttttctccttttgtgtttttcccactttccaatgtactcaagraaattgaacaaatgtaatggatcaatttaaaatattttatttcttaaaagccttttttgcctgttgtaatgtgcaggacccttctcctttcatgggagagacaggtagttacctg

SEQ ID NO: 18815 - DNA, 509 bp, Homo sapiens
cttcatgaaaaagtatagctccatagtttaatggatatagacccagatgtcctgggttctgtgacctcgggtttttactttaccttttggaattactataaggattaaggaaattaatattataaaacacttaaaagaatacagggcacatatgcaacggtttgaatgaaaatatctcacttgggaaattacacacaaacttttttcagccaataacctaatgttattgaactcttggctgggcgcggtggctcatgtctgtaatcccagcactttgggaggccgaggtgggcggatcacaaggtcaggagatcaagaccatcctggctaacactgtgaaaccccgtctctactaaaaatacaaaaaattagccgggcatggtggcgggtgcctgtagtcccagctactcaggaggctgaggcaggagaatggcaagaacctggatggcggagmttgcartgagcccagatcgcaccactgcactccagcctgggtgacagagcaagaa

SEQ ID NO: 18816 - DNA, 561 bp, Homo sapiens
aactgcttctctctctctcttttactcttattctttctctctcactctctctcttttcccacccttaagccaagtacagggatagttgtctcatcattggtggcttaaaatgatgtttttgaacaagaagacrccccatgggtacttttggtgactagcactatctctgtttttttccttttaaattcctgagctatkgtttagcagtacacccttttatctccattgctactgaagctgaatgttacttgggtggaaagcataactgctttcttttctatgtccttaaaccctttgataatgttactgtttgagagtccctgaagccaggatattagaagagtctggcttgtctgaacagctgaactacgaaataatggagtagggcagcctctaggtgctgtgctgtcctgaggcctgggccatggtgcccaaggaaagcccctgaagctcaccaggaggaagaagcatgcagggcactcctggaggcgggacsgccctgggccatcccccgtggacaggcggacactcctggtcttcagctttatcctggcagcagct

SEQ ID NO: 18817 - DNA, 487 bp, Homo sapiens
agagcaggagagagtgaatggggacgtgctacacacttttaaataagatctcgcgagaactctatcatgagaacagcagagcaggagccactttcaaataacaagatctcttgaggactctatcacgagaacagcagagcaggagagagtgaagggggacgtgtcacacactttcaaataacaagatctcgcgagaactatcacgagaacagcagagcaggagagagtgaagggggacgtgctacacattttcaaacaacaatatcttgcgagaactctgtaaggagaacagcacggggaagtctgcccccatgattcagtcacccccccatcaggcccctccttcaacacacggggattacaattggatatgagatttgggtggggacacagagctgaaccatatcaacatcctattctacagttcagtatttccagtagctttgttttgcctactgggtcagatgaatacacatagaatataaaa

SEQ ID NO: 18818 - DNA, 504 bp, Homo sapiens
aaaaacttcctaactgcttctctctctctcttttactcttattctttctctctcactctctctcttttcccacccttaagccaagtacagggatagttgtctcatcattggtggcttaaaatgatgtttttgaacaagaagacgccccatgggtacttttggtgactagcactatctctgtttttttccttttaaattcctgagctatkgtttagcagtacacccttttatctccattgctactgaagctgaatgttacttgggtggaaagcataactgctttcttttctatgtccttaaaccctttgataatgttactgtttgagagtccctgaagccaggatactagaagagtctggcttgtctgaacagctgaactacgaaataatggagtagggcaggctttaccaagccaattcactcaagttgtctcatctataccccttcaaaccctgtgaggctgggctttccagctctaggtgctgtgtgtcctgaggcctgggc

SEQ ID NO: 18819 - DNA, 533 bp, Homo sapiens
aactgcttctctctctctctttactcttaytctttctctctcactctctctcttttcccacccttaagccaagtacagggatagttgtctcatcattggtggcttaaaatgatgtttttgaacaagaagacrccccatgggtacttttggtgactagcactatctctgtttttttccttttaaattcctgagctattgkttagcagtacacccttttatctycattgctactgaagctgaatgttacttgggtggaaagcataactgctttcttttctatgtccttaaaccctttgataatgttactgtttgagagtccctgaagccaggatactagaagagtctggcttgtctgaacagctgaactacgaaataatggagtagggcaggctttaccaagccaattcactcaagttgtctcatctataccccttcaaaccctgtgagcctctaggtgctgtgctgtcctgaggcctgggcatggtgccaaggaaagcccctgaagctcaccaggaggaagaagcatgcagggc

SEQ ID NO: 18820 - DNA, 440 bp, Homo sapiens
actcttactctttctctctcactctctctcttttcccacccttaagccaagtacagggatagttgtctcatcattggtggcttaaaatgatgtttttgaacaagaagacaccccatgggactgatctcaaatgcagctgtgactaaaacctctaggtgctgtgctgtcctgaggcctgggccatggtgcccaaggaaagcccctgaagctcaccaggaggaagaagcatgcagggcactcctggaggcgggacggccctgggccatcccccgtggacaggcggacactcctggtcttcagctttatcctggcagcagctttgggccaaatgaatttcacaggggaccaggttcttcgagtcctggccaaagatgagaagcagctttcacttctcggggatctggarggcctgaaamcccagaaggtggacttctggcgtg

SEQ ID NO: 18821 - DNA, 593 bp, Homo sapiens
tttcaaagatgggaacaaccagtatctagtcatcatacattaatgtgaacatgcttattaaaagttaacctctttataaaaagtattaataaaccaagatgtgcctaaatattagggtacttcaagctaaaggtcatagtttatatataaaaagtacgagattcaaggaagtaatgtatctgatgctttgcttaataagattcactagtgcttgcccttaattcatagaacagtattgtttaggttacattaacctgaaatttaaagcataattattaggattccggcctataaatacaataattaaaatctatactatattattgctaccatgaaagtcttatctttggctgtttttcaagtagaaaagtaagtgtactgtgagccttttatttgagatgctgagagctattaggatgagtatttcagttttcttgtcaatagtgatactctgatgatgtttgcagttatttgaagtagaactgattgtctaaaccagacacacataggagtgtgctccattggtcttgtggagagtgctgcacattaacccctccctcaactgtgcaatccacttgagactggcttctcta

SEQ ID NO: 18822 - DNA, 205 bp, Homo sapiens
attgaaagtaaaatcaatatatgcacaaagactttaacatttatcataaaccagaaaaatcgagtttcaaattatatcctatggactattttctgctaaaaagtattaatatcaactttatgtaatactttcgtgacaaatattttgggggagaaaacccaacaaaattacatgcattgtaattttttttttttttttttttttt

SEQ ID NO: 18823 - DNA, 206 bp, Homo sapiens
attgaaagtaaaatcaatatatgcacaaagactttaacatttatcataaaccagaaaaatcgagtttcaaattatatcctatggactattttctgctaaaaagtattaatatcaactttatgtaatactttcgtgacaaatattttgggggagaaaacccaacaaaattacatgcattgtaatttttttttttttttttttttttw

SEQ ID NO: 18824 - DNA, 195 bp, Homo sapiens
attgaaagtaaaatcaatatatgcacaaagactttaacatttatcataaaccagaaaaatcgagtttcaaattatatcctatggactattttctgctaaaaagtattaatatcaactttatgtaatactttcgtgacaaatattttgggggagaaaacccaacaaaattacatgcattgtaattttttttttttt

SEQ ID NO: 18825 - DNA, 490 bp, Homo sapiens
ggtaggtaataggagaagaaagggcactgggggctgttctccttccttccctgggctgtatccatggactcctggaaggcacagagaagggagctataagaggatgtgaagttttaaaacctgaaattgttttttaaagcacttaagcacctccatattatgacttggtgggtcaccccttagcttcctccctctcccaccaagactatgagaacttcagctgatagctgggggctccccagatgaggatgcagggatttgggagcagtggaagagggtgcccaaccttgggttggaccaacccttggctcgcagctcaactctgcttcccgcattcctgctccacgtgtcccggcttctcccctgtgacgggaaggcaggtgtgactccaggctctgcactggttcttcttggttcctcccaccaggccctttgttcctcatgtccccatgtttctctccctctgcgtcttagcacctttcttctgttc

SEQ ID NO: 18826 - DNA, 402 bp, Homo sapiens
aataatttctttacagatgttttatttaagcaggtagcacaatctactaatgttgtttgatctgtgtttgttatactggttgtaattaattttttaattcatgaactagcggaaaatttattaaattaactattaaccacattcaccttgtaaatgactgtataaaacttgttgacaatgcactgactttagaaagatgttaatgtgcataaatagagtgtaaataaaatagtgttgatgtactgaaatatgaactgtataaaaagtattggtaattgtatatggggtgtacctatttatctgtaactattatccaaacaaattaaatactgtggatgcctctatgtactgtttttcctcatacaagtaaacacagaatgtcaaattcaaaaaaaaaaaaaa

SEQ ID NO: 18827 - DNA, 433 bp, Homo sapiens
acaatgatctgggaagggcaactagccataggcactgctatttggttcagagaagcaccaattaattcgactgctctctgatccacttgaagaactcagctggaaatcaaacaaagccaacctaaaaaaaaacgtctaacactagagtattcctgtatcctggagaaggcagcactcgagccaccatcttggaagtgaagatcaggccctcagcagacacaaaacctgccagtgccatgatcttggatttttcaacctgcaggactattcaatgaaattccaatgaaaatctcaagttattatgtgaatattgaaaaacgaaccctaaattttatatggagagccaaaaaatgcaaaagagccagcacatattgaaagagaagaacaaagtcagaagattgacactacctgacttcaagacttatgataaagc

SEQ ID NO: 18828 - DNA, 445 bp, Homo sapiens
ggaccggggcgggtccagtcccgggcgggccgtcgcgggagagaaataacatctgctttgctgccgagctcagaggagaccccagacccctcccgcagccagagggctggagcctgctcagaggtgctttgaagatgccggasgcccgcctctgctgttggcagctgtgttgctrggcctggtgctgctggtggtgctgctgctgcttctgaggcactggggctggggcctgtgccttatcggctggaacgakttcatcctgcagcccatccacaactgctcatgggtgacaccaagagcagcgcatcctgaaccaygtgctgcagcatgcggacgccggggaacgcacagagcgtgctggaggccattgacacctactgcgagcagaaggagtgggccatgaacgtgggcgacaagaaaggcaagatcgtggacgccgtgattc

SEQ ID NO: 18829 - DNA, 444 bp, Homo sapiens
ctaactagtgaaggaaaggtgaaactggttccaaatactaaaatccagatgtcatattcagtaaaatggaaaaagtcagatgtgaaatttgaagatcgatttgacaaatatcttgatccgtccttttttcaacatcggattcattggttttcaattttcaactccttcatgatggtgatcttcttggtgggcttagtttcaatgattttaatgagaacattaagaaaagattatgctcggtacagtaaagaggaagaaatggatgatatggatagagacctaggagatgaatatggatggaaacaggtgcatggagatgtatttagaccatcaagtcacccactgatattttcctctctgattggttctggatgtcagatatttgctgtgtctctcatcgttattattgttgcaatgatagaagatttatatactgagagggga

SEQ ID NO: 18830 - DNA, 282 bp, Homo sapiens
acttacatcatcatctggcttcaggctgtgctacagaaaacaaacagcatttttgagtggttaaaaagtcagcctgaaatattaaaaaatggggcaaatgttgcctcctggttgaatagaacagttttcttgaaaaatggagtggagccaggggtcgggggaaggaagtgtttccgagggcaaacgttggtcttagatccggtctgcattgctccagtgtgtgcacgccgaggagctttctgtagacgctgagggttatgttctgcttcgtttttgattttc

SEQ ID NO: 18831 - DNA, 522 bp, Homo sapiens
aatctggacggtccgaccgcctcgtgcttggtgggtttacaaactctgactggttcttaccacccatctaacaggaaattttttttttttaaaaaacaaaccaacccataaaacatctgaccagatgccacactcaagaaaacacttgtattcgggtgttttaacctccaacgatggaaatctgcttaacattggtgtttctgaggtgtcttagcatcagaaaaggaaaaagacacatatacacacattctaaggaaaaagtcaggaagggccttgcagagtggtggagccacagtgttaaagaacagagaagtgatccttaatcatttagaattttgcctccaccatccaccagaaaatgaagtggaaagagaagttgggggatggtgtctatgacacttcatgatgatagatgaaaccaaatgtcccccctgttcaaatgtactctgcaatccttctgaaccacctccacccagaagactaaatgctggagtgcagtggtgtcatgtcagctcattgcaa

SEQ ID NO: 18832 - DNA, 522 bp, Homo sapiens
  misc_feature 242: n=a, g, c or t
atcaccccaagttccagtcctaggctcctcctactggagacaccggagtacaagcatcccttttagctctcactctaattgtgtatctgtttcggaaccttttctccgtgtcccttctggttttcccgctcccgctccactaaaaagtcccgttgtctccggaaaccctaaatccagtcttatatttcatcttccaaggaacccagaatcagacttccttttccctgaggacctcaggtcgnactcccgccccctctagtcccgtaattttgaacacgcagcctttcacccttaagggaccgggccctaagccatcttccctcaggcaccaaagctctcttccccgtcccgggacagccgccagccgtctccagtccactagcgcctgtagatgaggaatctgcacctacgtgggccttcaataaactcccggtggtcctgcccacgactcttaactgtggtgaggtcacaakgaaaccaggtcgtcataggaatcagtcaaaacccatccccagaccccaa

SEQ ID NO: 18833 - DNA, 445 bp, Homo sapiens
ccaagatggccgcccccgtggatctagagctgaagaaggtttattcttcagtccaaggaagcaattcacagtcagctgttagagaagcagaaaatagcagaagaaaaaattaaagaactagaacagaaaaagtcctacctggagcgahvtaaggaagctgaggacaacatccgggagakgctgatggcacgaagggccagtagggagcctctctgggaagctcttcctcctgcccctcccattcctggtgggggcagaggagtgtctgcagggaaacagcttctcctctgccccgatggatgctttatttggatggcctggcaacatcacattttctgcatcaccctgagccccatttgcttcccagccctggagtttttacccggctttgctgcsacctctgcccaggacactcttccctctcgggatgtgtgatgaactccca

SEQ ID NO: 18834 - DNA, 394 bp, Homo sapiens
aagtctcgcgagcgaaccggcaatccgagaagagtaatgtcttgctctccgccctgacaacttttatgtattataatttgaccgcgctgggccacgctgcgagtcgcatcggaaccgctgcgttaacccakccccggaaataacgtaccgatcttcggagtccaagtcggaagttgactagagagtcacctgctttcgtccgctctaggacaccagacacaccaggccgccatgttgtgtaaggatccccagccagtgrgcctaaaatgggaagaaggaaaagatatttcttaccctacgcacccaggtccaagtcatcattattttgtctgaaatttatcttcctaactgatttctctgcttccccattgtgccttaagagttagttttccac

SEQ ID NO: 18835 - DNA, 532 bp, Homo sapiens
tttctaacaagaatttctggaaggcaagtcatcactatgattgggaaagaagccaaaattataataaaatgaaaacctgtgcatcaaatctgaaggatgagtataaaataggataaacagtcttaaatgaagaaattcaaaaataggaagctgaattacttctctgaggatgtcttgtcactaaaacatggagaatccaacctaccctgcgtagttgtggaatccctcagatgacagcagtgaagattattaatgaagatgttaaataagaagaaagcaacatccttccccatgtactgcagttgaattactaatcacttcacgaatgctgaagaaagcattttaaaaaagttttttctgcaatatatacaacctacactgaaaaatcttaagctatatgtacttcattcaattcattcatgcatacgaatattcaaaaccttcatttaagctcaaaggccatggagataaaaaagaagacaaattaaccagttgacaaggacctagctgtccaatgtgttgactttgttgt

SEQ ID NO: 18836 - DNA, 464 bp, Homo sapiens
attctaacaagaatttctggaaggcaagtcatcactatgattgggaaagaagccaaaattataataaaatgaaaacctgtgcatcaaatctgaaggatgagtataaaataggataaacagtcttaaatgaagaaattcaaaaataggaagctgaattacttctctgaggatgtcttgtcactaaaacatggagaatccaacctaccctgcgtagttgtggaatccctcagatgacagcagtgaaggtgatccctaggcatgctaaaggcagagaagcactggtctaaactgcagacatggttttggggatatgaagaaagaagagatatcagagatatttagcagattattaatgaagatgttaaataagaagaaagcaacatccttccccatgtactgcagttgaattactaatcacttcacgaatgctgaagaaagcattttaaaaaagttttttctgcaat

SEQ ID NO: 18837 - DNA, 188 bp, Homo sapiens
  misc_feature 94,140,149: n=a, g, c or t
aagcctgtcacgtcacgtgagaggaactaghcttaghgagghcatgggggaaaaagtctaactggcggaactcctgggaactggggcgatgggntmttagtatcggaggattggagmcatctgatttttahctgaaattnmttagthtntcctgtgttggggaaatggtaagtaagacagattttcac

SEQ ID NO: 18838 - DNA, 265 bp, Homo sapiens
agcttccgccggaasgctcctgtcagttgttctcaggtgtttgggcttgttgttccgtatactcagtgggttcgcggccgccggccagtgaggctgggttcgaggagctggagcgcgaaactggagcttaaattctggcggcgagatggacattctgaaatcagagatccttcggaagcggcagctggtggaggacagraacctgctggtggaaaataaaaaatatttcaagcgtagtgagctcgccaaaaaaaaaaaaaaaaag

SEQ ID NO: 18839 - DNA, 374 bp, Homo sapiens
catttgcctctcaagcagcctctggtcatctatctgcctttgagccatcaagatgccgatgtcttctcttccagcagctattttgtctcacatgacagctattaacaatgtgcctcctcctccacttcacagtataccaaacttgaaaaagtctaagcacattaattatggccagttgaatgcattatgccacattagaggacaacacagagagagakaakaaggcatgcaactttgatattgcttggatttctgtcaagagggatcattttcccctgtgcattgctgcctcctccttgcacccagtgcctttcgacatggagtaaagaatgaagtccacacactcccgagacctattgcctgatgtgaatcct

SEQ ID NO: 18840 - DNA, 439 bp, Homo sapiens
ttctccagttttgtgggtcagggatactgcttgttggggcattatgttaacagtaacattttgaaacatactttcatgatagtccagcaaaaaacagcatcaaaactatttccattgtatctctttagaaggctctgtattcggtaaaaagtctagctggcgccattggaatatgggctgctaaagactcaatttctagttgatgtttgaggtgaggcaaaaataaagctaaggtagaaaacttaagctttgtgggatttatttatgcgcctggcatgttgacttaaggaactcaaccttatgtacaggcttggcatttaaagaaaactggtggctgggtgtggtggctcactcctgtaatctcagcactttgggaggctgagaggatcacttgagcccaggagttcaagactagcctgggcaacatggtgaactccat

SEQ ID NO: 18841 - DNA, 452 bp, Homo sapiens
ttctccagttttgtgggtcagggatactgcttgttggggcattatgttaacagtaacattttgaaacatactttcatgatagtccagcaaaaaacagcatcaaaactatttccattgtatctctttagaaggctctgtattcggtaaaaagtctagctggcgccattggaatatgggctgctaaagactcaatttctagttgatgtttgaggtgaggcaaaaataaagctaaggtagaaaacttaagctttgtgggatttatttatgcgcctggcatgttgacttaaggaactcaaccttatgtacaggcttggcatttaaagaaaactggtggctgggtgtggtggctcactcctgtaatctcagcactttgggaggctgagaggatcacttgagcccaggagttcaagactagcctgggcaacatggtgaaactccatctctaccaaaaa

SEQ ID NO: 18842 - DNA, 225 bp, Homo sapiens
aaaaaaaactttaaacagattgaaataaaacagaaaagtaaatgtttttaaaaacttccttaaataacttattgctatgatatcttgtttaacattgtgatattgtacagaaccagagtttgtctgtagtatcatctagctgtagagtaccctgcttggccaaatgaatcactttcatttgtccagtgcaactgaaaatttcccaaaaaaaaaaaaaaaaaagct

SEQ ID NO: 18843 - DNA, 438 bp, Homo sapiens
aatcagaagattggcaggatttaggaatctatttgaaatattcattacctattttgaattggtcttaaaaatttaaagaaatataaagctggataattaaagataaataataaaggaagaatacaaggtttctatgctgtgaacaactgagattattatgattttggggcagtgaatttgtttctagaagttttgttggaactaaggcagaaaggaagaagaacaaatgaccttggaatgaaaaactttaaggacttggagctcacactttaaaaaagaagatcattctaactgcccctcatgactactgaagaggctatgctgaaaaagcaaaatgtcctacgttagagatcaccaagcaagacttttttcaagaagcaaaaactctcattgcccaacattatgagaaaataaatgagaataaagttcaaggtactt

SEQ ID NO: 18844 - DNA, 412 bp, Homo sapiens
aaggcgtggccgggtgtcgtgaggcgggccttcgggctggctcgccgtcggctgccggggggttggccggggtgtcattggctctgggaagcggcasagaggcagggaccactcggggtctggtgtcggcacagcatggcggcgcgttggtgcggaaagcggcggactatgtcraagcaaggatttccgggactacctcatgagtacgcacttctggggcccagtagccaactggggtcttcccattgctgccatcaatgatatgaaaaagtctccagagattatcagtgggcggatgacatttgccctctgttgctattctttgacattcatgagatttgcctacaaggtacagcctcggaactggcttctgtttgcatgscacgcaacaaatgaagtagcccagctcatc

SEQ ID NO: 18845 - DNA, 494 bp, Homo sapiens
aattccatttaactatgttactacatatcttctcagagttaaagttttgctagagtctaatcaaaacataagcacagaattaaagtttctaaaatgtatttacattttacccctgtgctaaagaaggaatgagcaataatcgaaagttaatagagttggccgggcacagtggctcacacctgtaatcccagcactttgggaggccgaggtgggaggaggatcactgaggcccacaagtttgagaccaacctgggcaacaaagtgagatcctgtctctattttttttttttwaattttttataaaacaaaggtaacagggttatctttttgtatatttgggaagcggtgatagaggacatgtggatctactgagtcagtccttctaaaaaagaagcttgaagaacatctagagaagctgcatgaggccaataatgaactacagaagaagagagccattattgaagatctcgmgccaagatttaacaacagctcct

SEQ ID NO: 18846 - DNA, 401 bp, Homo sapiens
acaaaatagttgtgttatctacagactgtcactttttaacaatagcttgactttttttggtcttttaaggtctcatacaaatgtttgcaaaaaagagtatttacttactatttcttttcacttaactttctcctgcccctgtccttggctgtaagtgtgtttgtgtttcttcctaataaaatgaagtgggtgtgtctcttagctgttttcattgtgaaacttttattcttttggtccctgaagtattgcatttctttggcttcttctaaacttatgtagcctatggagctatttatctggtctgttgtgatggagatgagaggaacatttggatttcatttaacttcttagttgcctttggaggcaatggaatttttactggataaaaagacaaacttatg

SEQ ID NO: 18847 - DNA, 352 bp, Homo sapiens
aaagtcccagcaagaaaagaaggaaaaggaatgccaagcagtcatgttagcagtttgaaggggctggagcaagatggaatcaggaataaggagtcagtgggaccatgtacaacactggaagacacgtatcccttcgcctggacaaggagcacttggtcaacatatctggagggcccatgacatacagccaccggctggaaggagatccgactacactttgggagtgaggacagccaagggtcggagcacctcctcaatggacaggccttctctggggaggtgcagctcatccactataaccatgagctatatacgaatgtcacagaagctgcaaaagagtccaaaatggatt

SEQ ID NO: 18848 - DNA, 416 bp, Homo sapiens
agttctcgcgaggtttcgtcttcccggaagcgttggaggacattccctgttgactgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccwtgaaagaagaagatgragaagaaatagttacctatgatcgacaaaatcaaagggacccttaggaggagagtgtgtcattttctaggggaaaaaagaagttttcagtgcctcagctcttgccaggctgaagagacaaagttgtgtttatcttgaaaagtctttcagtgcgtggtgccacttgtcctggagaacacaccagcctctgcccctgcactgt

SEQ ID NO: 18849 - DNA, 489 bp, Homo sapiens
agcttagctaagtcatctggggcagtggggcacaatccacagatctaccatcattatggaaagatggtcctgctctgttgtgttttcaggaaaaacgaaagggctcccaggcctgcttgatgcttccagatgcctggtgacaggaatcaagaaccagggaaaggcctcaggatgctgagttcagaaattgtgacgatcgaggggtgagaaatcgagagcagatgaggaagctggttctcgtcaagattaactgacttgccccaaattacacaacctgtaaatgcataaggaggaaccacatcaattatctgcctctgaggcacacatttaaaacatttcctctgctgctttcatttcctaatgtcctggggccaacctgaggctcatctgagggaggtgtctgagcttcatgcaagagaccttgatgtgttctaatggctaatgcagagtctttgctcacatgtctacatactgagtaccatgctgaat

SEQ ID NO: 18850 - DNA, 80 bp, Homo sapiens
ctcttcctgtctgtaccagggcgrcgcgtggtctacgccgaktgacagagacgctcaggmtgtgttctcaggatgaccga

SEQ ID NO: 18851 - DNA, 357 bp, Homo sapiens
agaggtgggcggctttgaccgagaggctgctggagctcgtgtttggacgcgatgtttcgtctgaactcactttctgctttggcagaactggctgtgggttctcgatggtaccatggaggatcacagcccatccagatccggcgaagactaatgatggtggctttcctgggagcatctgcagtaactgcaagtactggtcttttgtggaagagggcccatgcagaatctccaccatgtgtagacaacctaaaaagtgacatcggtgataaagggaagaataaagatgaaggggatgtttgtaaccatgagaaaaagactgcagatcttgcccctcacccaaaaaaaaaaaaaaaaagg

SEQ ID NO: 18852 - DNA, 360 bp, Homo sapiens
acttcaattcagactaggccacgaagctccttagtgaggagctgccatgctgggccatccaccatctggattcctacgactcagggaatagaacactgcaccttccagaagcacttgtttcttcgtgggtacaccaccagctgagaaagaagcctcatgatgattgttgtcttatggatgcttctcattgcaggaaccatgtggaagggatataaatatcccccaggagggactccagtggaagtaagcaaggatgatcctggtgaagtaatgcagctgtgaagctcacctgaccagctgtacagttcctgttgttggtttcacataaagtaattgcacattaaaaaaaaaaaaaaaaaa

SEQ ID NO: 18853 - DNA, 360 bp, Homo sapiens
gactaggccacgaagctccttagtgaggagctgccatgctgggccatccaccatctggattcctacgactcagggaatagaacactgcaccttccagaagcacttgtttcttcgtgggtacaccaccagctgagaaagaagcctcatgatgattgttgtcttatggatgcttctcattgcaggaaccatgtggaagggatataaatatcccccaggagggactccagtggaagtaagcaaggatgatcctggtgaagtaatgcagctgtgaagctcacctgaccagctgtacagttcctgttgttggtttcacataaagtaattgcacattaaaaaataaagaaaattccttaacctttg

SEQ ID NO: 18854 - DNA, 377 bp, Homo sapiens
agactaggccacgaagctccttagtgaggagctgccatgctgggccatccaccatctggattcctacgactcagggaatagaacactgcaccttccagaagcacttgtttcttcgtgggtacaccaccasctgagaaagaagcctcatgatgattgttgtcttatggatgcttctcattgcaggaaccatgtggaagggatataaatatcccccaggagggactccagtggaagtaagcaaggatgatcctggtgaagtaatgcagctgtgaagctcacctgaccagctgtacagttcctgttgttggtttcacataaagtaattgcacattaaaaaaaaaaaaaaaaaaaaaaaaaaaaaaaaaaaaaaaaaaaar

SEQ ID NO: 18855 - DNA, 382 bp, Homo sapiens
agactaggccacgaagctccttagtgaggagctgccatgctgggccatccaccatctggattcctacgactcagggaatagaacactgcaccttccagaagcacttgtttcttcgtgggtacaccaccagckmagaaagaagcctcatgatgattgttgtcttatggatgcttctcattgcaggaaccatgtggaagggatataaatatcccccaggagggactccagtggattaagcaaggatgatcctggtgaagtaatgcagctgtgaagctcacctgaccagctgtacagttcctgttgttggtttcacataaagtaattgcacattataaaaaaaaaaaaaaaaaaaaaaaaaaaaaaaaaaaaaaaaaaaaaaaar

SEQ ID NO: 18856 - DNA, 383 bp, Homo sapiens
  misc_feature 296: n=a, g, c or t
acttcaattcagactaggccacgaagctccttagtgaggagctgccatgctgggccatccaccatctggattcctacgactcagggaatagaacactgcaccttccagaagcacttgtttcttcgtgggtacaccaccagctgagaaagaagcctcatgatgattgttgtcttatggatgcttctcattgcaggaaccatgtggaagggatataaatatcccccaggagggactccagtggaagtaagcaaggatgatcctggtgaagtaatgcagctgtgaagctcacctgaccnvctgtacagttcctgttgttggtttcacataaagtaattgcacattaaaaaaaaaaaaaaaaaaaaaaaaaaaaaaaaaaaaaaaar

SEQ ID NO: 18857 - DNA, 427 bp, Homo sapiens
  misc_feature 114: n=a, g, c or t
aagatttcagcttctccactagggagttgtggatcctttggagccaaagactcgaacagacatgcgagacctctaccaactgaaggtttcgtgagcgcactcctttgccaagwncttggtgaataatctttcactgtgcaattttatcttagaaattgttttacgtttgatcatgattgtgcttggctggatgttttttgttggacttgtgtgttacatgggcacgtttccagagttgatgcctccaactctgaagtggcaggagaggtggcctgttcaggagagcaaaacacaactgagtaggcgggctttaggtgaagatctgctgcagaaccatgtggaagggatataaatatcccccaggagggactccagtggaagtaagcaaggatgatcctggtgaagtaatgcagctgtgaastcacct

SEQ ID NO: 18858 - DNA, 391 bp, Homo sapiens
acttcaattcagactaggccacgaagctccttagtgaggagctgccatgctgggccatccaccatctggattcctacgactcagggaatagaaaactgcaccttccagaagcacttgtttcttcgtgggtacaccaccagctgagaaagaagcctcatgatgattgttgtcttatggatgcttctcattgcaggaaccatgtggaagggatataaatatcccccaggagggactccagtggaagtaagcaaggatgatcctggtgaagtaatgcagctgtgaagctcacctgaccagctgtacagttcctgttgttggtttcacataaagtaattgcacattaaaaaaaaaaaaaaaaaaaaaaaaaaaaaaaaaaaaaaaaaaaaaaaar

SEQ ID NO: 18859 - DNA, 485 bp, Homo sapiens
actacatcctattgtcaccaccattgaaatacatttggaatcttaagatcaaggaggagattgtggttataaatgtctgatggcatctctacatctcaggtgaagcatggaggatttcacagatgaaccttttttccagtccctaaagcaacacttgttgtccaccatgtatcagcagaaagcagtctgaggaaactggccaataaggaagcttacactcaaacaacaacttcagactcaggtattgaggataatgagcaagcaaggctctctcagagatcaaaggcaggaaccatggagaagaaaatataaaggagtttccagtagagaatcacaggcatcctgatgagataagcaaggaaccgtccacatatttaatatatatatatatdykgtwtgatctaagtgtaaactgaatttatgttttaagaagtgaaaacaattacactgtgaatgttaaaaagaatgattaacataactattaa

SEQ ID NO: 18860 - DNA, 335 bp, Homo sapiens
agagggcgggccttccgggacgagggcgcgtgggtgaggaaggtcaggtctagtttccatcacagtcaggcatgatcgattcaggtggagggagttgaagattgttcttgatgaactgaatgcagctaatacattttcagttgccgttgatgcctctatgactccgtaaaataatcggaactctaactccttgccactcaagaaatgtcctccctttcagaatatgccttccgcatgtctcgtctcagtgcyyggctatttggtgawktytccaggcctactaattyyaagtctatgaaagtkgtkaaactgtttagtgaactgcccttggccat

SEQ ID NO: 18861 - DNA, 453 bp, Homo sapiens
gttgactggaaatactaactacatctgatcagttcttgccttagatctagccaaatgacaaagttttattctgaagtctttgaatgaataggatggaatcacatcatatctacttttgtgttagaaaatgttggactgtcaaaaacgactcatcaacaccttctttcatggcaacaaacctctgtgaaatgccactatctgtagagcacagtgacagagtctgcaaatgaagaaaagataaagacacagcatataccttttgggggcctcaagaggaagaaggaatacttctaagagacttttttttaaaagagatcaaactggcaaatacaggatcccatagcccttcgaaggagacatgtgcatgcaggctcctgtgtggggtccacagaggttttttctgcaagcaatgctgcttatcaagagctgcctggagctggtgactcagagaat

SEQ ID NO: 18862 - DNA, 501 bp, Homo sapiens
atccggttgtttgaagatgcacggcccccacaccccctttcctctgcttgctacgggtctggccatgtgaagtgcctgctcccgcttcaccttccattactttcctgaggccttcccagccatgcttcctgggcagcctgcagaactccagcacttgaagtttcaaaaacgaggatcaagccgttcctgggagcatcctatgagacatttggacacaggtttacttggagtctcggagatatgacggaatctggaaaagtcaaaggraaaaaagccaaggttaatggaattcaagaacataaattcaagcagggacgatatagtgaaaacactactatctccataagtcagtctttttaattgcctaaagttttaaccaagtcccggagctttggctaatgatgaaagaggtaacagaacaaactcaagtctcttgtcgagcagatggagctggtggattccaggacactccccaagggagccagggatgaccatctacgg

SEQ ID NO: 18863 - DNA, 353 bp, Homo sapiens
aaaaactgtcatggcgctggcgggcgtgtcctatgctaatgagcaatgagggcggctagggattgcttttgtcgccatctgctggtttccaccggtttcttcacttcatcctgtgtggaccatcttttggtcagcaggactgtgaccagaagacaagtcctgccagtctcctacctcatttccaagagacaaaaagataggatgtgcagcggaatagaaaaaagacttagaaaacatattttaaacatctaatgaacatgttgtcagacacccagaaggaggagtgagagaatgggcagtgacaaaattgaagatggagtggctggaaagaggaccttcacagcaccacccac

SEQ ID NO: 18864 - DNA, 220 bp, Homo sapiens
aaaaacgatggaatgccgagtgttcctaggttctcatttctcccttcgctctcctcagacattagaaatatctaatttaccgggtaggaaagcactcaagaggtttcvtcaacactacctaggaggagtgacagcagcaagtcaggccttcttcctcaagctctcactgcacgttctcaaggctgccaagaaaagaaaaaatagaagagaaaaaaacaaa

SEQ ID NO: 18865 - DNA, 228 bp, Homo sapiens
aaaaacgatggaatgccgagtgttcctaggttctcatttctcccttcgctctcctcagacattagaaatatctaatttaccgggtaggaaagcactcaagaggtttcctcaacactacctaggaggagtgacagcagcaagtcaggccttcttcctcaagctctcactgcacgttctcaaggctgccaagaaaagaaaaaatagaagagaaaaaaacaaaaaaaaaaa

SEQ ID NO: 18866 - DNA, 177 bp, Homo sapiens
aaggagcccagctgacttcccccagtggatcgttttagggctgcaggcggastgcccaccactcctatactgtggcgaggggcagggagcatctgtcggggagcccaagcctcaggcaggtccttcaggagggattccagaagaaggcattgttatcataggagatgacagctccat

SEQ ID NO: 18867 - DNA, 446 bp, Homo sapiens
aaaggcggcgtgtccggagtttgttccttctgatgttcagatgtgttcggagtttcttccttctggtgggttcgtggtctcgctggctcaggagtgaagctgcagaccttcgcggtaagcacattaatcattccagtgtaatcagactgcatcaagattgtactccttctacttataaaaaagacttagctgtagaacagcctcaggcaagtccttcaggaagtattccggaagaaggcattgttatcataggagatgacagctctatgaatgttattgcccttgaagaccttccagtgggacaagacgcagaggtgacagacaatgatactgatgatcctgaccctgtgtatgcctaggctaatgtgtgtgtttttgccttggtttataacaaaaaagcttaaaaaataaaaaggttacttttaaaaaatgaaaaaaaaaaaaaa

SEQ ID NO: 18868 - DNA, 220 bp, Homo sapiens
aaaaagtcttggttgtgaaaaacgatttgcatttgggtaaaataaagtgaccatgcttttgttctgtaatactgtgtgacctgtggttgttgtaatggtgatcatggagagcaaatatgaacttggcctggattttaaatggcctagaatttgtggtagttgccaaagaggttctcctaggtggtcttaataaacctattcacgaaaaaaaaaaaaaaaa

SEQ ID NO: 18869 - DNA, 716 bp, Homo sapiens
aaaaaggtccacatggccctggttttgaccagttttccaacagtttcaacgttatgtatttcaacttcccgtctcagttcactggcgtctgcacccgttgccgagtgtgggtggctgagccctgggtgacagcactcgggaccacgcacccatacccttctttatgctcgttgtcagccagttgcsaagagcgggagtgaagagcctgcaasccgggagagcgcggattccggagtagggaggcgagggggcagcgtgggagaccagagggaaaatgggctgaaaagcaacaaaaaaaacaacgtaaattgggctttsctctggctttacaaaggcagagattgtcgagccctctgactgtctttgtsccttctttatcccgtcctttgtgaaataagccgttttctgcccccactgcaggagcctaggctgtgggcgactcgctagcactgccctgggcctccaagctgcctgctcgctgagctcagcgctgacactcacaggagctgcgttcgccgcatcctctgagaggctctgcaacgatcccgatccaattcagcagcgttttaaaaggaaactcgtgcagggccactgaaaagtcaggggaggctcagatgttatttcccacggattcctgtttttccagaaacgttgtcaccaaataagtatgagactgttaatttggagaaacaattagcccctgcaaaaaaaaaaaa

SEQ ID NO: 18870 - DNA, 250 bp, Homo sapiens
gttccctttcgtactcaaagctcgtgcatccagggaggggaaaccggagatagggtcttcgggccccgggcagaccctctgtgccgctgcaaaccgttgcagcctgaggctgtcaggtcctcccccagacacctgyggaccctccctctcctggcttcccgtctggtcatggcgagattctgggtctgcgtmscggtgctggcttctttcttgcattttttgaatgcaaaaccaaaaaaaaaaaaaaaaa

SEQ ID NO: 18871 - DNA, 238 bp, Homo sapiens
gttccctttcgtactcyaaagctcgtgcatccagggaggggaaaccggagatagggtcttcgggccccgggcagaccctctgtgccgctgcaaaccgttgcagcctgaggctgtcaggtcctcccccagacacctgcggaccctccctctcctggcttcccgtctggtcatggcgagattctgggtctgcgtmscggtgctggcttctttcttgcaaaaccaaaaaaaaaaaaaaaaa

SEQ ID NO: 18872 - DNA, 269 bp, Homo sapiens
gttccctttcgtactcaaagctcgtgcatccagggaggggaaaccggagatagggtcttcgggccccgggcagaccctctgtgccgctgcaaaccgttgcagcctgaggctgtcaggtcctcccccagacacctgcggaccctccctctcctggcttcccgtctggtcatggcgagattctgggtctgcgtascggtgctggcttctttcttgcatttttggttttgcattckcgtttttgtggctcaaaactggagagccacaaaaac

SEQ ID NO: 18873 - DNA, 300 bp, Homo sapiens
gttccctttcgtactcaaagctcgtgcatccagggaggggaaaccggagatagggtcttcgggccccgggcagaccctctgtgccgctgcaaaccgttgcagcctgaggctgtcaggtcctcccccagacacytgcggaccctccctctcctggcttcccgtctggtcatggcgagattctggrtgcttaggccaacccacatccagccggtaaagaattttctcagttctccaggaaactgcaaaagtaaagttcctcaaaactggagagccacaaaaacgcgaatgcaaaaccaaaaa

SEQ ID NO: 18874 - DNA, 490 bp, Homo sapiens
aagtccggaactggtcttctgtgattttcattcgccctggtctctgttccctttcgtactcaaagctcgtgcatccagggaggggaaaccggagatagggtcttcgggccccgggcagaccctctgtgccgctgcaaaccgttgcagcctgaggctgtcaggtcctcccccagacacctgcggaccctccctctcctggcttcccgtctggtcatggcgagattctgggtctgcgtascggtgctggcttctttcttgcatttttggttttgcattcgcgtttttgtggctctccagttttgaggaactttacttttgcagtttcctggagaactgagaaaattctttaccggctggatgtgggttggcctaagcacccagaatattttaccggaacaacattttgtgttgcagttgactccctcaatggattggtttacataggtcaaagaggggataacatcccaaagatattagtgttcacagagga

SEQ ID NO: 18875 - DNA, 482 bp, Homo sapiens
tttacaaagacaatgttcttcagcttgcaagacagtgaactgactaatattaagcatagctaaagaaataatgtgaaaatcaggagcatggtggtcagcttggggattagagtcataagaaatagaaaatataaggaacagttggcaggaccctccaaaccattgtccagaggagatgaaataatcccccttctattggtgggaccaatcccatcatgtccaccaacctgaggaggaagggctggttatacaatccatgagtgttcctgttcctgggagaggacagaaggggtttcaccgtgttaggcaggatggtctcgatctcctgacctcatgatctgcccgccttggcctcccaaagtgctgggattacacgcaagagccaccgcgcccggcgaggactgaatttttaacagcaggtgactcaggaagagctccaaatcacagcaagtacctgttgaccatgactacttatattgctg

SEQ ID NO: 18876 - DNA, 425 bp, Homo sapiens
acgtggtggctgggccggggaaatggcggcttcaggagagagcgggacttcaggcggcggaggcagcaccgaggaagcatttatgaccttctacagtgaggtgaacacagagtgaggagtagtggcaccggggcgaccgctcccggatctgctttcccagtggacaaaggcagtggccgcctggcctggaccgttgggcgattccttcagtccagtcttcggggtggcgggggtctgggggtgtgtgagcgtctcccactgatagctgctgggagatcccccggggcaacgaaagagggaatggtgttcgatctatcgagggaggtggcgagtgtgtccaacatagtgcgggcgcgcgggcagagtgcccaagtccgcggagtcgggggctggcagaggctgggccttcctgggagtgacttagc

SEQ ID NO: 18877 - DNA, 501 bp, Homo sapiens
aacttggctatagttttctaacagccttgtctacacatgtaaccagtttactcttaagtccctggattagttagtcaaaaggtgctctagagaaacagaaccaaagaatgtgtatacagaggcatatttattacaaagaattggctcatgtaattgtgaaagcttggttaaggccaaaattaagcagggcagagacttaggaaagagttgcagttgtgttcaaaagcagtcagctggctgaatttatcctcacttggaaaagcaagtaaagttgaggatgtattgtcagatccttgtacagaagaaaagaagtgaaaataatgaaaacaatggcaagagaagttactatttcccagaggaaaaacgctgctgtaaaaggagctcatatattttagctgtggtgttaattttgaagtcagcatgagtcattaaattaaagtattgtaatttggaaatatatttaaaatgaaaagamataaaaaagagtactagaaaatggaa

SEQ ID NO: 18878 - DNA, 476 bp, Homo sapiens
aacttggctatagttttctaacagccttgtctacacatgtaaccagtttactcttaagtccctggattagttagtcaaaaggtgctctagagaaacagaaccaaagaatgtgtatacagaggcatatttattacaaagaattggctcatgtaattgtgaaagcttggttaaggccaaaattaagcagggcagagacttaggaaagagttgcagttgtgttcaaaagcagtcagctggctgaatttatcctcacttggaaaagcaagtaaagttgaggatgtattgtcagatccttgtacagaagaaaagaagtgaaaataatgaaaacaatggcaagagaagttactatttcccagaggaaaaacgctgctgtaaaaggagctcatatattttagctgtggtgttaattttgaagtcagcatgagtcattaaattaaagtattgtaatttggaaatatatttaaaaaaaatgcgaa

SEQ ID NO: 18879 - DNA, 319 bp, Homo sapiens
agaatgttgatctctctgttggaacacaacttggctatagttttctaacagccttgtctacacatgtaaccagtttactcttaagtccctggattagttagtcaaaaggtgctctagagaaacagaaccaaagaatgtgtatacagaggcatatttattacaaagaattggctcatgtaattgtgaaagcttggttaaggccaaaattaagcagggcagagacttaggaaagagttgcagttgtgttcaaaagcagtcagctggctgaatttatcctcacttggaaaaggattctgtccctatagtcctctcaagcagc

SEQ ID NO: 18880 - DNA, 563 bp, Homo sapiens
atacacgagatcaccgaaaactcctcctttctcccattgttcctatgaggtgggtggggactccaaaacccgtagctcctgccctactaggccactctaccccattttccccacactcaccggagccaaagccgcgacccttccgtttcttcgctttttctttcagtttgtgaatgctctctggaaccccagaagataaaagaataagtaactatgacagtcatttgtaacaatcgtctctttcccaatacactaccagcaagccgacccacaccgcctccagtcttagtgccttcccggtcacgccctcccttctcctgaagggggcggaatctctaatccacccaagacccggttcctcgattcccaaccttacgaccgaggaaaaaagagtaaattttcctattatagccttctctcgcaccttccccgcttcccaccagccgtctccactgtcctcaccgtccccatcctcatccatggcgaaatcttcgccccagcctcgtgaagatctagcacgtccgcatctcgcttcgatcgagatctcgtctgtgccgctcaga

SEQ ID NO: 18881 - DNA, 460 bp, Homo sapiens
  misc_feature 195: n=a, g, c or t
ataatcctcacgcatccggctcgggacccctcttctataagggacatacacgagatcaccgaaaactcctcctttctcccattgttcctatgagtttgtgaatgctctctggaaccccagaagataaaagaataagtaactatgacagtcatttgtaacaatcgtctctttcccaatacactaccagcaagccgncccacaccgcctccagtcttagtgccttcccggtcacgccctcccttctcctgaagggggcggaatctctattccacccaagacccggttchtcgattcccaaccttacgaccgaggaaaaaagagtaaattttcctattatagccttctctcgcaccttccccgsttcccaccagccgtctcsactgtcstcaccgtccccatcctcatccatggcgaaatcttsgcccccagcctcgtgaagatctagcacgtccgccatctc

SEQ ID NO: 18882 - DNA, 461 bp, Homo sapiens
acaaatattttgtaccagtggctcatgctcactgcagagaagctggactggataatgactgcaagattttcttattccttgacaactgttctgctaatctttcaggtgaaattttcatcaaaaataatatctatgccatgtactttccccatattgacttaatcaatttagccatgtgaccagggtatccttagatcaaagaagagtaaatataaaaacgctttcttgagtagcacgctagcagcagtgaatagaggcacaggtgtggaagatttttaaaaggagtttagcatgaaggctgctgatatgctgtcaccaacacctggaacacagtgactaaagacacagttgtgcatgcctgacacaacctctgtcctgtaactatgttcagtgatgatgataaacaaggtggtgactttgaatgactcatatgtcaagtagaaaaaaaatgacgtcttacc

SEQ ID NO: 18883 - DNA, 485 bp, Homo sapiens
aagaataaaaccataagagataaaaacggcaacaatgggcacccaatgccaacggtcacaacaataaagatgaccaggacatttatgtaagagccgttgcaggagagctcaagaaggggaaggatgtcacacatgtagtgattgacaaggttgtctgcacaaaaggtgagaaacactatatttcctgtatgagccacagccccaaaaacccccatcccgtagacacccagtaaaaggagcaaacacacctggggagacatggtgaccgtgtacaacaatgggttacagatggccacgtagcggtcctacgccatcgccgacagatgaaggactcagaaaagacaaagaaacagaagaagaagaactgactcatacaccctgtgaaggaaataatgttcttccttgagacaaaactcatcagcattttgggaatgatggtcgtagagaaactaaaaatctacgagggacaagttgaaggggaaaaa

SEQ ID NO: 18884 - DNA, 496 bp, Homo sapiens
agaaggctgtgtatgctctgaatctgtgtccaatacatggtgcagtttctcccatagccaggattcacgggtccaggaatcaagaggtggaagtggaagtggcaccattcatcattatccctagtgaccccctagcaacatttttacttcctgttcccgcgacattatgttctgctggcctagaggtctcagttccagagggaggaatgtgccaccaggagacacagcaacaatgccattgagttaagattgccacctggacactttgggctcctcctacctttaaggcaacagactaagaagggagttacagtgttggctaaggtgactgactcagactatcaagatgaaatcagtcgactactccacgatgcaggtaaaaaagagtgtgcatgaatacaggagatccattagggcgtttcttagtattaccacgctctgtgattaaggtcaatgggaaactacaatagcccaatccaggcaggactacaaatgg

SEQ ID NO: 18885 - DNA, 936 bp, Homo sapiens
gaatctaattaaggcgagtgctccagagtcgggtctgctttccaaagtataggacatttgaagaactggtatgctactcactggtgaaggacagtcaggtgaaggactgtaagcccacacaagctcttcttatctctactagaattaaaatgttaagtcaaaaacggctccttttttgcgcctcctagtgaaacttaaccagctagaccatttgagtaccagcatttagttacaaacgtcaaaggcttccggtgctgcttaccttccttttttgttaatgtgcttttatttattaaaaaaaattacaatgaagatgcctgttttgtctctactatgtactctgatcgtatctttccaaagtgcagactcttgtgaagttttcttaaattgttcactttaaagaaaatgacgtaccaacaatgatttggcttttatattactgtaagatgttataatgttaatgtggatgtagtgcttttactttacagattgattggaataagattattgcatatgaatttacccacaggactctgaatcatgttacccactcccctcacaatgttgtccacttagtgagttgcattgatctatccgtaccaaatgatgttgaataattacatatctttcttgactatactgatttcttattttggtcactattactaaatctctgttaatattctctcttttaactgaaaagggatgggatagaagggtttgcaatgccatattattggtggagggctgttttaacatctttgaagtatggcttgctgaatatctttaccaacatcttgaatatatattctagtgtccacaagatttagcaaaaagataaagcttgggtggaatatcattttaaaatgttcatgttctgttctatattttcttcacctactctccaaaatattttgtaatgcaaaaagtctcagt

SEQ ID NO: 18886 - DNA, 477 bp, Homo sapiens
ctcttccgccgccattttaaatccagctccatacaacgctccgccgccgctgctgccgcgacccggactgcgcgccasacccccctgccgacagctccgtcactatggaggatatgaacgagtacagcaatatagaggaattcgcagagggatccaagatcaacgcgagcaagaatcagcaggatgacggtaaaatgtttattggagcgtgaagggcctggtggcggtaataaccggagagcctcgggcctgggcctggccacggcggasgacttgtggggcagggagcctctgctgtgcttctggacctgcccaactcgggtggggaggcccaagccaagaagttaggaaacaactgcgttttcgccccagccgacgtgacctctgagaaggatgtgcaaacagctctggctctagcaaaaggaaagtttggccgtgtggatgtagctgtcaactgtgcaggcatcgcgggtggct

SEQ ID NO: 18887 - DNA, 138 bp, Homo sapiens
  misc_feature 48,120: n=a, g, c or t
aggcagcagcaacgcgaggaaacgggagtgaacggagagcgtagtrrnccatcatgagcctcctcaacaagcccaagagtgagatgaccccagaggagctgcagaagcgaagaggaggangaattttttaacaccggt

SEQ ID NO: 18888 - DNA, 136 bp, Homo sapiens
aaacaaaagattctagcctgaagaagagcagaatcaggtaaatctaaacaagtgagatttcattacgaaggagcctagaataggtattgttccttagactttttgatgtagttttctctgccggtgtttgtgtcct

SEQ ID NO: 18889 - DNA, 449 bp, Homo sapiens
tgaaataagaatgagtcagactacatatttggtagccagatttttttcactcagtgatatatcatgaacatatttccatgctaatataattttctaataattttagatgctgtaactacaatttcattgttaatgggcaatttgttgctttacaagtggtaaattatatgataaataatatgatcattattcttgtagccaatatcattattagaaatgatggaccgcattaaagctataaaattaaataagaatttataaatgtaaggagttattcagacatcttgtatctagtattacaatatcagaaaactcagcaggttatatgacatatacactttgagatagtcactcagaggttttcacatacaggattaaccttgctgcagtgcgtgtgcaagattaaaaaagatgtcatgggtcactttgtaatgtcatatcgttgctgt

SEQ ID NO: 18890 - DNA, 467 bp, Homo sapiens
taacctctccgtgcctttgtttctctacccatatggactggaaataggatatcaatcagcccgaaatgggggctgtcacatattaagctatcgacacatatattagacaaattgtaaagaatgtcttatggtatagaatcaagtttaataaactttttttttcccgtaaaggtcaggcagtaaatattgtgggctgtggttgtgggctacctatagtctctgttgcagttcctcggcaatatcattgtagcacaaaagcagccacagccactacatgggcaggtgggtatagctgtgttccaataaaacttaagtaacaaaaacgggttgtgggatggatttgacctgtgggctatagtttaccatgtgtttagaatatggactgtgttccggctgttacaggttcatgtgtgttacagggttgggtgtaggggactcattcatagtttttacattaatagccccta

SEQ ID NO: 18891 - DNA, 502 bp, Homo sapiens
atgatttatctggttcaaggaagatgcactattcagttatctattgagaaattattttgcagtggttttagtgggtgaaaatgtcccatctgcaccagtacacaggcaggcattatcattcttcacctactttttaaatagtggcaacttgggattcattctggtgattctgaaccttgcctcatagcttaaagtataaaaaagattcaagagcagtgaggtttgttctttccagtgaatggtggactgagtggtgcgaggtggagggctaacaagaggaaagaactacattcttcagaatacagtgatgaaaattcattttgaaactcaaatattttcattttggatattctcctgtttttattaaaccagtgattacacctggccatccctctaaatgttctaggaaggcatgtctattgtgattttgatgaagacagaattatttttctctgtagaaacacagataccactttatcagggaagttagtcaaatgaaatg

SEQ ID NO: 18892 - DNA, 524 bp, Homo sapiens
aatattttcgaatgcttgagaaaactctgtacttatggaaatgtcccatgttgcactatccaatatgatagtcactaggcacatgggctgttgaacaatagaaatatggctaatgtaattgagaaactgaaaatgtaatttacatgtacatttaagatgaaatagccagacatggctactattataatggacaacacatttttacaaattatgagttgactttattataccagcctctatctcatacttccttattatcttcaaaacacaatcgatcaggaacaaaaacgtaatctcaagcttctagaaatttggcacactcaccaaagaactgaatactcctttgcagtcagaccatgtgttccagacaacataactagaaagatgtgagaaggcacttcatgtgggagataagccttgttttacttaatccactgagatgtcagagttaattgttacagcagcagcctgttgtataggctgactaacacatggtaactaacagaacactttggattcttgac

SEQ ID NO: 18893 - DNA, 250 bp, Homo sapiens
aaacaaaagattctagcctgaagaagagcagaatcaggtaaatctaaacaagtgagatttcattacgaaggagcctagaataggtattgttccttaractttttgatgtagttttctctgccgtgtttgtgtccttgcttatattttcaaatgaactccaggttacagggaaggctgaaaaaaaaaaaaaaaaaaaaaaaaaaaaaaaaaaaaaaaaaaaaaaaaaaaaaaaaaaaaaaaaaaaaaaaah

SEQ ID NO: 18894 - DNA, 409 bp, Homo sapiens
  misc_feature 57: n=a, g, c or t
agaaggagaagcgcgcttttttccctggcgggggatttggctagaaggctgggccgncagcggttgtgaggagttagctcgcggcattgcaggctctgagaggaggggacccggttcccggtggagtgtccaggcatgccagcggaacggcccgcgggcagcgcggctcggaggctccarcaatggttgaacaactggacactgctgtgattaccccggccatgctagaagaggaagaacagcttgaagctgctggactagagagagagcggaagatgctggaaaaggctcgcatgtcttgggatagagagtcgacagaaattcggtaccgtagacttcaacatttgcttgaaaaaagcaatatctactccaaatttttattgacgaaaatggaacagcaacaattaga

SEQ ID NO: 18895 - DNA, 426 bp, Homo sapiens
cttctgtccacacacagctctgcaaggagagtgtcttcattctttccgccatcttgattctttgtcactgaccgagactcagccgtattctattttcagtgggaaatatgagtgagcatgtgagaacaagatcccaatcctcagaaagaggaaatgaccaagagtcttcccagccagttggatctgtgattgtccaggagcccactgaggaaaaacgtcaagaagaggaaccaccaactgataatcagggtattgcacctagtggggagatcgaaaatgaaggagcacctgccgttcaakggcctgacatggaagcttttcaacaggaactggctctgcttaagatagaggatgagcctggagatggtcctgatgtcagggaggggattatgcccacttttgatctcactaaaagtgctggaagca

SEQ ID NO: 18896 - DNA, 284 bp, Homo sapiens
  misc_feature 75..76: n=a, g, c or t
gcagaagggaaacgtgaagaaggtgaagatggcggtggcagggccggggtcttgggagtccagtggctgcaaagnncatcccggaacgtgatgccgctgggcgcacggacagcctcccacatgaccaaggacatgttcccggggccctatcctargaccccagaagaacgggccgccgccgccaagaagtataatatgcgtgtggaaracttacgaaccttacccggatgatggcatggggtatkgcgactwacccgaagctcccttgaccgctcaacaagcaa

SEQ ID NO: 18897 - DNA, 344 bp, Homo sapiens
cttctcgcctaacgctgccaacatggtgttcaggcgcttcgtggaggttggccgggtggctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatggagcaaaaagtaaaatctttaacccaagtctatgagtccaaacttgaagatggtaacaaaggacag

SEQ ID NO: 18898 - DNA, 412 bp, Homo sapiens
acgcgtgcggcctccgccgctggagctggatggctgatgcggctcgtggtccgagagccttgtcctgccgtgtgggccttgcggacctgggagctggcgggcgttgggaaccgggcttaagctactgaggcgtttgctgatttcgtccatccaggtgttcaggcgcttcgtggaggttggccgggtggctatgtctcctttggacctcatgccggaaaattggtcgcgattgtagatgttattgatcagaacagggctttggtcgatggaccttgcactcaagtgaggagacaggccatgctttcaagtgcatgcagctcactgatttcatcctcaagtttccgcacagtgcccaccagaagtatgtccgacaagcctggcagaaggcagacatcaatacaaaatgggcagc

SEQ ID NO: 18899 - DNA, 378 bp, Homo sapiens
acatgcgcagggttgggcgggtcttcttccttctcgcctaacgctgccaacatggtgttcaggcgcttcgtggaggttggccgggtggctatgtctcctttggacctcatgccggaaaattggtcgcgattgtagatgttattgatcagaacagagaccactggaaggagtcagataggaaagatggcaaaaaggatcaagactccagatctgcacctgagccaaagaaacctgaggaaaatccagcttctaagttcagttctgcaagcaagtatgctgctctctctgttgatggtgaagatgaaaatgagggagaagattatgccgaatagacctctacatcctgtgcttttctcctakyttctctccaccctggat

SEQ ID NO: 18900 - DNA, 351 bp, Homo sapiens
  misc_feature 333,345: n=a, g, c or t
agcaacggggtttcctgaaccttcgggccacccgaatccaccttctcagacggaaatagaatccagggattcttctacccatggaaaaacgtgcggaggaagcacatgtgggcgctggtctggacgtgcagcggcctcctcctcctgagctgcagcatctgcttgttctggtgggccaagcgccgggacgtgctgcatatgcccggtttcctggcgggtccgtgtgacatgtccaagtccgtctcgctgctctccaagcaccgagggaccaagaagacgccgtccacgggcagcgtgccagtcgccctgtccaaagagtccagggatgtgganggaggcaccganggggaa

SEQ ID NO: 18901 - DNA, 507 bp, Homo sapiens
tgttgttctctggagggggtgctgctgcctctccttgagtagttctgtgacccccaatccagctgtttkgtagagaatccttctagcttctggtatgcctgctctccagcagctggaaacagatcttcctgcctgaccaaagctccttgtttcttgcgtggcatgtttgttcttacccgatccggtggctgtcatagccgagggcctgcctgccaccttcctttatcatttgccctgttggggttcagggtgcatccttagcccaggacctgctcttccagcatcatgggttttttcctaaagatctcaacggctcccttgggctccataaaatatttcttttttaaaaaagcagactcctttcatgcattgggatgaacggccctcttgtctgggtgctgggctacagcaaacaaatgtgtttgaatcccagtattccagagattcctggcggtgggctgtctagaagaggcgaggctggatctcacggttttttaaactgtattt

SEQ ID NO: 18902 - DNA, 271 bp, Homo sapiens
ataaaatgtgctgtaaacctcattatatcataaggattttacctaaagaaatgcatgagtgacccctaaaacactgcagaagttttgactggctatccactttccttctcctgtttcctcactaattttacagaagatagattttctttagaaattcaaacttttgaaattgacgatttaccttatcaaacttaaaaacgtgtgttttgcatctgaaacattttctaggacaccaatacatactgatcaagtgtgagccttacttgatgta

SEQ ID NO: 18903 - DNA, 479 bp, Homo sapiens
aaaaacgttcagaatctcacccttcaggaaaagcgatgggactccgcggtgctccttgcctacgattcccgcactgcccatggggaacgaatcctatatcgctgagcgcttggtagggaatgtggactgtgaccctgagagtcgtccttccctctgcctgagtccttgagcgaaaatattgaatagacagcaattcctgaagtctaaacgcctcccaggactacggaggattattggaaagagaacaagcgaggagatacaatcttcaaggactaaatggggaatgactttttaggggtcagtagatgattgatgattgattactataaactgataatatgaggccaaaactaaaagttggaagagtgagcaagtacaatggtttgggagaggcaatgaagaacaaagaaggtgccagcccctactccagacgctgtggtaccactggtttggcaggaaaaacaatcatcatttgagag

SEQ ID NO: 18904 - DNA, 304 bp, Homo sapiens
agagtctagagcagcctttacagatggttttacagacggttttgcagaaaaacgtttcgctttcccttttttaaaaagatgtaaacatcttcccaggctcctctgacatcagcgtgtcagtgatgaatcatcgggaatctaaacacacgcactagagcacacaaaaccaacgttttcaggctggttcttgcttgcaagtgagagacttcatatgtgatggaacagaggagaggagcccctgggagctgttatatttaaatcaatattaaaaacaaaaattcgaccaccaaaaaaaaaaaaaaaa

SEQ ID NO: 18905 - DNA, 51 bp, Homo sapiens
  misc_feature 41: n=a, g, c or t
agattccggaaaggggaagagcagccagcatgsgcgaacgngcgcgggggc

SEQ ID NO: 18906 - DNA, 155 bp, Homo sapiens
ctttccggcggtgctcgcaagcgaggcagccatgtcttatcccgctgatgattatgagtctgaggcggcttatgacccctacgcttatcccagcgactatgatatgcacacaggagatccaaagcaggaccttgcttatgaacgtcatatgaagc

SEQ ID NO: 18907 - DNA, 155 bp, Homo sapiens
ctttccggcggtgctcgcaagckaggcagccatgtcttatcccgctgatgattatgagtctgaggcggcttatgacccctacgcttatcccagcgactatgatatgcacacaggagatccaaagsaggaccttgcttatgaacgtcatatgaagc

SEQ ID NO: 18908 - DNA, 424 bp, Homo sapiens
atcatagtttggagtgtaggtacagtagccccaggaaccatgctaggggttcagggaagaaacatagactgactagctaaccttgcctgctgatgtcacataaagtgataagaagtattgtggacccctgctaagtgcttttgaccacaactgactctagaaaaaggaggcacatttggatgagcaatgtacccctacagtcctccaggaagtcgtaatttgatrggagacaaagaaacatagccaaggatacaattttaaggtcaccttgaatccttcctggaaaaaagcaggtcataaataataatggttgttggagaaaggtctctaggaaagatgaagaacttttaaattcctagaagcatcttagaaaagataacacaaaaactttatttaatgtaaaaataagagctgagagtcagtt

SEQ ID NO: 18909 - DNA, 51 bp, Homo sapiens
  misc_feature 35,38: n=a, g, c or t
agattccggaaaggggaagagcagccagcatgsgncgnaacggcgcggggc

SEQ ID NO: 18910 - DNA, 361 bp, Homo sapiens
atttttcctggaggaagtttgggaaatgccgatttagcagattcttttgttgtgccgtggatggtgctggttgatgtgggcaaaacaaagaacacctcgcatggtcagtaaaagcaaagacgggactggaagcgatgacaaaaaagccaagggggctgatggtaaaacgaagatcgccacaccgcggggagcagcccctccaggccagaagggcaggccaacgccaccaggattccagcaaaaaccccgcccgctccaaagacaccacccagctctggtgaacctccaaaatcaggggatcgcagcggctacagcagccccggctccccaggcactcccggcagccgctccccgcatcccg

SEQ ID NO: 18911 - DNA, 381 bp, Homo sapiens
  misc_feature 362: n=a, g, c or t
actctttctcgactccatcttcgcggtastgggaccgccgttcagtcgccaatatgcagctctttgtccgcgcccaggagctacacaccttcgaggtgaccggccaggaaacggtcgcccagatcaaggctcatgtagcctcactggagggcattgcccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagagatgtatatttaattttttaactgctgcaaacattgtacatccaaattnaaggaaaaaaatggaaaca

SEQ ID NO: 18912 - DNA, 52 bp, Homo sapiens
  misc_feature 43: n=a, g, c or t
agattccggaaaggggaagagcagccagcatgggtcgtaacgngcgcggggc

SEQ ID NO: 18913 - DNA, 391 bp, Homo sapiens
amtycttttctcgactccatcttcgcggtastgggaccgccgttcagtcgccaatatgcagctctttgtccgcgcccaggagctacacaccttcgaggtgaccggccaggaaacggtcgcccagatcaaggctcatgtagcctcactggagggcattgcccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtaca

SEQ ID NO: 18914 - DNA, 51 bp, Homo sapiens
agattccggaaaggggaagagcagccagcatggcggcggaacgggcgcggg

SEQ ID NO: 18915 - DNA, 333 bp, Homo sapiens
ctctttctcgactccatcttcgcggtastgggaccgccgttcagtcgccaatatgcagctctttgtccgcgcccaggagctacacaccttcgaggtgaccggccaggaaacggtcgcccagatcaaggctcatgtagcctcactggagggcattgcccggaagatcaagtcgtgctcctggcaggcgcgcccctggaggatgaggccactctgggccagtgcggggtggaggccctgactaccctggaagtagcaggccgcatgcttggaggtaaagtccatggttcmctggaccgtgctggaaaagtgagasgtcagactcctaaaggtggc

SEQ ID NO: 18916 - DNA, 447 bp, Homo sapiens
attctcattgctgggtctccactcctagctgttactgcaagtccatgcctctaccatgagggtggaggagttaagatcaacagatccacatgtaccttgaggtgacagactggctctgaacaagttgaaatcatcgcagaaggataaagttcgtcagtttatgatcttcacacaatctagtgaaaaaacagccagcattagtgtgttgattattgcatggaagttcagagcagcaacacagtgcgagttctccaaacaggagttcatggatggcatgacagaattaggatgtgacagcatagaaaaactaaaggcccagatacccaagatggaacaagaattgaaagaaccaggacgatttaaggatttttaccagtttacttttaattttgcaagaatccaggacaaaaaggattagatctagaaatggccattgcctactggaac

SEQ ID NO: 18917 - DNA, 506 bp, Homo sapiens
actcatatacccaaaaggatgggattaaaaactaattacataaaatacttaaaaatgcaacacaagtgcctgttttatttctctgttctcataccataaatgagaatttgtaaaacacattatttcttttaaattgcaaagactattcctgcagtaatttatgagatttatttgctaagaagtctttactaatctgtgggcagaggtgtggcaagtcacttatcaagatatattataacagtgagaaaatccaaagaaaggattgtgctgcagctccttatccagtttctctttcatcctggacatctggagtgttttctgctaatagtaaatgaactttgtttcattacctgtatgaggtttgacgtcatcgaaatagcctgtgtctttttttcagcctgatctgtgccactctgacagtgttgcaaagatggtctgctgtgccacgcctgagcagttagctgttcacagcctggcgcacacacctttaccacatacttttccca

SEQ ID NO: 18918 - DNA, 215 bp, Homo sapiens
acgatatttgctgcgacccgcagcgctatccgctgccgggttctggcgcgccctttcagttctgcttgctgtccgcacsgctgcgttacccggaaccgccgggccgaacagcatgacgtccgctttggagaactacatcaascgaactgttgccgttattacatsaggatgggagaatgattgtgggaacactgaaaggttttgaccaagaccat

SEQ ID NO: 18919 - DNA, 485 bp, Homo sapiens
aagagaaaataccccttcccttggtcacagactgcttgggtcagcatgtgaaccaatgcatacttaggcatgaatagggagagagtgaaaggtaggatgtggagtaaaagagtatttacaggccaggaaaaactactccttcccgaatggaataataaactgcaatatgggtctcaataatgccattagttagctgtgtgaacttggaaacacctcttaacctctttgaaattcagtttttcaattgtactaaaacggaattttgagctagaaggtctcaggtctaagttttatgatattatttcgatagaagaaagtttatggtttgtataaaagtgtatcttgaagatctgggtatgagccagtagctcctgtagaaatcttggaagtctgggctgggcgcgatggctcgcgcykgtwaatctcagcaccttgggaggcctagacaggtggatcgcctgaggttgggagttcgggacagcctg

SEQ ID NO: 18920 - DNA, 52 bp, Homo sapiens
  misc_feature 35: n=a, g, c or t
agattccggaaaggggaagagcagccagcatgsgncggaacgggcgcggggc

SEQ ID NO: 18921 - DNA, 411 bp, Homo sapiens
atcaggtctaaaattgaaacgtggttttaaacatataatttcttgtttattttcctccgtaactacctaaggatcaccacgatgaaygacacsgtaactatcygsacyagraagttcatgaccaaycgacyrctycagaggaaacaaatggtcaccaatgtccttcaccatggaaatgcaacaaaatgtacaagatcataataggtgtcatcttcatattaatagttggactcagaacccatgttggtggtggttaaacaatgggctttggcatgctatctggttctttgaattatgcaaagaaaartgaactcaaacatagacttgcaagacacagctgacatgagaagaaaacgacctcgagaaaacagcaaaaggaatgcaagggcagaatgaagtcaagagactgta

SEQ ID NO: 18922 - DNA, 52 bp, Homo sapiens
  misc_feature 37: n=a, g, c or t
agattccggaaaggggaagagcagccagcatgsgcgnaacgggcgcgggggc

SEQ ID NO: 18923 - DNA, 52 bp, Homo sapiens
  misc_feature 35: n=a, g, c or t
agattccggaaaggggaagagcagccagcatgsgncggaacsggcgcggggc

SEQ ID NO: 18924 - DNA, 421 bp, Homo sapiens
agatagatcgccatcatgaacgacaccgtaactatccgcactagaaagttcatgaccaaccgactacttcagaggaaacaaatggtcattgatgtccttcayyccgggaaggsgacagtgcctaagacagaaattcgggaaaaactagccaaaatgtayaagaccaccmcgggwtgtcatctttgwatttggattcagaactcattttggtggtggcaagacaactggctttggcatgatttatgattccctggattatgcaaagaaaaatgawcccaaacatagacttgcaagacatggcctgtatgagaagaaaaagacctcaagaaagcaacgaaaggracgcaagaacagattgaagaaagtcagggggactgcaaaggccaatgttggtgctggcaaaaagaagtgagctggagat

SEQ ID NO: 18925 - DNA, 51 bp, Homo sapiens
agattccggaaaggggaagagcagccagcatgsgcggaacgggcgcggggc

SEQ ID NO: 18926 - DNA, 52 bp, Homo sapiens
  misc_feature 35: n=a, g, c or t
agattccggaaaggggaagagcagccagcatgsgncgaacgggcgcgggggc

SEQ ID NO: 18927 - DNA, 307 bp, Homo sapiens
ctggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagtgagctggagattggatcacagccgaagagtaaaggtgctgcaatgatgttagctgtggccactgtggatttttcgcaagaacattaataaactaaaaacttcatgcgaaaaaaaaaaaaaaaaa

SEQ ID NO: 18928 - DNA, 51 bp, Homo sapiens
agattccggaaaggggaagagcagccagcatggcggcggaacsggcgcggg

SEQ ID NO: 18929 - DNA, 53 bp, Homo sapiens
  misc_feature 36: n=a, g, c or t
agattccggaaaggggaagagcagccagcatggsgncggaacsggcgcggggc

SEQ ID NO: 18930 - DNA, 485 bp, Homo sapiens
atagtgtttgtaataaagcagcagagagacatagatggacatgagatttgtagtgtcagacttttcaacggaaaatttaaaaatcaaaataataaagttgtagtatctgaaaatagataaacagcaaggawaggagagacggttccccttcattggtgaggatgacaatgacgatggtcacccacttcatccatctctgaatattccttatggcatacggaatttaccacctcctctttattatcgcccagtgaatacagtccccagttaccctgggaatacttacactgacacagggttaccttcgtatccctggattctaacttctcctggattcccctatgtctatcacatccgtggttttcccttagctactcagttgaatgttcctcctctccctcctaggggtttcccgtttgtcccctccttcaaggttttttcagcagctgcagcacccgttgycccacctattgcagctgagcctg

SEQ ID NO: 18931 - DNA, 355 bp, Homo sapiens
  misc_feature 351: n=a, g, c or t
attaagtgttagctagtttgggaggtcggcaggggtggggaggatgcaaaaaagccctcatcacagcgctcctgacagctcccgccagccagctccccaaatcccttaggaaaatggcctcgacctctcagctgcaactctggcccagccgccatctcctgacctgaccgcccacttctggggagccccggtgggtctggattggagagagccaccctcagccctccccaccttcattggaccacagctgtctccttcaccatcacctccgtgcccaccaggattacaggcctgatctgaacccctaatctagggaagaaaaaaaaaaaaaaaaaaaaaaaagaaraaranaaaa

SEQ ID NO: 18932 - DNA, 330 bp, Homo sapiens
attaagtgttagctagtttgggaggtcggcaggggtggggaggatgcaaaaaagccctcatcacagcgctcctgacagctcccgccaggccagctccccaaatcccttaggaaaatggcctcgacctctcagctgcaactctggcccagccgccatctcctgacctgaccgcccacttctggggagcccsggttggktctgrattggagagagccaccctcagccctccccaccttcattggaccacagctgtctccttcaccatcacctccgtgcccaccaggattacaggcctgatctgaacccctaatctagggaagaaaaaaaaar

SEQ ID NO: 18933 - DNA, 440 bp, Homo sapiens
gatcttccgggtacacgccaccggaaaaaggaaaaaagcctcggaggggcatgccaataacgcctttaacacatggcgcatgcttgcttcccaaagctaaggagggctctgtgcaggcggcascmaccctaagggaagaatcatgggaaagagatggggaactgcgacatgaagaagttaacttacctaagatcagagaatgagtcaaggacagaacaggaccatgtcatcaaatttagagaaacttgaactatcatatctcattttggactagccatctttcaagagctcaacagccacgtgctattaatggctaccacattaaaggctccaagtctagatggaaaataaacaagtaaacctataaacacagttaatagatgtttttcagctgcaatctgtactgtgactggaatgagaaagccttaattcataccatc

SEQ ID NO: 18934 - DNA, 582 bp, Homo sapiens
gcacgcgcgtgagggatgtcgcggtctcgtggtggaacatctgacccttttcaagaggaaggatgaaaactctacataggaacacgatgtgaatggaagaaacctgtcattattggatcacctcccaccctgaggccccccaagactttgaacagttcttcagtcatccttacagaaagataccctctccagacaaacgcagtatttatatacggtccattggatctctatgaagcaccagaattatcagtgaagaatatattaaatggctcacgggctactgtaaagcatatttctatcgcttgagagtaaaactgctagaaccagttcctgtttctacaacaaggtgttcctttagagtcaatgagaacacacaaaacctacaaattcatgcaggggacatcctgaagttcttgaaaaagaagaaacctgaagatgccttctgtgttgtgggaataacaatgattgatctttacccaagagacttgtggaattttgtctttggacaggcctctttgacagatggcactggtgaggtggattgatgatgaatcttctggcacacctggagcaactccagaa

SEQ ID NO: 18935 - DNA, 281 bp, Homo sapiens
tgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggtttaattgtttgtcctcaaaaggaataaaacttttctgctgataagacaaaaaaaaaaaaaaaa

SEQ ID NO: 18936 - DNA, 341 bp, Homo sapiens
aaatcgaggcctgtcgggtcagggcggttcgcgggtgctgtcagagctgggccggggccctaggcaggccaggcccagacatgtccgtccttgtaagttaaaagcttccatgggagccttccttcctaatcaagatgcaaataatacggcactccgaacagacactaaaaacagctctcatctcaaagaacccagtgcttgtatcacagtatgagaaattagatgctggggaacaacgtttaatgaatgaagccttccagccagccagtgatctctttggacccattaccttgcattctccatcagattggatcacctcccaccctgaggctccccaagac

SEQ ID NO: 18937 - DNA, 426 bp, Homo sapiens
atctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagcactccccaccgctaccatggmcgaagacgcagacatgcgcaatgagctggaggagatgcagcgaagggctgaccagttggctgatgagtcgctggaaagcacccgtcgtatgctgcaactggttgaagaggcttaaatcaagtgatgcttacaaaaaragcctggggcaataatcaggacggagtggtggccagccagcctgctcgtgtagtagacgaacgggagcagatgg

SEQ ID NO: 18938 - DNA, 451 bp, Homo sapiens
  misc_feature 116: n=a, g, c or t
gcacgcgcgdgarggatgtcgcgggatctctatgaagcaccagaattatcagtgaagaatatattaaatggctcacgggctactgtaaagcatatttctatcgcttgagagtaaanctgctagarccagttcctgtttctacaacaaggtgttcctttagagtcaatgagaacacacaaaacctacaaattcatgcaggggacatcctgaagttcttgaaaaagaagaaacctgaagatgccttctgtgttgtgggaataacaatgattgatctttacccaagagacttgtggaattttgtctttggacaggcctctttgacagatggtatkccgtttttggcattgttgttagaagcttcttcaacttgagaatatttgaagatgttaaaagagggaaaaaaattccaaccaagaatcatattgatatttaaaactatagtattttcagt

SEQ ID NO: 18939 - DNA, 431 bp, Homo sapiens
agtgagggttttgggattcaagcacagaccaccttcgcccctatgctacaccacctcaggctgtcgggagataggcgcccagtcaaaaggcacatagaagaaagcctacgacttctcaagcattgaagcaagagtggcgcatcggtatgctcaacttcaaactttgagaacagtcatggatctctatgaagcaccagaattatcagtgaagaatatattaaatggctcacgggctactgtaaagcatatttctatcgcttgagagtaaaactgctagaaccagttcctgtttctacaacaaggtgttcctttagagtcaatgagaacacacaaaacctacaaattcatgcaggggacatcctgaagttcttgaaaaagaagaaacctgaagatgccttctgtgttgtgggaataacaatgattgatcttta

SEQ ID NO: 18940 - DNA, 424 bp, Homo sapiens
aagaaacaggctgtagacagtggaaagaaacacagggatgggaatgggagggtcgatggaagagcaacccagaatccactgactttgatctgatgttcacctgcagtgccacactcaatcagtatccaagtcctagctgttcacccsatcstcgacagggtaccctgtcccagggccctagcatggcatggccccttggatgattggtagctacstggaagacctcggaatatatttgccttsaccccasctaagagaaagcctccaggcaagtcccccagagaagatagtgaaggcccaggacscttatgaacacaggcacagggccacgctggtgatatctaggaataattgcagggaaaaatgcacccaagcttcctttgggaatcaatctccccctcccactstacagataatgttgcag

SEQ ID NO: 18941 - DNA, 469 bp, Homo sapiens
aaaaaagcgaggacgtgaccgttttggaagcattgttcttttcactgttagtgaggagcggtcaaggatgcgtattaagaaaataactagaagtggccgcatgatgtacctctcaccaatgagatgcctgtcaaggtatacgtgggtcttttgagatcttattcactgatttgaagagttcatgcatcgagccagtagggktgcacatgggtaaaaactggctgcggctaaacagttactcttagaagaaaggaagcattgagagtaaggaacaaatgccaatgatgacaacccaaacactatgtattgtaaatgaagtggacttcgtggtttctttatccaccaataaattaaaagaaaacttacaggaaatggacacagccctggataaatgcaactactaagattcaaccaagaagtaaaaatccttaacacaccaatacaactaatggatttaatcagtaataaa

SEQ ID NO: 18942 - DNA, 325 bp, Homo sapiens
gaggacgtgaccgttttggaagcattgttcttttcactgttagtgaggagcggtcaaggatgcgtattaagaaaataactagaagtggccgcatgatgtacctctcaccaatgagatgcctgtcaaggtatacgtgggtcttttgagtattgtaaatgaagtggacttcgtggtttctttatccaccaataaattaaaagaaaacttacaggaaatggacacagccctggataaatgcaactactaagattcaaccaagaagtaaaaatcctgaacacaccaatacaactaatggatttaatcagtaataaaaagtctctcacca

SEQ ID NO: 18943 - DNA, 149 bp, Homo sapiens
agaaaaggaggggcgtacgcgggcaagatggaggcgactacggctggtgtgggccggctagaggaagaggcgttgcggcgaaaggaacggctgaaggcctacgggagaaaaccgggcgcaaggacaaggaaaaaaaaaaaaaaaaaagc

SEQ ID NO: 18944 - DNA, 438 bp, Homo sapiens
  misc_feature 293: n=a, g, c or t
agaaaaggaggggcgtacgcgggcaagatggaggcgactacggctggtgtgggccggctagaggaagaggcgttgcggcgaaaggaacggctgaaggcctacgggagaaaaccgggcgcaaggtgagaagtgtggagtgagggtcgcagttgaggcgtccagcgttcggggtccgggtcgcgcwtgaggagagcaaagggctaataaggaaagacagctgccgagggcgcgcatscgggcgctaacgcatgcgcgaraagacggcgccctcccacgatgtctggggctgcttngcgtgggactcctctggcgctggtgcggtcgtcgcgcacgcgcggaggggtgggcaaggcagtggtcagcgaccgcagtccatctgactcctgcttcccgggtgttgctcgtgtaggtatctaggggctgcctgtaggttcagat

SEQ ID NO: 18945 - DNA, 524 bp, Homo sapiens
gataaagcgcgccgactgggctacaaggccaagcaaggtacgtgatcgactgcgtggatgcttggataaaattatattcgagaaaagttggaaaccagctgttaggaagacactgctgcctcagtgtctttcttcgcatagggctttggcagaaaaaagctagcaacactggtcagttactgtatgcactgttgtctaaagtggcaagtgtgtcaaaggttacaaatctgaatgagttcagactaaagcaaaataaacagtgtgcctccctgtgtgagtagcctaaggtgcattgaaaaagactgggatgtgttttatttttttctattagatagcattaacttactgttgaagtatttttggtggagtattagtgacaagccattgagtcttaagccttacggcttcctataaaatcactaatttcgtgtktgtttgtgtgtaggttacgttatatataggattcgtgttcgccgtkgtggccgaaacgccagttcctaagggttgcamttacggcaacctgt

SEQ ID NO: 18946 - DNA, 518 bp, Homo sapiens
agttgtttgggctgtcgctgtggctggttctgcggtgtgcggccagccatggagcgctctgggcccagcgaagtgacaggctcagacgcatcgggaccggacccgcagcttgtggtcaccatgggcttcacggggttcggggttcggtaaaaaagctcacacatttgacttggaagcaatgtttgaacaaactcaaagaacagctgtggaaagaagtcacaaaacactggaccagattacagaggggtattgatttgccttgcccccgcccccaccatcacagtgtgtccctgtccagtgttggtgctgtgtggcattgcttgtgtccataggagtccatcaaggcagagcagcagagcgtcaagcagagcgtcaaggcagttcaacccaatggaaatggattgaaagagtgaaagtcactggtctcaaagaatctacggaatttagcattttgaaaatcacagagcaatttttgggtaggtattcacatgcactaaaaaaccaggcaacatctgact

SEQ ID NO: 18947 - DNA, 409 bp, Homo sapiens
aagttcccctgcagttgtttgggctgtcgctgtggctggttctgcggtgtgcggccagccatggagcgctctgggcccagcgaagtgacaggctcagacgcatcgggaccggacccgcagcttgtggtcaccatgggcttcacggggttcggggttcggtaaaaaagctcacacatttgacttggaagcaatgtttgaacaaactcaaagaacagctgtggaaagaagtcacaaaacactgggccaccaggaacacacctgtagcccagcaaagkkgaggccatcgactggctcatcacaacaaggaaggctgtgcaccactgggacccagcagcagctcagcagcagcagtgagagggccttgggaaagacttggagggtttggcttatacaagaccagattacagag

SEQ ID NO: 18948 - DNA, 519 bp, Homo sapiens
  misc_feature 391: n=a, g, c or t
attggtgttaatattaacaatttcaactaaaaacaacaaacataatttttctaagtgtttcgagctgtgagatgtcaatttctacaatttagtttctagacatgctgtatatttaataaactttatgtaaactttaaaatattgcactgcatttatgaaaaaagctttctttgcctactgcagctatctaacattttatgaaactgacgcatgtccttcattattgaggctaaaagctcttgttcagattgcttgaggtttgaaaaagaggtgtgctagctttgcttagtttatttcttatttttggtatacatatacatatatataacattagaatgtgtgtactggaaatgctatgataggtattttgtgttaatccaaatgcaatgantagtttcttgtatgaatgtgcaagaggcctgtgaccgaatgctacgtttttatggtagtttaagattataaagtagaaatgcaacaattcccagtttttttggataggtkctaaatttctgagatttg

SEQ ID NO: 18949 - DNA, 469 bp, Homo sapiens
attggtgttaatattaacaatttcaactaaaaacaacaaacataatttttctaagtgtttcgagctgtgagatgtcaatttctacaatttagtttctagacatgctgtatatttaataaactttatgtaaactttaaaatattgcactgcatttatgaaaaaagctttctttgcctactgcagctatctaacattttatgaaactgacgcatgtccttcattattgaggctaaaagctcttgttcagattgcttgaggtttgaaaaagaggtgtgctagctttgcttagtttatttcttatttttggtatacatatacatatatataacattagaatgtgtgtactggaaatgctatgataggtattttgtgttaatccaaatgcaatgrttagtttcttgtatgaatgtgcaagaggcctgtgaccgaatgctacgtttttatggtagtttaagattataaragtaga

SEQ ID NO: 18950 - DNA, 468 bp, Homo sapiens
aagtcaacagcaatcgcccatttccaaagccatggtgaaacatctctgtgctaatttcttttgttttgtttcctaattttttttttttggcaggtggtrggaaataatctttgtcttctttggagtaaaccttcaacaccggattttttcttttaattatggatgtaaaccccaatatccccataatttacattgggtctcgaccaattgcctaattataagaggatatatttaggctcttatttcatccacacaaaaacttgtgtaacaggtagttggaaacatctgaggcaccactttgattctgttttggatggtcatgttttttctcctccgtttccccagcatgtctgccaccatcctcatgcactgcttccaagtgcctgggagcctttatgagcgtccctaaacctaaaagawtccagaggcggggctcggatgaaccctcgagataagcaatatttgaga

SEQ ID NO: 18951 - DNA, 519 bp, Homo sapiens
aagtcaacagcaatcgcccatttccaaagccatggtgaaacatctctgtgctaatttcttttgttttgtttcctaattttttttttttggcaggtggtgggaaataatctttgtcttctttggagtaaaccttcaacaccggattttttcttttaattatggatgtaaaccccaatatccccataatttacattgggtctcgaccaattgcctaattataagaggatatatttaggctcttatttcatccacacaaaaacttgtgtaacaggtagttggaaacatctgaggcaccactttgattctgttttggatggtcatgttttttctcctccgtttccccagcatgtctgccaccatcctcatgcactgcttccaagtgcctgggagcctttatgagcgtccctaaacctaaaagaatccagaggcggggctcggatgaaccctcgagataagcaagatggagagcaatacatcatcatctttggagaatttagcgacggcgcctgtgaaccagat

SEQ ID NO: 18952 - DNA, 256 bp, Homo sapiens
  misc_feature 223: n=a, g, c or t
agtcgatctggtcaccaagacagctgttgactaaagcgtggggagcttatacagagtccatatkctggacaaarggaggattcataccctgggatggagagcaatacatcatcatctttggagaatttagcgacggcgcctgtgaaccagatccaagaaacaatttctgataattgtgtggtgattttctcaaaaacatcctgttcttaactgtacaatggcnaaaaagcttttccatgacatgaatgttaactat

SEQ ID NO: 18953 - DNA, 306 bp, Homo sapiens
aaaaaaggaaaagcgtggcctgggtgagtgaaggagggaaaggagggcctcagacgttgtgtctgggattcaggagagaagatgactgaggaggaggtggagaccgttctggcaggacacgaggacagcaacggctgcatcaactacgaggccttcttgaaacacatcctaagcgtctgagtgctgcagatccagtggggtccggacactgggccccgcagcgaaagcacgttccagccaccaggaggccacctattgtttcaaaataaagactgggttcctctcttggaaaaaaaaaaaaaaaaa

SEQ ID NO: 18954 - DNA, 470 bp, Homo sapiens
tataagttctagcaattattaaaaaaggaaaggctgtctgcaaacaggtgatctcagaagggggtttgtgcctctctaggaaggaagcctcattgtggacatctgggagcaggtacatcccagccttcttgsacatagaaacactacacagcacttcagctgtatgtttgggggccattttaaacagcaaaatcatcaacaggaagcagaaaattgtaaaaattgtggcactaaatagaccatgtaaaggacacatgtttgcaataagaaagctgaaacaagaagggggagtgtcaccttatttgatccagctagaaactcaggtgctggtattccagcaacactcaggcggctgctccaggaggctgcagaggggtcctttttagccgtcaacaaaactggctatggtcacgcccattgcgaaactcattgctgccttcaaggttctgtcaatagaagatactaaagaa

SEQ ID NO: 18955 - DNA, 458 bp, Homo sapiens
aatctggaatgatgatatcaatcaagtgaagcagctatcacagggtctggaacataaaataatcatgaggcccaaaacacttcctgaatgaaagagaacctgcattgaattttgttctgtggtgaatggtacatcccagccttcttgcacatagaaacactacacagcacttcagctgtatgtttgggggccattttaaacagcaaaatcatcaacaggaagcagaaaattgtaaaaattgtggcactaaatagaccatgtaaaggacacatgtttgcaataagaaagctgaaacaagaagggggagtgtcaccttatttgatccagctagaaacgactcagaagctgtaggaatattcaggcacagacaccagacccagcttcatctctaacttgtggcaaaggacagtacatcctgggatgggaccctatgctcccctatgccatttagacagagc

SEQ ID NO: 18956 - DNA, 790 bp, Homo sapiens
attagcatcccttgtcttccgcggtgttgcagacttatcctcagctcaagcgagtttggggcgttatggagccagccaagtctccccttgctggcgtgggtacttgtgcagaaacttcccgaggtgcttctgagactgcacagtgaagaccgccgcaccggagtcagcgctccgccgcggactcccggctgactctgccactctcccaggaggaggcgctgtgcacctctgggtggtttccagggctcggctggcggtagagggagccttgaggttggaaaagatctagagctataatctccgaaaggaagatttgtaatacactgcgagttagaaatgtttttctcactgcagcttccttgtttcaaaaagagaatttttgacagcactgcaaaggcacaagaaaccaggcacagtataaaatatacaaataaaacaggtaccaaggaacttaaaacattcaacccataacgtcgtctaggtttttctgctttaagaaaattgactcaattcttccaagagaataaccctattaaaggctaaaaatggaagctcccagttatgtagaagatatttccatctggatccgtcttagaaagtgaaacaggaaatggcttaatcctagaggagaagataagactggagaaattactggggaaagggcggttaagggctttctgcaagtgcttgagactatccctgtggcaccccctaccacagccctaggaacaatagcataagatccttgcaccaataaatgtcacagaaggatggaaaaaaaaaaaaaaaa

SEQ ID NO: 18957 - DNA, 517 bp, Homo sapiens
acgggcgcgcgcacgccgccttcgccgctggctccgtctgttggggggcgaacacgcgcggtcctcgtcgtgatggctctgagagattcctctgcgaatctgtttttagctatcaagtggcatccacgcttaaacaggtgaaacatgatcagcaagttgctcggatggaaaaactagctggtttggtagaagagctggaggctgacgagtggcggtttaagcccatcgagcagctgctgggattcaccccctcttcaggttgatactgcctggatggtcacctctggtgcgcasaagtgcaaagccagtgggggactttctcacagcttacatagccatccagagatccacagctacgtcactgaattgttaatgcacatttgtacttggtttctctgtatctattcacaggcaacaaatacttatatgtgtgatctttcagggaatgttttgtttatttgtttttaaaagtattgggaatcagattaaagacaatcagtttcagagaaccaggagg

SEQ ID NO: 18958 - DNA, 1030 bp, Homo sapiens
ggctccgtctgttggggggcgaacacgcgcggtcctcgtcgtggtgagcgcaccactcaggctggtcctgggggtggggctgtaggggaaagtgctaaagccgctgagatggctctgagagattcctctgcgaatctgtttttagctatcaagtggcatccacgcttaaacaggtgaaacatgatcagcaagttgctcggatggaaaaactagctggtttggtagaagagctggaggctgacgagtggcggtttaagcccatcgagcagctgctgggattcaccccctcttcaggttgatactgcctggatggtcacctctggtgcgcacaagttgcaaagccagtgggggactttctcacagcttacatagccatccagagatccacagctacgtcactgaattgttaatgcacatttgtacttggtttctctgtatctattcacaggcaacaaatacttatatgtgtgatctttcagggaatgttttgtttatttgtttttaaaagtattgggaatcagattaagacaatcagtttcagagaaccaggaggtttggggttaagagatactcaaaaattttcacaagccaagtagggcatatatcagatttggccaactgaatggcgtctgtcctgtcatccatatggtgcctggaaatatttaccagtcaaggtcaaggtcagcatctgtggttaaaaatatagcattctgacctaaaaaagttattttgcagatgaatgtgttttcaactcaggacctatccaaatgaggaatttttaaatattcttttttttttcctatttttagacatcaattctatagattctgactttttctaacctcttatagacatgccaaatgctggcaaaaagaagtgctttttggatatggcagcacttgtaaaaataaagcagtaagcaaaatccttttaaacacagaaatcctgagttcttctcattggtggactcaagcaattctgtagcaaataaatcctttgaaagagctccaaaaaaaaaaaaaaatgcgaa

SEQ ID NO: 18959 - DNA, 419 bp, Homo sapiens
cttcgccgctggctccgtctgttggggggcgaacacgcgcggtcctcgtcgtgtgaagtaagaactctgctagagaggaaatggctgcttcatcatcatcctcctcagctggtggggtcagtggaagttctgtcactggatctggtttcagtgtctcagaccttgccccaccacggaaagcccttttcacctaccccaaaggagctggagagatgttagaagatggctctgagagattcctctgcgaatctgtttttagctatcaagtggcatccacgcttaaacaggtgaaacatgatcagcaagttgctcggatggaaaaactagctggtttggtagaagagctggaggctgacgagtggcggtttaagcccatcgagcagctgctgggattcaccccctcttcaggttgatactgc

SEQ ID NO: 18960 - DNA, 324 bp, Homo sapiens
ttcgccgctggctccgtctgttggggggcgaacacgcgcggtcctcgtcgtggtgcagtggctcacgcctgtaatcccagcactttgggaggccaaggcaggtggatcacctgaggtcgggagttcaagaccagcctgaccaacatggagaaaccccatctctactagaaatacaaaattagccaggcatggtggtgcatgcctgtaatcccagctactcgggaggctgaagcaggagaatcgcttaaatccgggaggcagaggttgctgtgagccgagatcgcgccatttccagcctgggcaacaagagggaaactccgtctc

SEQ ID NO: 18961 - DNA, 379 bp, Homo sapiens
aaaaatcctttgttgacttccttccaccagccctgggaagaatctatcatcccctttcctctaacacccctaacccctttcctctaacaccaaatgtggtgttccatcaccacatttatagaaaaatatatattacaattattggtttctatgtctgtttchagttctcctcaacttgctcctcaagggtacatctggacacaaaaaaggacaccagggatgtgtgcacatggaggaaagagcatgtgaggacacatcaagacagcctctatctacaagccaaagagagaggcttcagaagaaatgaacctgctaacaccttgatcttggacttccaggcagtactgtgagaaaatgaatttctgttgtttaaaaaaar

SEQ ID NO: 18962 - DNA, 403 bp, Homo sapiens
aaaaatcctttgttgacttccttccaccagccctgggaagaatctatcatcccctttcctctaacacccctaacccctttcctctaacaccaaatgtggtgttccatcaccacatttatagaaaaatatatattacaattattggtttctatgtctgtttccagttctcctcaacttgctcctcaagggtacatctggacacaaaaaaggacaccagggatgtgtgcacatggaggaaagagcatgtgaggacacatcaagacagcctctatctacaagccaaagagagaggcttcagaagaaatgaacctgctaacaccttgatcttggacttccaggcagtactgtgagaaaatgaatttctgttgtttaaaaaaaaaaaaaaaaaaaaaaaaaaaaaaaa

SEQ ID NO: 18963 - DNA, 384 bp, Homo sapiens
aaaaatcctttgttgacttccttccaccagccctgggaagaatctatcatcccctttcctctaacacccctaacccctttcctctaacaccaaatgtggtgttccatcaccacatttatagaaaaatatatattacaattattggtttctatgtctgtttccagttctcctcaacttgctcctcaagggtacatctggacacaaaaaaggacaccagggatgtgtgcacatggaggaaagagcatgtgaggacacatcaagacagcctctatctacaagccaaagagagaggcttcagaagaaatgaacctgctaacaccttgatcttggacttccaggcagtactgtgagaaaatgaatttctgttgtttaaaaaaaaaaaaa

SEQ ID NO: 18964 - DNA, 527 bp, Homo sapiens
cactaatgactcaccttagaaggaaaagaaaaattttaatttacttaaaaaattttttttttgattgaatagataattgtgtatatttgtggttaattattattttacactccagacctatttctacacctgtagggaagaaacttaatcactgatatcatcagcctgtcagataccactgatatcttcagtctagttttaagaaaaactaggactaagaagaagtatataatcaagttcaagctaatcatggccatttttaaattacttggtcttttttaatactttttcccagagcaaccttctaaatggaagggcaaagcctcaactatctaaaatgcagcttttaaggactcttagatgtatgatatgccttatgtacaggagattccatctataccttgacacccacaccactcccacccctgttctctcttccaagaaggtttttggcagcaaatagttctctttaattattatatttaaatatttgtatatatttaattcacattagggatacaactaag

SEQ ID NO: 18965 - DNA, 458 bp, Homo sapiens
cactaatgactcaccttagaaggaaaagaaaaattttaatttacttaaaaaattttttttttgattgaatagataattgtgtatatttgtggttaattattattttacactccagacctatttctacacctgtagggaagaaacttaatcactgatatcatcagcctgtcagataccactgatatcttcagtctagttttaagaaaaactaggactaagaagaagtatataatcaagttcaagctaatcatggccatttttaaattacttggtcttttttaatactttttcccagagcaaccttctaaatggaagggcaaagcctcaactatctaaaatgcagcttttaaggactcttagatgtatgatatgccttatgtacaggagattccatctataccttgacacccacaccactcccacccctgttctctcttccaagaagggtttttggcagc

SEQ ID NO: 18966 - DNA, 516 bp, Homo sapiens
cagtaatgcttaaataacatgtttattctcacttcagctctgttgccaagaagaaccttcagttcatctctaaaagcatttattggatgcttactatatgctgaatgctagagttatgaaaatgaatgacctagtccccacctatcaggaacttaaaaactagtggtgagggatttaaacaaaacttcaatatagtatagtaaaatgtattatagaggtatgccttgcagttatggaaatcaaggaagagcaccttacctaagttgagggttcaaagaaggcctcttagaagggatgttccctgaaccaagtcttacacagttagcaagaaaaaattgggaagggtatataaacaaaagcagataggtgtgatatttacatggaagtataagcaattctgtgatagagtacaaagtataaaatgaagattggcagatgacattggagatagctatgtgattattatccttataatccatgttaaggaattttactttatcttctaggtcaggagac

SEQ ID NO: 18967 - DNA, 449 bp, Homo sapiens
catttaggtttaagatgtaagtgaacaattctttctttctgccaagaaacaaagttttggatgagcttttatatatggaacttactccaacaggactgagggaccaaggaaacatgatgggggaggcagagagggcaagagtaaaactgtagcatagcttttgtcacggtcactagctgatccctcaggtctgctgcaaacacagcatggaggacacagatgactctttggtgttggtctttttgtctgcagtgaatgttcaacagtttgcccaggaactggggatcatatatgtcttagtggacaggggtctgaagtacactggaatttactgagaaacttgtttgtaaaaactatagttaataattattgcattttcttacaaaaatatattttggaaaattgtatactgtcaattaaagtgtttttgtgaaaaaaaaaaaaaaaag

SEQ ID NO: 18968 - DNA, 496 bp, Homo sapiens
aaggaacaatgatttacaaacagaaatacaataccttttcaaattgccagtcaagagtgaagtatgccaagaaaaaaggagaggctcctcaataaccctcaagacataatgtcattttctctcctgaggatgaagactctctatatgctgaatatttattagtctgctgggtcacctgctagaaaacagacaattctccagcaacttcaaacactcttcttcactgaactacagtttggtatgagacgtcaaaggataagaatgtgcatacctaaatggtcaaatgaagatgaatgttccatatggcttttgcccatactgcccaagactgtgttaaaaactaaatacatcaggatgctctaagccactgaagagccatgtttgccagtccattatactgggcttctctggttatacaaagggacagctaatgaagatattctgttgatataaaagcagtctcatggacagtaatctttctatatcctttaggcag

SEQ ID NO: 18969 - DNA, 569 bp, Homo sapiens
aaggaacaatgatttacaaacagaaatacaataccttttcaaattgccagtcaagagtgaagtatgccaagaaaaaaggagaggctcctcaataaccctcaagacataatgtcattttctctcctgaggatgaagactctctatatgctgaatatttattagtctgctgggtcacctgctagaaaacagacaattctccagcaacttcaaacactcttcttcactgaactacagtttggtatgagacgtcaaaggataagaatgtgcatacctaaatggtcaaatgaagatgaatgttccatatggcttttgcccatactgcccaagactgtgttaaaaactaaatacatcaggatgctctaagccactgaagagccatgtttgccagtccattatactgggcttctctggttatacaaagggacagctaatgaagatattctgttgatataaaagcagtctcatggacagtaatctttctatatccttaggcagccacaatactgcctgtcaaatataattascagcagaagaacagaaaactaacacttacctattaccttgttaac

SEQ ID NO: 18970 - DNA, 477 bp, Homo sapiens
  misc_feature 455: n=a, g, c or t
aaaaaatcgtttcaggattggaaaggaaggtaccaaaatgattggagagggcctttccccgtttcactaggcacttggagaagctgtgacagagagctggacacccagcgcgtgcggaccccgtgcgtatttccccggagtccgcgttccgtgaaagggagaggggtgcggttagctccagggattctctagccctggagccaccgctgatttgcgcackwagtttgcctgggggtgataaacgggcgtcgtctctcttcaggagcgccaacactaccaagcttccccctgcaaaattcagaaaggatgcgctttggtgagaacttggctcagccttcccgtggcttgggagatgaggttggagtgagaatgtcaccagacctcggaaggggacataacggtacctcctagtcccaggacacgggtacgtggcggaggtggggtgtgggaggttngtgggaagagcgcaggttactg

SEQ ID NO: 18971 - DNA, 607 bp, Homo sapiens
ccagactgckagcgsmgaagcgtagtttgcagcctcggaattggctagagcgccagagccgagtcagccataaagctacgcgctaggctcttggccctgacgtgaggcgcgcagagatggcgtaacgggaatagttttcaacgtctatttcattccctgcttcagaggacctctttaatctttgattttggtccctgtttctaagaaaagcaactgaaaaggtcgtaataccgcccctgagaaaaaaggagcagcgctaaataatcgagaaaatgcctcctcttgaaacggatatagagatggaaacaagatataagaaggattgagaatcatataatacaggagcttaaacacctatgcgcgatgataaagagggtactattagagcgcttggaaaataccaggaagttgagagagttaacagaagggcgcacgctggattggccacaaaatcgaattactgaaggccactactgattaggacacttatggagaacgtgggtagcactgaagcagcattctagtttccagtgccrtcaacctcatacgtatctacctggtctctgatcgaagctaccgtaatgtgttcttgaggtcacatgatttg

SEQ ID NO: 18972 - DNA, 501 bp, Homo sapiens
gagatggcgtaacgggaatagttttcaacgtctatttcattccctgcttcagaggacctctttaatctttgattttggtccctgtttctaagaaaagcaactgaaaaggtcgtaataccgcccctgagaaaaaaggagcagcgctaaataatcgagaaaatgcctcctcttgaaacggatatagagatggaaacaagatataagaaggattgagaatcatataatacaggagcttaaacacctatgcgcgatgataaagagggtactattagarcgsttkgraaatacccaggragkttraraggagtttamcagaaagggcgcacgctggattggccmmaaaatcgawttactgaaggccactactgattaggacacttatggagaacgtgggtagcactgaagcagcattctagtttcagtgccgtcaacctcatacgtatctacctggtctctgatcgaagctaccgtaatgtgttcttgaggtcaacatgttttgtg

SEQ ID NO: 18973 - DNA, 415 bp, Homo sapiens
  misc_feature 136: n=a, g, c or t
agagatggcgtaacgggaatagttttcaacgtctatttcattccctgcttcagaggacctctttaatctttgattttggtccctgtttctaagaaaagcaactgaaaaggtcgtaataccgcccctgagaaaaaangagcagcgctaaataatcgagaaaatgcctcctcttgaaacggatatagagatggaaacaagatataagaaggattgagaatcatataatacaggagcttaaacacctatgcgcgatgataaagagggtactattagagcgcttggaaaataccaggaagttgagagagttaacagaagggcgcacgctggattggccacaaaatcgaattactgaagtaagtgcaaaacgacaaattgtcacagaatacagagaaaaggggaaagaaattaagaggag

SEQ ID NO: 18974 - DNA, 474 bp, Homo sapiens
agatccaagaggatgagacaaagtccccatatctcaatgaaagatcgtcaaggtcacactgaagaagaccatgtgggatgggagagagacatagtggtcacatttgagaaaggccatctgacagatgggagaagctgaaagggctgcagtaagcaaatacactttggacgaaaatttttcttaagatctatctttartacacagatttctatgaattagctccagtwawatttattttcaaccttgtcattacagaagtamcatatttcaaaacacttgacagtttacaaagtactcttaattgatcatcataataagcctgctaattattaggacaaaatattatcacccacactgtttagacaagaaaactaagacccaaattctcatagccaaaaaaggagcatgttcaggatctgagtccagaattaactgttctttctacagaaacaaaccatctattgaacatgccat

SEQ ID NO: 18975 - DNA, 449 bp, Homo sapiens
atgaaaaaatctaaattaatatcttgtgcccaaatccaacattccaatggagaggtaaggaaagaaagggcagcagtggctcaggtaagggagacccatctgtggccaccatagctccaccgtctctcactgtgggtaatggctgtgactcagttttgccttctgtcatttgtaagctgcctgctttctgtgtctgcctatccatctgtgcaaatggattcagtgtgattttaaatctgtctgaaaatgaaattcagttgcaagtaaaaacttctgtggatacatcatggtctgaggtgagctctaggagcttgcttttacaaatgagaaagcacaagtgcagacacttggtcacctcctctatgcatgcttagcctgcaaaagtgcaacagcaatgaaagcacaactttttctcatgcctgaatcattacaaagaggcaaacggaaag

SEQ ID NO: 18976 - DNA, 482 bp, Homo sapiens
tctttaaacatagaggtaccaccacaagggatgccctactctctcgcagctcttgaaagcatctgtttgagggaaacgtctctgggcaagcaagtggttatttggattgcttgcttccctttttccacctgggacattgtaatcataaaataacagtaaattccaaacctcaaaaactattatggcctgagcacagctgaaatctagcagagtttaactcttctgcctccatgtctgtcacttataattcaggttctgctgttggcttcagaacatgagcagaagaatcgttttatgctagttattgcattcatggttgaaactcaacttagggaaagggttccaatgtattaagcaatgggctgcttctccccaatcctccctaacaattcgttgtgtggacttctcatctaaaaggttagtggcttttgcttgggatcagtgctctctattgatgttcttgctggtctccagacacattc

SEQ ID NO: 18977 - DNA, 467 bp, Homo sapiens
  misc_feature 410: n=a, g, c or t
atgcggccctggaaactgtgagtttggggattgttgygtccmmtawcyggacycagaagggacttccctgctcggctggctytcggtttctctgctywcctccggakaaatmacrgsgtctyccgcgccgtcatggmgctcccgkccgyckcgagygtccctttccttccyggcgctttcctgggttgcttctggcggccctggtgttgctgctgtcctccttctccgatcaatgcaatgtcccggaatggcttccatttgccaggcctaccaacctaactgatgactttgagtttcccattgggacatatctgaactatgaatgccgccctggttattccggaagaccgttttctatcatctgcctaaaaaactcagtctggacaagtgctaaggacaagtgcaaacknaaatcatgtcgtaatcctccagatcctgtgaatggcatggcacatgtgatcaaagac

SEQ ID NO: 18978 - DNA, 659 bp, Homo sapiens
taaatatataggtagttcattcgtgggaagatgaatcttcttattaagcctgccctcaattgtaaataagtgactcaaaaactcaaaatgttcatcagcattcaggtcatttgtttcacccttagccaagaagaactcattagaaattcagttataatttcaatttaagcctgtttatgataagcataatgattggcatgttatatagcctgttgaaaataactacagaatgaccttccagagcactgtttttggcctcgtgcccgctctgttcaggctctgcttgtttttcagaatatgatttttacctccagacagtaagaattgaacaagaactgatcaaacacaccttcctattttgttttcttcactatgtaaatattatttgggcaaacattacaaaaagggatccaaacaatttgagtttcagtatttttttctccctaggcatgtgcttcaatttcaaatatttttttctgtgtggaaaatgccatgtaactattgcactaccttctgtgtggactgtgttggtattggttctttctgtatatcaaaagtcagggtgtttataactgcaaagtttgtataagtggctttattcctcttctagaagatttatgaggagcctaggaagcactattggtacaggaggaaaaaag

SEQ ID NO: 18979 - DNA, 451 bp, Homo sapiens
ttagagcttatgtttgaatttttacttaaatgtacttaaagactaccttaaagggaaaactaaaactgaattttaagaaaggaagctaaaaacaaaagcttaataataatctgacacttttatcctttcattgattgattgaatcattcattcattcatgaaatatagattaagtgcctagtatgagcaagcctagtctccatactggggctatagccatatgcaaaaactcacatgttccctgagcccatggaattgatctacttgaacactaaataaacacaaaattgtgtttatcacaaatttgtgtttactacaaaatttctaagattttgaagtgctacaagaactctgtgggcattttttctttgaagattttgttcgcttgctatgaattaccaagggtcctatctgataactgtgtgcttctcactttgatttccctgactgt

SEQ ID NO: 18980 - DNA, 485 bp, Homo sapiens
aacattatctgcttatggaagttgtgcccttcacttggttagtaaccacctcagccataatacttaccatcataggtttcttaaaatgctttttttttttccctaaacttgagtttccttagtgatttcaaaatgaagtataagaatatcagatccagttagcaaaagcctaggacttgtttctccaaacattgtactaacattcaacttgttttaaaattatgactcaagaattttaaaaaattattctggacatgaattaaaacttttttataatataagtatttttctgattgaaaaaaggatataattgacttcactctaattgtcatgtatatttccataagtaaatggattttgaagtattttwattttttgaactttatttaaagcatttgtgatgacatgttcaacttttgcatgtatgtagcctttgaagtaaaaataaatrggaatgttaggcycmcgcaaaaaaaaaaaaaaaa

SEQ ID NO: 18981 - DNA, 463 bp, Homo sapiens
  misc_feature 401: n=a, g, c or t
gaatttaatgcctcagtttttaaaaaaggatccttacacttcatgtctcctagccatcagaagaggaatgagacagcaaaagttcaaatggcctgtttcaagtttctgatataaaacgatgacattttcaggaaaatcctgcatttccagagagagactggctggttaaatttctgaaagaggacaccagctaaaagaagggtcattccggctgcttttttgagaagtccctgaagagatcaataacagcaagagggaacctggcaaggaagctattcctataatccaggaaagagatgaggaaggcttggaccaggtggtagtggtgtcaggtagtcaaatgctgggtatattttgaagatacaccccataggatttgactacctgmcaccactaccacnacccaacccttctcactctcctcagtgctagcactttgtattttttgatacttttatacttg

SEQ ID NO: 18982 - DNA, 493 bp, Homo sapiens
taacacttacatttccataaagaaaactcaagtattaataaaagagactttactggcttaagagggctgtgaaagatttttgatagtgaatcatgaccctaagggagagatttgtgtgataaaagtattgtatataatagatcagcgatttttgtaaggcaaacagaatttgtaagttggcagatcttcctaagttgcaaaatgtaatgatgagcttggtggagaagaatgagtcgttcttggaatacctatgtgcagccactacccatctcaatgtcaccttgtttgcattcttggatagcttgtatatgtagtagtttgatgaataatttaaagaaaaacacctaaaatttgaaaaatgattgtaggatcaaaaaaggcagatgaaattacttaatactcagtgttttggagagtattccttttagtttgttggttggctggcttgaacgatagaaatatgcagcatsaatatatgcttatatttcatttt

SEQ ID NO: 18983 - DNA, 378 bp, Homo sapiens
aaaaaggaaaacgcgggcttatcgtggcctttaaaatccggcttggtgagcttgggtcgcctctgaaggagaaccattttccatctctttcatagttttttccccctcagcgtggtagcggtattctccgcggcagtgacagtaattgtttttgtctctttagccaagacttccgccctcgatcaagatggtggttggacggccttcctaacctttacggggcctggcggtgctgacgcctgagctggtaggggtggagcaggtaggaaacagcaaatgcagaagctgctgcgcgggagtcggccatggactggaaagaagttcttcgtcggcgcctagcgacgcccaacacctgtccaaacaaaaaaaaaaaaaaaa

SEQ ID NO: 18984 - DNA, 507 bp, Homo sapiens
aagaaagttctagtggcttgaggtatccgcagagcgccgggtggcgggaggaaccgttacgggaactgaagttgcgggcctatgttgtccttggccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagccgagtagggactcctcccctgtcctctacgaaggaaaagattgctattgtcgtactcacctccgacgtactccggggtcttttgggagttttctcccctaaccatttcaacttttttttggattctcgctcttgcatgcctcccccgtcctttttcccttgccagttccctggtgacagttaccagctttcctgaatggattccggscccatccctcacccccaccctcacttt

SEQ ID NO: 18985 - DNA, 509 bp, Homo sapiens
gaataatgtgagtgcgcttgaaaaagagacctcctgctccgcgggctcggggcaagagccgcaggctaccttccccgggcaggggcgctcaacccaaccggctccagggcactgatctgcgatttccttctggttggctgtcctgcgtgggtgccaagttccacacatttaatgaataagaagctcgccagtgaggcaaactccagcattttatatttcatctgcccccagtgacttcactgtaggaagaggaaatgcagaaaaacaaacgtcttgaatactgaaagcctgttattcaaagaggttagcagtagactgttggaagtaaggagatgtcagtgaaaaaagggatccagaatgattactaacctatgactcccaacagtatgacagaaaatggccttacagcctgggacaaaccgaagcactgtccagaccgagaacacgactggaagctagtaggaatgtctgaagcctgcctacataggaagagccattcagagaggcgc

SEQ ID NO: 18986 - DNA, 433 bp, Homo sapiens
gcttagcgccccaggccgcccctgacactgaacgccgcttgtcccctccggcttgccgtcctcgcagccatggcgscgscgcgctcccagcatggctgtctctgcagtcgagggcaaggactctgcgtgcattctccactgccgtctactcggccactccggtcccgacacctagcctgcgtgccctttaaggaggcagaattacgattatgcagtgtatctactaacagtgttataccatgagtcttggaatactgaagaatgggaaaaaagtaagactgaagcagacatggaagagtatatatgggaaaatagctcatcagaaagaaatatcctggaaacgcttctccagatgaaagctgctgagaaaaatatggaaataaataaagaagagctccttggtactaaagaaattgaagagtacaaaaagtct

SEQ ID NO: 18987 - DNA, 479 bp, Homo sapiens
agtaagtacgaatcggccttaggttccctgcctcaagaccctattctcctgcctcacttttagctaagggttattacaaaagagtcagaaagttaagacaaaatatgaaagtttataaagtaaaaagagttacagtgagctaagtataacttattgaaaacatttttttaatttagtatagcctaactgtgtttatacagtctacagtagtatacagtaatatcctagacctccacattccctcgccactcactcactcactcaccgactcactcagagcaacatccagtcctggaagctccattcacagaagctattggaagagatgctcaaagaagaaaaaattaccataatccaataaagaagaagacctgagatccaggaagcagatgatctgaactgcagagaaagttcaggaaagttccctcattcatgatgatgggaaataacagtaaattctgtacagcagtcttggacaa

SEQ ID NO: 18988 - DNA, 489 bp, Homo sapiens
aagaaaaacgaggggttgcaactgccacgcagcaactgccacacagaagaaggagggactgcaactgccatgcagcaactgccacacagaaaaaggaggggttgcaactgccacgcagaaaaaggaggggttgcaactgccacgcagcaactgccacgcagaaaaaggaggggttgaaaagggagtagcttctgatattcagaagctattggaagagatgctcaaagaagaaaaaattaccataatccaataaagaagaagacctgagatccaggaagcagatgatctgaactgcagagaaagttcaggaaagttccctcattcatgatgatgggaaataacagtaaattctgtacagcagtcttggacaacaaccaatctaaactggcacagtgcagaggcaatcaacagagaacataatattgatagaatgcctgacgcttttgattgtattcacaggaaacataaacaattggaagacagtttatg

SEQ ID NO: 18989 - DNA, 478 bp, Homo sapiens
attttgtttctggactatctccctgcaactttcaacactactgaccagcgttccttcctgataagagaccaccaactatggagtggtactggcctgtcaatggaggatacacagtgagggtttttgtgtcctgtgtttcacgttttgacattagagagccaaaaactccatcctgggatcatgctgaagcaaccattttttgaacatgggacccgtgaaggggtttgaagctcaattgcacatgtgcatgtttctcctgtcataaatattcatgactcctcctatagtttattgattacctatatttggccacccagtctggcataaattcctgtcttatccttcctactcctaaactgcctgtatttggcttttggttgcatgctatgcttcctagcctttcagaatggccactctgcaggctgcttccttttataagaaataaagctcttatttccaaatctaaaaaaaaaaaaaa

SEQ ID NO: 18990 - DNA, 460 bp, Homo sapiens
actctaccattttgtttctggactatctccctgcaacttattatagaatagtttctgcttgcaaccatgaatcctgactgctacatgtggaagtgtgttctacaggactaaggcagaggctgaggcatcatcagcctacctgagatgatggaataattcaaggatcggaaagtgaatcaaagcagaatgcatgggagaaaacaggacagttttttagtctgctcatcaacatcattttatccgcattgttctcaaaaatctgaacattaagacaactcaagtgtgacctgaccagttcacagaacgctgagaatattacttagtacaatctcatcacaatacttctattttgcaatacaagatagccatattatactttgcttatattaagtttgtaactatctaaaatctccaagttttttagagcaatctacttccagataacatgtctattttatac

SEQ ID NO: 18991 - DNA, 528 bp, Homo sapiens
caatctgtatacaattaagagatttctgacatttattcttacactaaatggatcaactctaggatttaggcatgttaacttctgttgtgttttgaatctctccagagttgcatgtagatagcatttatttctgtgcccttaaacccatttagaaaataactacaaagtaaaaatgtagaggaaatagaaatgtattttttcatgaacattttgatacaaatttcatcatttaatgattcaccaattwcttgcattaatttgaatttaagcatttaattcaaagagaggggagcatccattattgatacatgtgggcttttaaaaactccatcctttataaatagtcaaggtttgggccacacaaagtatatttttatcatggaaaaatttcaactcctcaagccgtaatgttgmacagaattggagtattttctttataatttcttgaacaggcaaatgaaagcttattatagaatgcatgtattttcttttatctttggracatcagcaccaagtaatattgctgca

SEQ ID NO: 18992 - DNA, 506 bp, Homo sapiens
aaaaaaccaagtgttcatatgggatcaggcaaaagcaggtcctgaaggcaggatcctgaagatcaggcaccacctgacagccgtcatccgaaaggaaagaaaagaaaaaaggtacagcgcatatccacatcccaagctagtaagatgcggascagactggaagcagggagtctggaaaggggcagagagagtggagcagagaaagactcactgcagtccaaccagatggccaattaacagagcagtcaagaaagaaaccgcagtgaaaaagcttgtcagcacgctgtggctaaggctcctcatccaggacaggcatgaagcagcagatgcacacacagtgacaggtctgctgagaacagctggccactcaggagcccaggagagtcaccaacacagccaaggacaaaggtggagagtcccttaaacatgcctgactctgagatgtgtgaagtcgaacaggtagtgggaaataagaattatttttatggttagggaatagaaaaaaa

SEQ ID NO: 18993 - DNA, 377 bp, Homo sapiens
  misc_feature 265: n=a, g, c or t
aaaaaccaagtgttcatatgggatcaggcaaaagcaggtcctgaaggcaggatcctgaagatcaggcaccacctgacagccgtcatccgaaaggaaagaaaagaaaaaaggtacagcgcatatccacatcccaagctagtaagatgcggascagactggaagcagggagtctggaaaggggcagagagagtggagcagagaaagactcactgcagtccaaccagatggccaattaacagagcagtcaagaaagaaaccgcakganaaagcttgtcagcacgctgtggctaaggctcctcatccaggacaggcatgaagcagcagatgcacacacagtgacaggtctgctgagaacagctggccactcagggagccca

SEQ ID NO: 18994 - DNA, 367 bp, Homo sapiens
aaaaaccaaagttgttycatatgggaycaggcaaaagcaggtcctgaaggcaggatcctgaagatcaggcaccacctgacagccgtcatccgaaaggaaagaaaagaaaaaaggtacagcgcctatccacatcccaagctagtaagatgcggascagactggaagcagggagtctggaaaggggcagagagagtggagcagagaaagactcactgcagtccaaccagatggccaattaacagagcagtcaagaaagaaaccgcagtgaaaaagcttgtcagcacgctgtggctaaggctcctcatccaggacaggcatgaagcagcagatgcacacacagtgacaggtctgctgagaacagctggcc

SEQ ID NO: 18995 - DNA, 188 bp, Homo sapiens
aaaaaccaagtgttcatatgggatcaggcaaaagcaggtcctgaaggcaggatcctgaagatcaggcaccacctgacagccgtcatccgaaaggaaagaaaagaaaaaaggtacagcgcctatccacatcccaagctagtaagatgcggmgcagactggaagcaggggagtctgggaagggggcagag

SEQ ID NO: 18996 - DNA, 543 bp, Homo sapiens
aaaaaccaagtgttcatatgggatcaggcaaaagcaggtcctgaaggcaggatcctgaagatcaggcaccacctgacagccgtcatccgaaaggaaagaaaagaaaaaaggtacagcgcatatccacatcccaagctagtaagatgcggaccagactggaagcagggagtctggaaaggggcagagagagtggagcagagaaagactcactgcagtccaaccagatggccaattaacagagcagtcaagaaagaaaccgcagtgaaaagcttgtcagcacgctgtggctaaggctcctcatccaggacaggcatgaagcagcagatgcacacacagtgacaggtctgctgagaacagctggccactcaggagcccaggagagtcaccaacacagccaaggacaaaggtggagagtcccttaaacatgcctgactctgagatgtgtgaagtcgaacaggtagtgggaaataagaattatttttatggttagggaatagaaaaaaaaaaaaaaaaaaaaaaaagaaaaaaaaaaaaaaatgcgaa

SEQ ID NO: 18997 - DNA, 347 bp, Homo sapiens
aaaaaccaagtgttcatatgggatcaggcaaaagcaggtcctgaaggcaggatcctgaagatcaggcaccacctgacagccgtcatccgaaaggaaagaaaagaaaaaaggtacagcgcctatccacatcccaagctagtaagatgcggascagactggaagcagggagtctggaaaggggcagagagagtggagcagagaaagactcactgcagtccaaccagatggccaattaacagagcagtcaagaaagaaaccgcagtaaaaagcttgtcagcacgctgtggctaaggctcctcatccaggacaggcatgaagcagcagatgcacacacagtgacaaggtct

SEQ ID NO: 18998 - DNA, 518 bp, Homo sapiens
agtggcaccagcacttccggtacgaaaactcgctgctgccccaacctggcttgacaggcttggtctctgcaagtggctctcagccccttcttctttcctgcctcaccttccaattcgtttgccgccgccgtcccgcagctgctgtttccggagttgccccttccccatgttccggggcaggagtccgcaaagcgaagatccgcccgccrgttccycatcatgtccgaactgactaaagagctgatggagctggtgtggggcacaagagcagccccggtctctcrgacaccattttctgccgctggacgcaagggtttgtgtttagtgaatcagagggatctgcattagaacagtttgaaggtggcccctgtgctgttattgcacctgttcaggcatttcttttgaagaagctcctgttttcttcggagaagtcttcttggcgggattgttcagaggaagagcagaaggaactcctttgtcataccttgtgtgatattttagaaagtgcttgttgtgac

SEQ ID NO: 18999 - DNA, 533 bp, Homo sapiens
aaatctgaaactttataatagttttattgttggtaatttaaaagctgttttatgtatagtgcagcatcaagcaaattagtatgttcatggtattagaaactaagactttcaggaatagatatggcatacaaatataaagtcaaaaattaaggattttttaagttttagagtgatttatttgggttttattttggagtatggaaatgtggaactagatagaggtggtagttgcacagcattgtgaatatactaagcatgactgaattgttcactttaaagtgtttacttttatgttatatgaattttgcctcaataaattaaaacaattttgttaaagacataggagtctggctttgttcatagcaaaacgggttgtattagactatttctcctgtgttaaaaattatgaaccctcgataaaatacgaaaaaaggtatttgaaggcctagagcaaccaaaagcaggcagaaactagagggacgtcaamccttaaaagaagggratcatactgggtgtgatcacatttatatagc

SEQ ID NO: 19000 - DNA, 190 bp, Homo sapiens
acttccggctgtgtcggcgcgcgaaaaaaggtcctgggttggaatgtttgtactggtctgtggcggtggttgtcggctgtcctgccaggaaaactcggcactgactatcccactgctgatgctgtaaaagaggtccttctgctatgacgcaactgtggttcctctggttctggggacacttaggcctcgc

SEQ ID NO: 19001 - DNA, 199 bp, Homo sapiens
  misc_feature 88,183: n=a, g, c or t
acttccggctgtgtcggcgcgcgaaaaaaggtcctgggttggaatgtttgtactggtctgtggcggtggttgtcggctgtcctgccangaaaactcggcactgactatcccactgctgatgctgtaaaagaggtccttctgctatgacgcaactgtggttcctctggttctggggacacttangcctcgcgtgccgatt

SEQ ID NO: 19002 - DNA, 822 bp, Homo sapiens
aggcgcttcccgcaccttcccgctccctgcttgcaaagtggttgtgccccaaggtccgcctccaggccacgtgggtgctgcgggccaagctttcccttcctttgagagaggtttccgctgtaggagcagagcttccgggctgcgctcttcgttgcccagtttccgctcagtggtcgcgtctccgccccccacccaccagtcccgctgcattctcggccgggctctaggcgccatggctccccgcgggaggaagcgtaaggctgaggccgcggtggtcgccgtagccgagaagcgagagaagctggcgaacggcggggagggaatggaggaggcgaccgttgttatcgagcattgcactagctgacgcgtctatgggcgcaacgccgcggccctgagccaggcgctgcgctggaggccccagagcttccagtaaaggtgaacccgacgaagccccggagaggcyttcgaggtgacgctgctgcgcccggacggcagcagtgcggactctggactgggattaagaaggggcccccacgcaaactcaaattccctgagcctcaagaggtggtggaagagttgaagaagtacctgtcgtagggagatttgggtagaagccctcatgctgagctttgtgtccctggtgatgttggaacattaatgatggaacatggccaaacttcagtcatgatcctgaagccatggtttcttccctgccagaaatgaaggttcagttatgaggcaaccctctagtaaggcattgtaaaakttactggatttggtttaataaaagttgaaataaagaaaaaaaaaaaaaaatgcgaa

SEQ ID NO: 19003 - DNA, 354 bp, Homo sapiens
  misc_feature 348: n=a, g, c or t
gctgtaggagcagagcttccgggctgcgctcttcgttgcccagtttccgctcagtggtcgcgtctccgccccccacccaccagtcccgctgcattctcggccgggctctaggcgccatggctccccgcgggaggaagcgtaaggctgaggccgcggtggtcgccgtagccgagaagcgagagaagctggcgaacggcggggagggaatggaggaggcgaccgttgttatcgagcattgcactagctgacgcgtctatgggcgcaacgccgcggccctgagccaggcgctgcgcctggaggccccagagcttccagtaaaggtgaacccgacgaagccccggaggaagnctttcg

SEQ ID NO: 19004 - DNA, 415 bp, Homo sapiens
aagttctagtggcttgaggtatccgcagagcggccgggtggcgggaggaaccgttacgggaactgaagttgcggattaagcctgatcaagatgacaacctcccaaaagcaccgagacttcgtggcagagccatgggggagaagccagtggggagcctggctgggattggtgaagtcctgggcaagaagctggaggaaaggggttttgacaaggcctatgttgtccttvgccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagcccgagta

SEQ ID NO: 19005 - DNA, 407 bp, Homo sapiens
ctttaaatactgatggggaaatatctctaagatggaacagtactgggaagaaagttgatgtaaaaccatatatattataatttgcataaaaaagtaaaatttttcttgtgtatgcattaaaaaattatagacacaaggctacccaagaaaacttaagatagaggagacaacagtgaagggtcacttttcatggtgtatatttttatatcttatctttgcatatgtgaatatattaattattccagaatgtatgtgtgaaatatttgacattaaaaacatgtaaaattggccaggtgcggtggctcatgcctgtaatcccagcactttgggaggctgaggtgggcagatcatgaggtcaggagtttgagaccagcctggccaatgtggtgataccctgtttctactaa

SEQ ID NO: 19006 - DNA, 701 bp, Homo sapiens
tatgaaagtatgtatattaccatacagagaagaatgcgaatactataaagagttcttatacaaacagataatatagattttgtatcaatcattcaccttttttgagatttttaaatgagaaaacctataatgtataaaatacatgtgtgtatgtatgtatgtgacacagttactaaaaataggcttcttaaacttacatctcaatctggtagataaagtacataaaagaatatggaattttagtacctatattaagtgtttttaatttttgtataatatttagtacctgattagcgtgtatgcaaaaaagtaatttgcttcgtttgttgaattagaagccagctgccttactaaactaccacatttgctttgctcattctcttggctttgcagatagaaaattatatcatctgcatatagtgacttataatgattattttacttctccattttactacttgtaattcttttttggtatcagttgtataatgaaatggtttgaacattcaaagtgttaagtaatcctgatcgkaactgctgtctttgcaaatggagtgttttctagtgttttaacaataaacgtaatactgactctagctttgagataaattcttttaaaaatattattcagggagaatatttgtttcctawcttcctgtgtatagtattgtaataaaatctctgttaaaaactaaaaaaaa

SEQ ID NO: 19007 - DNA, 508 bp, Homo sapiens
aagaaaggatattcttagataactgcctcctgagggtgattctggttttgctcactccacggagatggacctggcagaggcttcaacaaaaaagtcaaaaccccaagctcttgggaactgacgtagaaggaagcaggaagaaggaagatgaggcctggtggagtttcttgactggaaacaattagctgcattgttttttatacggtttctccagctgcaccctctttcctgagcattgaaaaatacagatgagaagcagagggaggttgtagtttctatttggtcacagagagtaatcaagtggaagccagatcaccatttacaagaaagactgaatgggagatttggacatgtacgattctatgagactgtgtgaaatgtgtattcacatagtactctgttaccatagtaaccagtcacgtcaggcttcctaggagtctagggaggagctgtcaactttcacaactagttcattcacaaacaacccttsttacaaaatgctttgtga

SEQ ID NO: 19008 - DNA, 478 bp, Homo sapiens
aaacatattagacccacctgaaaataatatagccaatttctaggtaatcttactgctttgtgggtttctttccatgtacatctacctcttccagctgttttaagttttctcaagtctgtgcctatgaaatctcatccaacttttgattattcatggattgattatccgctttttttttgcttttttgctgccattgctatgcctggtctcgtctgcatcaaatatactacatatcagcaactttagagaatgggttcaacagggagtggagagtgaagctaatgtaaaatagtttagtggcagtgggaatctttggacttcatttacctctctcattatttctattaccatggataaaaaagtcagctgctacgttgatatcccttctatgagcacattcttagcagaagaaaacaatccaactaccaacacccgactctattggtgcatttaaaatgtgattccattttttcttaca

SEQ ID NO: 19009 - DNA, 508 bp, Homo sapiens
tcaaaattaatttcttaggaaaaaatttaaaagtatatttaagtactctggatagactgaaacgtttccatgttatttctgcagttgtagacttaggcttatttgtaaagaagcatgctccattgactgccatctctagtcttgcagtgggtggtattaacccatagaaagcaagcagttgtgtatcacatagacaatggttatgatgtaaacagattcagttgttttgttgttcattcgtcatatgtttgtgatagggatgttgggagcacagctctattctgcctgctcagacttaagttagacccttatcttttatattatgtcatgaaaaaagtctcctaaaattgtgaaactagttcttgatgagtgatgtgatcatcagcaataaagatataataactctgttttcttagcctgtatagaggagaggaacttgcttggctttaaaatatatttatttgccatttaagtataaatatgaaatctgtttcttattgggaagata

SEQ ID NO: 19010 - DNA, 436 bp, Homo sapiens
taaagatttttataagtatgttattttgcataaatttaaaaatggatttaccttaaaaaagtgacataaaacttcagtcacaaactaaatgcaaaaatttattttatattcttgtactaaaaatcacaattttgggctgggcatgatggctcacacctgtaattgtagcattttttgaggttgaggtagaaggattgcttgagcccaggaatttgagaccagcctgggcaacatagtgacactctgtctctacaaataaaaaagaaaaaaattagtttggcacgttggtgcacacctgtggtcccagctacttgggaggctgaggtgggaggattgcttgagccggggaggttgaggctgcagtgagccaagattgcaccactgcactccagcctgggcaacacagtgagaccctgtctcaaaataaaaaaaaaaa

SEQ ID NO: 19011 - DNA, 481 bp, Homo sapiens
atagtcgcagattctgtgtgaacatttggttgataatttaatggaacaatggttctttgggagatgccattagaacaaaatacctgtgatggagacaataataaagactgagtcaacagaagcaccgccactgaactttcaacttcctcaagaagtttggaagcaagattgggtatcagtgatgggggcttgggggatattaaaaaagtgatacatcttttactggaatttcacagtttttgtcaagggtctctccactcagttctctgggaagaggcacaatttaaacagcgtaagtgccaaagatgaggatgtagatgttctctactgtctcacagaatcaacctctcctcaccgatcaagtcctcaggggacatctgaaataatcctaatggagggtgctgtcagccgccgctgcacctgctaaatgtcttgagatccgcaaaggctcacctgaatgctttgcacagttgcctctgag

SEQ ID NO: 19012 - DNA, 483 bp, Homo sapiens
  misc_feature 141: n=a, g, c or t
atttaccagagggagccagggctgcagctcatctgtttgcggatcagaacccgagctgttcttgtggctgcggctgctaactggctgcgcacagggagctgtcaccatgcctcactcgtacccagccctttctgctgagynaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccagtcctgttcagtgctgatgaccgtgtgaaaaagtgcattggaggcgtcattttcttccatgggaccctctaccagaaagatgataatggtgttcccttcgtccgaaccatccaggataagggcatcgtcgtgggcatcaaggttgacaagggtgtggtgcctctagctgggactgatggagaadccaccactcaag

SEQ ID NO: 19013 - DNA, 448 bp, Homo sapiens
  misc_feature 172,430: n=a, g, c or t
atttaccagagggagccagggctgcagctcatctgtttgcggatcagaacccgagctgttcttgtggctgsggctgctaactggctgcgcacagggagctgtcaccatgcctcactcgtacccagccctttctgctgagcagaagaaggagttgtctgacattgccctgcgnattgtagccccgggcaaaggcattctggctgcggatgagtctgtaggcagcatggccaagcggctgagccaaattggggtggaaaacacagaggagaaccgccggctgtaccgccagtcctgttcagtgctgatgaccgtgtgaaaaagtgcattggaggcgtcattttcttccatgggacsctctaccagaaagatgataatggtgttcccttcgtccgaaccatccaggataagggcatcgtcgtggggcatcaanggttgacaaggggtgtgg

SEQ ID NO: 19014 - DNA, 428 bp, Homo sapiens
atttaccagagggagccagggctgcagctcatctgtttgcggatcagaacccgagctgtgcttgtggctgcggctgctaactggctgcgcacagggagctgtcaccatgcctcactcgtacccagccctttctgctgagcagaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccagtcctgttcagtgctgatgaccgtgtgaaaaagtgcattggaggcgtcattwtcttcmatgagaccctctaccagaaagatgataatggtgttcmcttcgtccgaaccatccaggataagggcatcgtcgtggggcatca

SEQ ID NO: 19015 - DNA, 484 bp, Homo sapiens
  misc_feature 142: n=a, g, c or t
atttaccagagggagccagggctgcagctcatctgtttgcggatcagaacccgagctgtgcttgtggctgcggctgctaactggctgcgcacagggagctgtcaccatgcctcactcgtacccagcccttttctgctgabsnaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccagtcctgttcagtgctgatgaccgtgtgaaaaagtgcattggaggcgtcattttcttccatgagaccctctaccagaaagatgataatggtgttcccttcgtccgaaccatccaggataagggcatcgtcgtgggcatcaaggttgacaagggtgtggtgcctctagctgggactgatggagaaaccaccactcaag

SEQ ID NO: 19016 - DNA, 220 bp, Homo sapiens
ttattgtggcagctgctgcctcacccacagcttttgatatctaggaggactcttctctcccaaactacctgtcaccatggcccaccgatttccagccctcacccaggagcagaagaaggagctctcagaaattgcccagagcattgttgccaatggaaaggggatcctggctgcagatgaatctgtaggtaccatggggaaccgcctgcagaggatcaag

SEQ ID NO: 19017 - DNA, 484 bp, Homo sapiens
gaaacggccactccaggctcaacctatccatcccggcctcttcctaagaccaaggcgctgctgactcaaccctgcttccagaagcctagggttaacatctgctccttcctcctgtttgcattcagtgaaatcctctcctctcccaggagtttccacataaaacctgsctctttgtttattaagaattgtttacagaactctcaagcagcaaaggcaaagtacagaagataaataagagcaagctggccggtgcgtgcgactggatggacaacatctttacccacatgtctgcatcagctctgcgttgttcaccgacaaatcccgtgtctggaagagtcctggcaggctgcacgggctggagagagagcgagctgacaccaacaccaggcagagtccaccatgaaggcaagtggcagtgtcccaaggagagcccgctggccaggagggcaccgcaagcttggacacagcaggggcactggagatg

SEQ ID NO: 19018 - DNA, 482 bp, Homo sapiens
  misc_feature 140..141: n=a, g, c or t
atttaccagagggagccagggctgcagctcatctgtttgcggatcagaacccgagctgtgcttgtggctgcggctgctaactggctgcgcacagggagctgtcaccatgcctcactcgtacccagccctttctgctgaknnaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccagtcctgttcagtgctgatgaccgtgtgaaaaagtgcattggaggcgtcattttcttccatgagaccctctaccagaaagatgataatggtgttcccttcgtccgaaccatccaggataagggcatcgtcgtgggcatcaaggttgacaagggtgtggtgcctctagctgggactgatggagaaacaccactcaag

SEQ ID NO: 19019 - DNA, 428 bp, Homo sapiens
aataggtgtgcccatggatatagattgctgtcgtcggatgataattagtgaagttaaggatgtcagggaactctaaagccaggttggtacattattaaaagccatgggccctgacatcacrcatgatgattataatgtgaagagacgagactgagactataaagaaagaccaggagtgagctaacttgaatgataccaaggaagatgatataatatgaaggtaggagcctcatgagagagaagaattttgcttgaaagatgaaaagtaatagtttagaaggratcacaatgtttgatgattgatagtattccaacaccattgccagaytccatggtagatgraatatgggaaattaagttcattcatctcaagaaagctaccagtaaaaaagtggccttgaacttggataatacatacaccttatcac

SEQ ID NO: 19020 - DNA, 497 bp, Homo sapiens
tgtgaatactgagctgctcggctatctgcaggttttccctggcttgctggaaagagtgattgatcttttgcgggtgattcatgtagctggaaaagaaaccacaaacatcttcagtgattgtggttgcgtgagagcagaaggtgacatctccaatgtggccaatgggtttaagtctcatctcattcgtctgattggaaatctgtgttacaagaataaagataaccaagacaaggtaaatgagctggatggtatcccgttgatcctggacaactgcaacatcagtgacagtaacccctttctgacccagtgggtgatatatgccatccgaaaccttaccgaagacaacagccaaaaccaagatttgattgcaaagatggaggaacaggggctggcagatgcatccctacttaaaaaagtgggttttgaagttgaaaagaaaggcgaaaagctgatcctgaaatctactagagacacccctaagccatgaatgaactaca

SEQ ID NO: 19021 - DNA, 325 bp, Homo sapiens
acagataaggaagctgagatgtagagctgaagtgtcttgcccaagatcatttgtctagtaagtgataaagctggaatttgaacccaaagagaatagggctagaggctttctctctactctcccctggttctccaaagtgagctacctttccatttctatggctagtttatgaaatacagtcatgaaacaagagctctacaattatatgtcaaaaagcagaagatagaagtaggttaatcctgcttttggaaaaaagtgttcagaatatacattaaagtaatactaacgtaaatctgtggacatgaaaaaaaaaaaaaaatgcgaa

SEQ ID NO: 19022 - DNA, 490 bp, Homo sapiens
aaaaactagtatataaaacagaatggagttttacttctagcaatagctcctattggaccaatcttcctgtagatagcatttataactctcaacaaactatgtaaaatgactatctgaaggtactacagtctaaagcatgcagaaatgggaaggaaattgatactgagtgaatttcccatttttacagcttttcacttgaagggatgacatatttcgtactagctgggtcaactagaacttggataaaaatctgtggtcttattatcttgaagaatgagaggacagttctacatgaattagagttcagggttaccacagcagctggaagataaaggaagaaatccaggaaaagagagagcaacagaggaggagccccaaactctatgtataaactctgcttaaaaaatctctggatgatccctgaactacacatgtatggggcagattgaaagcatatcagctaaggctatataaagatttcagctctttc

SEQ ID NO: 19023 - DNA, 509 bp, Homo sapiens
attccaactttataaactagcaaaaaagtgtttgcttattccaccagttctactgtgacatactcgagtataaagacatgtagcaataacggggagtggggggggagtctcatagtgcctttggaagggcccgaacttgccttaaatcttcctcaaccaaataagtattttattagtgcttgagagaatctgaatgtaggatgggttcaactgcacaaaaggaaaagatttttaccactttttttatatagatataaagtgaagcaaccgccttagtgctgaaatatgtagtacatgaatatgccttgtttaattacagaaaattccaaaacttgtactatttttttttccatgtagaaaggcaggaatgtctcctaagctttcctggacagcagatgaatgagcggtactttagtttgtacgtaggtacagttggagcactatatgtactctctggactactttggacagaagtaggtttttgaatgtaacaagataagtcacttgag

SEQ ID NO: 19024 - DNA, 514 bp, Homo sapiens
attccaactttataaactagcaaaaaagtgtttgcttattccaccagttctactgtgacatactcgagtataaagacatgtagcaataacggggagtggggggggagtctcatagtgcctttggaagggcccgaacttgccttaaatcttcctcaaccaaataagtattttattagtgcttgagagaatctgaatgtaggatgggttcaactgcacaaaaggaaaagatttttaccactttttttatatagatataaagtgaagcaaccgccttagtgctgaaatatgtagtacatgaatatgccttgtttaattacagaaaattccaaaacttgtactatttttttttccatgtagaaaggcaggaatgtctcctaagctttcctggacagcagatgaatgagcggtactttagtttgtacgtaggtacagttggagcactatatgtactctctggactactttggacagaagtaggtttttgaatgtaacaagataagtcaactttgagttg

SEQ ID NO: 19025 - DNA, 501 bp, Homo sapiens
tgatttagataattataaatgttataaggaaaaataactgggataaggaaaggtagctattttaattggataattaggcatacttctctcatgcataacaaatattctaattttgttcaatccataccaatattttttggattataaaggtaatacctttttttcaactccattttttctaaaaaagttagttatattgtttattattttacggaccatgaaacatgatggaaaccggggaattgagatgtggccagttgttagtttgtaaaatgacatttaaaaattaccatctactcatcacctcatcatttgacaaaacaatgcatgttttaacaccaaaaagtaggaaagatgtaatcccagaatagagggcagttgaatacgtttagtgttttggaaaatttgctgcattatctgaggttttctccttttcatggcctatgagaacttcatcagggactggttctggtcaggggctggcatccagttccacagatc

SEQ ID NO: 19026 - DNA, 293 bp, Homo sapiens
agtcacagcctcagccgcagcggccgtgctacctaggtgatagcggascytgggtaggaagcaattgttctcaaacttcactagccccgtcggcgcggacgcttgtcgagaatgcagattcctgggtactgccagatacgaattgagcataccacaaaaaagttctcattttgtgtcctcccatcccattctcctcactaaccaaaggctaggaattatctgtgaatgtaggaccactggatttgcagtcttcatctgacactgtggatagtttctaggaatgaaacagatat

SEQ ID NO: 19027 - DNA, 470 bp, Homo sapiens
aaatcggttagcgcgcggtacttatatggcagtatgtgtgcgagtgatgccgaggttgtgagttcgagcctcacctggagcattgttttccaacccaaaatagcattacttgaagtgcctttccccctgtaatccgactccatcgtctttaacgtgtttggaattgtgtacacagtttattgttattggtttccttagcctttttagaaccaagcaacgccaattaccaacaaaatccgttgcgccgcagatcatcgatcatcgttcctcggggagcccctggcacatacttagtgctaagaaactcccatcagctttgcttgaggcaaatgcaacaatatttcagagtgaggattcagccaaacatctctaagaagaaaacctctggacacagcaggacacagaaatactgaaatctccagcctagggcaccatccctcaagttaaagcccaggcagtaagaaaacata

SEQ ID NO: 19028 - DNA, 440 bp, Homo sapiens
ttaatttgttcccagtggttgaagttatttgccaacaattttactgtttctcttcatctgtttataggatttctctgcctcttccaaacttttcctccctgaacctgaggggtaagcattttatttccctttaggaaaaacgtcagctgcttgtaaccactgtgtttatgtcaaagcattcattttttttaggatatctgaaaaaatgccatataagagaaaactctataaaacatctataattttcgaacccaagtacactcttgcattctatgctttaagttaaatgcaaactcctttttccttcttcctgctgcaagtactatctcatcctgatgctcaagagtgtcagggcctgggtttccaaacagagactaccctaaaattatttggggagtagtactttacacaattgcctctcccccacaaatcataattgt

SEQ ID NO: 19029 - DNA, 550 bp, Homo sapiens
catcataaggaaaacgtgttgcgcatctctagtttgatatgagctttagtatctccccactacagtgcgagaaaagtcagggcaaaggattgaaaagaagttcacaacaaaaaagtttgaacacaagcaaacctgaaacagatgcagggtagtagatcttaagggtgcgttgctcactccagggcctgctgccacccagatggctggcaaacaccaggactccgaacacaacaggattcagggattcagacaggagtcttgctctaccaattattataggatcttagatgcctttccagtaaagctaacaaaaaacaaaacaaaataaaaccatatccaaaatactaaacagctgtctccaagatcagaaggcatcagaaaagaccctcaagagttgtctaatcccagaggaagatcttaagtggggatgtgctcacagcagaaaccttggaaatttcagggagtgaaattttattgtcagaactttcaataaaagtgtagccacagatcctgggagcattaaataaaaattaccaacaagctgtcttac

SEQ ID NO: 19030 - DNA, 470 bp, Homo sapiens
taattttagactgtgtatttccataaataccctacgtactggcatatttgaaactctttttccaggttaggtccttttctttctcattgaatcatcttaaatagttcttggccctgaatttagctgatttaaaattcttaatattcaagaatttatacttattttttccttaaaagccacaggggacagttaaatatcttaaaatatctaaaacattttttaaagcacttagattgtcttacgtatgtgcatactatacctttacagcgtttattgtcttgtctcttgtcagtagaccttcagtacacagtatgtgggatatgtcagtcaagttggtcagcaccagcatctgtccagctgttcagtatattgtgattcmttaaaaaatctcttctatcccagacatgggccaaggtgctgtatctgagggatgtgctgtaatttgatttacatgcattagagcacacagt

SEQ ID NO: 19031 - DNA, 531 bp, Homo sapiens
acttccgccgccgstccgccgcctccggaactaaacgcggtgaggtcacattcggttatctctaacgttggaaaacggtgggtagctttccagttgccgttaatttagaaaataagcaaaacgtgttgaaaaaataaaaccctgccagatggagctaacacccattatggagattaaccacttttcatcaggtttttaacttaagtcgtgaggaatacaacggtgaacacaagattcattttattttcatcaccatgggacgtatcctgttgttgagttctctgggtcagacctctgaagacttctcagatggatcctagtctctgggcttgcctgaaattactcgctgctcagggagagagttgaaatggttagtcttgttcaaagtcaactcatctaagacacttcgcaggcccttgctatcagcctcaacacagtgataaaggacaactttactctggcatctgaacagagcccaattggaagaatcaatacagcttagatggaggtctcctcatccagtggtaatta

SEQ ID NO: 19032 - DNA, 505 bp, Homo sapiens
  misc_feature 455: n=a, g, c or t
acattcggttatctctaacgttggaaaacgatggagctaacacccattatggagattaaccacttttcatcaggtttttaacttaagtcgtgaggaatacaacggtgaacacaagattcattttattttcatcaccatgggacgtatcctgttgttgagtactctgggtcagacctctgaagacttctcagatggatcctagtctctgggcttgcctgaaattactcgctgctcagggagagagttgaaatggttagtcttgttcaaagtcaactcatctaagacacttcgcaggcccttgctatcagcctcaacacagtgataaaggacaactttactctggcatctgaacagagcccaattkgaagaatcaatacagcttagatggaggtctcctcatccagtggtaataaaacatcccacatagtgagcttagagagcacagcactgggatntaaagacatgggtcaattgcacctctgcatgtcagctgtcacttggcaat

SEQ ID NO: 19033 - DNA, 459 bp, Homo sapiens
acattcggttatctctaacgttggawaacgatggagctaacacccattatggagattaaccacttttcatcaggtttttaacttaagtcgtgaggaatacaacggtgaacacaagattcattttattttcatcaccatgggacgtatctgttgttgagtactctgggtcagacctctgaagacttctcagatggatcctagtctctgggcttgccctgaaattactcgctgctcagggagagagttgaaatggttagtcttgttcaaagtcaactcatctaagacacttcgcaggcccttgctatcagcctcaacacagtgataaaggacaactttactctggcatctgaacagagcccaattggaagaatcaatacagcttagatggaggtctcctcatccagtggtaataaaacatcccacatagtggagcttagagagcacagcactgggatgtga

SEQ ID NO: 19034 - DNA, 460 bp, Homo sapiens
acattcggttatctctaacgttggaaaacgatggagctaacacccattatggagattaaccacttttcatcaggtttttaacttaagtcgtgaggaatacaacggtgaacacaagattcattttattttcatcaccatgggacgtatcctgttgttgagtactctgggtcagacctctgaagacttctcagatggatcctagtctctgggcttgccctgaaattactcgctgctcagggagagagttgaaatggttagtcttgttcaaagtcaactcatctaagacacttcgcaggcccttgctatcagcctcaacacagtgataaaggacaactttactctggcatctgaacagagcccaattggaagaatcaatacagcttagatggaggtctcctcatccagtggtaataaaacatcccacatagtggagcttagagagcacagcactgggatgtga

SEQ ID NO: 19035 - DNA, 447 bp, Homo sapiens
caaatcaaattaaagatgatttttttaatgtgaataaagttatgttctgatagtttgtacagaaaaaataaaatggatgcccatgttttattgctattactaaatgtcaagattgtatgctattatgtcttgtaaatttcttttgttggtgtaaatatggaaatgccacattggttaagtgccatcatttgtaatgcaatgtgtcacttgaaaagagatttgaagaaactgacaacttcaaaaacaaatgagaagcccaaggaactgtgagcaattaaaagcaaaccgcgacaccctttgtctccaccacacatagtgtactttggaagcacaacgtccaggctggtaccgcagcgccatgcccattcctcgcctcgttcataggacacttcactgccattttctattcacataaaagaaaaataaatgtggaaatttcatccttgg

SEQ ID NO: 19036 - DNA, 368 bp, Homo sapiens
ttgctattactaaatgtcaagattgtatgctattatgtcttgtaaatttcttttgttggtgtaaatatggaaatgccacattggttaagtgccatcatttgtaatgcaatgtgtcacttgaaaagagattttgaagaaactgacaacttcaaaaacaaatgagaagcccaaggaactgtgagcaattaaaagcaaaccgcgacaccctttgtctccaccacacatagtgtactttggaagcacaacgtccaggctggtaccgcagcgccatgcccattcctcgcctcgttcataggacacttcactgccattttctattcacatraaagaaaaataaatgtggaaatttcatccytgaaaaaaaaaaa

SEQ ID NO: 19037 - DNA, 516 bp, Homo sapiens
aaacaggtggccgttgtccgcgttgatggagaccagggaagagaggggcaggtgcgggtcctggggcggcagagcgaccacagaatagcgtcttgactcggacccagccagagaccctcccagaaaaacaaagagaagcaagacttgcctttgtctaagaaatcgctctcctcccgcctccattgcactttccgtcacgctcttccagggaatgtcgccaagctgaacctcagacagcgctgggaaacagtcttttgccccacaacctttgtagacggcctagtgaataagcctttccagaggctcagagttgctggctcaaaaatctgcctgggctctcaaccgctggtttaccacactggatccgtgcgtcaccgagcatgcacaatgcctgtggtttaattcgccttcttagtcaacagcgccaccatgcgttcgcttgcagttacaaaatcttggagaaggtgtttttattttgctttatcgattattcttatcaaccctagttgacgctac

SEQ ID NO: 19038 - DNA, 426 bp, Homo sapiens
agatgcagtagccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggatatgaaggaggtggagctgaatgagttagagcccgagaagcagccgatgaacgcggcgtctggggcggccatgtccctggcgggagcgagaagaatggtctggtgaagatcaaggtrgcggaagacgaggcggaggcggcagcgsggctaagttcacgggcctgtccaaggaggagctgctgaaggtggcaggcagccccggctgggtacgcacccgctgggcactgctgctgctcttctggctcggctggctcggcatgcttgctggtgccgtg

SEQ ID NO: 19039 - DNA, 580 bp, Homo sapiens
gtagtccagcgacctgagggcaaacaggtggccgttgtccgcgttgatggagaccagccacagaatagcgtcttgactcggacccagccagagaccctcccagaaaaacaaagagaagcaagacttgcctttgtctaagaaatcgctctcctcccgcctccattgcactttccgtcacgctcttccagggaatgtcgccaagctgaacctcagacagagctgggaaacagtctttagccccacaacctttgtagacggcctagtgaataagcctttccagaggctcagacttgctggctcaaaaatctgcctgggctctcaaccgctggtttccacactggatccgtgcgtcaccgagcatgcacaatgcctgtggtttaattcgccttcttagtcaacagcgccaccatgcgttcgsttgcagttacaaaatcttggagaaggtgtttttatttttatcgattattcttatcaaccctagttgacgctactggaggagtttctcatgttatatgaattaaataaatgcaatctagggaaataaaatgcacttttatctacgaaaaaaaaaaaaaaatgg

SEQ ID NO: 19040 - DNA, 309 bp, Homo sapiens
akcgcccacgcggaactcgaactcctgcagggcctcgtagtccagcgacctaagggcgaacaggtggccgttgtctgtgttgatggagaccagggaggcgaggggcagaatcgcggtcttgaatgctgaaaagagctgcaacggtctcaggagaattttcgcggatggggcttgtgaatgaagccatggtcagttccggagcgttatcgttgatatctaccacctgtattatgacagtgcattttccagaaagacctgccccatcagaggctttaatatccacctgatatgacacaatttaaaaaaaaa

SEQ ID NO: 19041 - DNA, 369 bp, Homo sapiens
gtagtccagcgacctgagggcgaacaggtggccgttgtctgtgttgatggagaccagggaggcgaggggcagaatcgcggtcttgaatgctgaaaagagctgcaacggtctcaggagaattttcgcggatggggcttgtgaatgaagccatggtcagttccggagcgttatcgttgatatctaccacctgtattatgacagtgcattttccagaaagacctgccccatcagaggctttaatatccacctgatatgacacaattttttcaaaatctagttttctgattattttaatttctccccttcgttcattaagtgcaaatgtcttagaaatctcttcatcaccataaaaaatgagtagaataaaaa

SEQ ID NO: 19042 - DNA, 424 bp, Homo sapiens
aagttgacgaggggtgggcttgtgatggttaatactgagtgtcaatttgactgggttcaaggatgcaaagtattgttcctgggtgtgtctgtgagggtgctgccaaaggagattaacatttgagtcagtggactgggagaggcagacccaccttcaatctgggtgggcagcatgtgatcatctgccagcgcaaccaagataaagcaggcagaagaaggtgacttgctgcgtcttccagtcttcatctttctcccatgctggatgcttcctgcccttaaacatcagactccaagtttttcagcttttggactcttaaagttacaccagtggtttgccaggggctctcaggcctttggcagagactgaaggctacactgtcagcttctctgcatttgaggttttgggacttggattggcttccttg

SEQ ID NO: 19043 - DNA, 449 bp, Homo sapiens
agatgcagtagccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggatatgaaggaggtggagctgaatgagttagagcccgagaagcagccgatgaacgcggcgtctggggcggccatgtccctggcgggagcgagaagaatggtctggtgaagatcaaggtggcggaagacgaggcggaggcggcasgcggctaagttcacgggcctgtccaaggaggagctgctgaaggtggcaggcagccccggctgggtacgcacccgctgggcactgctgctgctcttctggctcggctggctcggcatgcttgctggttgccgtgggtcataatcgtgcgagcgccgc

SEQ ID NO: 19044 - DNA, 62 bp, Homo sapiens
aaaaatctgtgctgtcaaactgattaggacctgactaccacctgcaggtcagggccaaggtt

SEQ ID NO: 19045 - DNA, 301 bp, Homo sapiens
ttttttttcgtaactggaagtagtaatctggcggttgacactctcgttgcctgtatagctgatggcccactcacctttttagctgggctcctgacctgtccggccagaaagttgccactgggaaacctggacccctactgaatggatctgctggcacctagacctcagagaagggggaactgaagactgaagtctgaccactgttctttgttgaaaatttctttctcaggggcttggagggatcacatctacaatcctgagctaatattctcttctgctgtccccaaaatttaaacgaagc

SEQ ID NO: 19046 - DNA, 462 bp, Homo sapiens
acggtcgcgcgtcccacagctcccttcacgtccgttcctccgtttccccaccttgggagggccaggacttccgaggctttagggggcaggaagctgcgagaaggtggcgcttgcttagaaacctggacccctactgaatggatctgctggcacctagacctcagagaagggggaactgaagactgaagtctgaccactgatctttgttgaaaatttctttctcaggggcttggagggatcacatctacaatcctgagctaatattctcttctgctgtccccaaaatttaaacgaagcttctcttaacccattgcaaatgagaaaaatctttgaatctacctatgactataagcccttatttcaagatatcctgcctttttaggccagaaccaaagtgtamctccatctattgatttacaattttgcctgtaactttggctttcctgaaatttaccccagcca

SEQ ID NO: 19047 - DNA, 326 bp, Homo sapiens
ttttttttcgtaactggaagtagtaatctggcggttgacactctcgttgcctgtataggctgatggcccactcacctttttagctgggctcctgacctgtccggccagaaagttgccactgggaaacctggaccctactgaatggatctgctggcacctagacctcagagaagggggaactgaagactgaagtctgaccactgttctttgttgaaaatttctttctcaggggcttggagggatcacatctacaatcctgagctaatattctcttctgctgtccccaaaatttaaaaaagcttctcttaacccattgcaaatgcgaa

SEQ ID NO: 19048 - DNA, 417 bp, Homo sapiens
taaaaatgagatttgtataaaagagtgtgcagtccctatggtgttaaaatcactgatatggaggagaagaggggttggaattgtgacactgtggcagcagatgaccttggacaagtcagtttttcagactttcctcccttaaaatagggatactaaatctcacagggtggttgtctataatgtcacccacacgccatctcctctataactgcatttgtatgccaggaaattgtctgtgaaggcttcagtttagaatagcttcatattattttggggcactgctgggtgattttggttaaggctggggcaggagaatggcgtgaacccgggaggcagagcttgcagtgagccgagattgcgccactgcactccagcctgggcgacagagcgagactccgtctcaaaaaaaaaaaaaaa

SEQ ID NO: 19049 - DNA, 537 bp, Homo sapiens
taatgacttatggaaattactacattccatttccagaaagagctattttccttatcatcttggttctaaaacagacagcaagcattgatgtcaccttaatgtagaaacagaagtttaatctttcaattagttagtgtctatcattcatccaaaaattaattactggcatttaacttgttccttattttacacccttagcaacattaataaatcaatacatcaattatcattttttcaaaatgttatcagattcccaaaatatagtaattacatcatcactaggtctcttttgtgactggataagaataaaacaaattttgtaataatatgagaaatgtgtttaccactatgggattttgaaaatataatcttgagatattattcttaagagtcaagagaagcctctattttcctttttcaaggatgaaaatcctccagctttataaaccatagactagaccaaaggctgctcaggtaaatttgacagcaccatatttaggttactagcacaacataaagtcaatacattcttgctgg

SEQ ID NO: 19050 - DNA, 518 bp, Homo sapiens
acaaactacgtaaagaataaaaattgcatccctcctttatttagatatgctctcgccattgttccatctatgatgagcaccctttctgcagaaagtaaaaatggccttactaagaaaattaaatttatattctagtgctatttctttctttctttctttttctttttttggagatggagtctcgctctgtcaaccagactgaagtgcaatggcatggtatcgcctcactgtaacctctgccttctgggttcaagcaattctcctgcctcagcctcctgagtagctgggactacaggcacacgccaccacgcttggctaacttttgtatttttagtagagatggggtttcaccatattggccaggatggtctcaatctcctgacatcgtgatccacccaccttggcctccgaaagtgctgggattgtaggcatgagccaccacacctggccttcaagtgctatttctttgcagtaccaggggacaagcattctctttctaaataaacattttacatata

SEQ ID NO: 19051 - DNA, 508 bp, Homo sapiens
tttagttttgaagtagctatagggagcaggtcttctgccttttagaattagaatcatagagtcaaaggacattaagctgggtgggctttagatcagaatccaccctccttatttttcatgtgggaggaaacagaggctaggaaaaattcagtgatttgcctttgggtgtgggagtgttctggctgagacctctctcatgtccctcccttacttaaatccttcagtactggccgggtgcagtggctcatgcctgtaatcccagcactttgggaggccaaggcgggaggatcacaaggtcaggagatcgagaccatcctggctaacacggtgaaacctgtctctactaaaaatacaaaaaattagccgggcgtggtggtgggcgcctgtagtcccagctactcgggaggctgaggcaggggaatggcatgaacctggagggcagagcttgcagtgagccgagatcgcgccactgcactccagcctgggcaacagaacgagactccgtctc

SEQ ID NO: 19052 - DNA, 497 bp, Homo sapiens
gaatgaatataaaatattgtaaaagaaaaattcataaagtttatgataaccatacaaatgcagtcagcaaaccagccacattcgtgattattttttaactgtgtggtggtaggaggtgctccttacagttttccctttgcaaacatttattccttggtttaacccaccactcttaaaattgccatcactcactgattcaccaaaaattgggtaaatatcttaccttgtttttattaatctttcttaagtgtatgtatagctcacatgtattttgatgttgaatattagaagtgactgggttttttggccaggtgccgtggctcacgcctgtagtcccagtgctttggggggccgaggcgggcggatcacttgagatcaggagtgtgagaccagcctggccacatggtgaaacccctctctactaaaaatgcaagaaaaagattagccaggtgtggtggcgggtgtctgtaatcccagctactccagaatctcttgag

SEQ ID NO: 19053 - DNA, 450 bp, Homo sapiens
aagaaggggatacaagttcttactctggtcatgaattttattcggaatgtcagctcgggtttggttggttgaaaagcatcattcagaaggaaccaacaaggagagagggggaattcctgcaaaaagtaataaactaaaagaaaacctaaagggtataaatgtaraattaagtccttttactctctccagttgaactacctagagaaaaccattttaaatcacaatttcagaagattttaaaaattcatctctacctaaagacatcataaaatggctcattattccatcatccaggctcccctgtttctcaggcctccagactgaagctgaattataccaccagctctcctcagtctccagtttgcagacaacagatcatgggacttctcagcctccataatcacaggagtcaattcctcataataaatctgtctgsccccttaaaaaaaa

SEQ ID NO: 19054 - DNA, 482 bp, Homo sapiens
attctaggtcacagcgcaggcgcactaatagacaccttaggcgcggastgagcaagtggcagtttagggagcgttaactgcgcatgaacaaattgctgcttgcctcaaggttaaggctccggtggtgtaataaaggatctgagaatttaattcctagctgaattggttcgaacgcgtttctgggacttttaccctctgttttgtcttctaacgctgggtaaaggccgagggttagcaacttttatgcatccctagtagtgagggatccttaaaaatgtttttttgaattaatgaacaatattactgtaattatcattcatggagctctaaattcttaaactcttcataaacacattttctcatttgattcttagaacagtcttgtgaagtgggtggtatataccgctctcttagggcagggactgaccttccaaagaggaagaaccaattccaacctagatttatgcgatgccaaatgaatg

SEQ ID NO: 19055 - DNA, 465 bp, Homo sapiens
tagaataaagaagtggagtgctcttgtaacagaaacctaaaatacactgtttcttggtattgttttgcagacagggcagcaggtagcatgggaaccataaaatgaatctgaaaaattacaacctatattgtgcagtagtaaaatatttggcaaagtactagcctgtagtaatttataaggaaaaaaaaatgaggctaggggctgtggctcacgcctgtaatcccagcactttgagaggccgaggtgggtggatcatgagctcaggagatcgagaccatcccggctaacatggtgaaaccctgtctctactaaaaatacaaaaaattggccgggcatggtggcgggcgcctgtagtcccagctattggggaggctgaggcaggagaattgcttgaacccaggaggcggasttgcagtgagccgagatggcgccactgcactccagcctgggcgacagagtgagact

SEQ ID NO: 19056 - DNA, 372 bp, Homo sapiens
tttgtatcttgtttttctgatcggagcatcactactgacctgttgtaggcagctatcttacagacgcatgaatgtaagagtaggaaggggtgggtgtcagggatcacttgggatctttgacacttgaaaaattacacctggcagctgcgtttaagccttcccccatcgtgtactgcagagttgagctggcaggggaggggctgagagggtgggggctggaacccctccccgggagagtgccatctgggtcttccatctagaactgtttacatgaagataagatactcactgttcatgaatacacttgatgttcaagtattaagacctatgcaatattttttacttttctaataaacatgtttgttaaaacaa

SEQ ID NO: 19057 - DNA, 465 bp, Homo sapiens
tttatcagattgcctccttatgacgcggctcaaaaggaaaccaagtggtcaggagttgtttctgacccactgatctctactaccacaaggaraatagtttaggagaaaccagcttttactgtttttgaaaaattacagcttcaccctgtcaagttaacaaggaatgcctgtgccaataaaaggtttctccaacttgaagtctactctgatgggatctcagatcctttgtcactgcctatagacttgtagctgctgtctctctttgtccctgcagagaatcacgtcctggaactgcatgttcttgcgactcttgggacttcatcttaasttctcgbtgccccagccatgttttcaaccatggcatccctcccccaattagttccstgtcatcctbaascttctctgtaagtgcctggtaagcttgcccttggcttaagaactcaaaacatagctgtgctctatttt

SEQ ID NO: 19058 - DNA, 478 bp, Homo sapiens
attttgaggcggtcctcctagcggcctggtagtgtttttgttgccttttcttaatctacaatctcttcgttatttttcttcctgcgacccagtttcgcttgaccctggagaggcggcgggcgggttggttctgcttctcagccatcccgggggctcctcgctagccaagagccggttcccgggagccgcgcgcgcatcgctttctcctcgtcgtcgtcctcctgggtccaggcgcggggacagagtcgcctcccccgctcctcggagcgtcggcggcggtggtgcctccggactgcacttgcgaagggagcttggggaggaatagtacaaaatgtcaaaaattagaaggaaggtcacagtggaaaaataccaagactatatctgatagcacatcccgaagacccagtgtatttgagaggcttggacccagcactggcagtacagcagagacacagtgccgtaactggctgaagactgg

SEQ ID NO: 19059 - DNA, 468 bp, Homo sapiens
  misc_feature 404: n=a, g, c or t
aaaagcggggaaagaagccggagagcggtggaccagacatctagacctgaaagctcgtgcggaggcagaggcgggatcttccggagtgagaattgtttttttattgtagcagaatggggaggaattgaggggaaaacggagatagaacctgaaagagccccaaacgtgagaatctgtaactccccaagaataagatcttccagaaaaattagaccgaaaactaggcgtctgggaaccctgacatccttggaggactagcatcatcatgaccctctgtgttccttttggcataaggacttgcttccattgtttgtttgttaaattgttgtgtttgtttaataaataaaaccttttcatgtatctttgaaattacgttggtttggccgagcgcggtggctcacgcntgtaatcccagcactctgggaggccgaggcgggcggatcacgaggtccaggagatcgagactat

SEQ ID NO: 19060 - DNA, 384 bp, Homo sapiens
tctttgtgccgccttcacccagtgaaggagcctgtatccaccctgcccagtcgctgttgggctgctgcggasttccgctgccatcttcggatcctgtgttccgcccggggctccaccagggcagggatggtgcagaatggggaaatggagagagaacctgaaagagccccaaactcgaggacctattgctccccaagaataacatcttccagaactagacagaaaactaggcgtctgggaaccctgaaatccttggaggagtagatcatcatgaccctctgtgttccttttggcaaatgacttgcttccattgtttgtttgttcaattgtctgtttgttaaataaataaaacccttttcatgtatctttaaaattaaaaaaaaa

SEQ ID NO: 19061 - DNA, 403 bp, Homo sapiens
  misc_feature 173: n=a, g, c or t
agtgttccgcccggggctccaccagggcagggatggtggtgagggtcgctcgtgggtcccctggcagggaacagggtctggcactcacaagggcgcacgactaggacttgtcgaatgaatcctttgtcgcctttagcttttagtcctttgaagagagcagaatggggaaatgnagagagaacctgaaagagccccaaactcgaggacctattgctccccaagaataacatcttccagaactagacagaaaactaggcgtctgggaacctgaaatccttggaggagtagatcatcatgaccctctgtgttccttttggcaaatgacttgcttccattgtttgtttgttcaattgtctgtttgttaaataaataaaacccttttcatgtatctttaaaaaaaaaa

SEQ ID NO: 19062 - DNA, 500 bp, Homo sapiens
aatttttgtttgtaatgtaaaatagggactatttgtaatatgagatagctctatttgttcccaaataaaatatattttacctttttctggtttgttctctgattgtttctttaacttgtctttcttaactatttttctttcttaactcttagtttacatgtagaagaaacttgtgattgaagactgtgcctatttattaacgcaaatatgacactaaaaattagcatcctgatactactgatttagtgtttacggtgaattattcatagaaatacttgctattttagcgattttttttttkgtttatgtagattagtttatgttttgayggaaattggagccccaatgatatctcggatacatgtcctatgcagtggtagcctacagagaaactcatcttctgcattatactaagttagaaaaatgtgatactgtgtggtccttttccaaaatgacactttattaatattattattctgagacagagtcttgctgtgtcg

SEQ ID NO: 19063 - DNA, 472 bp, Homo sapiens
tggatttgtttgttctagtttctccagtttttgtcaacttattgtatggtaaaacatagattttttccccccaaacttctgttttataatatgtaatttttcatgaaaagaaagggctcagaaaaattaggatgtgattttggttggttttaaattactgtaagttttagattctaaggttcaagatttttaaaatttgatttaaatgaagaaatggatttttctctctgcccctccctgccattcatattttctgcataacactattaataatatcaacctccacagccccttattttattatttccaataattccaagttcatatagaactgataatgtagcaagccccaagtatgataataggcagactattcccaactttctgtctagtttccagccattgaagtgaactgctaaaaaaagaaaaataattgaaatgttgagagagatggttatgtaagttagtcctc

SEQ ID NO: 19064 - DNA, 515 bp, Homo sapiens
cagattattcagggtagctgttgagattattcagggcagctgttgacatggcataatctaatgggaaaatttgccagaaaccaagatgatattgattagagggagtgctgttttggggaaacaattctctatggatctctgatgtctccatgtcttacaagcagaagcactgactgctgtttgtcctggactatcttttaaggcatatttacatagagatagtgtcttcacgggagcaaagagcacacatgcttactgcccagataatgtttctctgagagcaaaaagcagaaatgcatcctgctcattactaaagattcgtgtttcttaagctcagtgtctctttcctgtggactacaacccactaaatgtgcatgtatcatctgtccctcctagtgtctccttatagaaatggggacctgggaacaggtgcaaaatatatgctgatacactgcctactggaattagcttaaastaataaactcccctttttctgtgaaaaaaaaaaaaaaatg

SEQ ID NO: 19065 - DNA, 396 bp, Homo sapiens
  misc_feature 154: n=a, g, c or t
aaggtaaaayktcmcactgcgaggcaggcagtgatgctgcggccgcttcgcactgtggctcctgccgaccgccagcgctgttacagtggatgcgaactaaccgtaagtatgcagcagcagccggaacccacagttcaccttggtgcattccttnatgatgaagacttattgattcattatatgagaaaggaaaaatgagcagaaactactgtatgatgtgcagctcacaccagacagcaactttagggttatctttccagttcagcagtgcaactctatggagtagaattgaaaggagacttttcaccaattgcaggaaatggtcataaaaaaatacctgctcactgacagaataaaggtaccttttaacttaaaaaaaaaaaaaaaaaaaaaaaa

SEQ ID NO: 19066 - DNA, 413 bp, Homo sapiens
actgcgaggcaggcagtgatgctgcggccgcttcgcactgtggctcctgccgaccgccaggcgctgttacagtggatgcgaactaaccatgcagcagcagccggaacccacagttcaccttggtgcattcctttatgatgaagacttattgattcattatatgagaaaggaaaaatgagcagaaactactgtatgatgtgcagctcacaccagacagcaactttaggtaggcacttagagtaatttatccctacttacagagagattgccctacgtgtaacagctgcatacaaaaaagttataaaattatcattggtttaacaaggataagtgaaaaacattaaaattctccaactgaacaaggtgtgtctgtttcattgattggctgactgtcaaatcggaatctgatctgc

SEQ ID NO: 19067 - DNA, 381 bp, Homo sapiens
aaggtaaaatttcccactgcgaggcaggcagtgatgctgcggccgcttcgcactgtggctcctgcgaccgccagcgctgttacagtggatgcgaactaaccgtaagtatgcagcagcagccggaacccacagttcaccttggtgcattcctttatgatgaagacttattgattcattatatgagaaaggaaaaatgagcagaaactactgtatgatgtgcagctcacaccagacagcaactttagggttatctttccagttcagcagtgcaactctatggagtagaattgaaaggagacttttcaccaattgcaggaaatggtcataaaaaaatacctgctcactgacagaataaaggtaccttttaacttaaaaaaaaaa

SEQ ID NO: 19068 - DNA, 580 bp, Homo sapiens
  misc_feature 569: n=a, g, c or t
mtyyytyycrtsmgysyycssgcgkccctccctttcatcagtcttcccgcgtccgccgattcctcctccttggtcgccgcgtccttggctggcgtcagaaaaatggctacaaacttcctagcacatgagaagatctggttcgacaagttcaaatatgacgacgcagaaaggagattctacgagcagatgaacgggcctgtggcaggtgcctcccgccaggagaacggcgccasgtgatcctccgtgacattgcgagagccagagagaacatccagaaatccctggctggaagctcaggccccggggctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggcacggccccacagacccagcacgtatctcccatgcgccaagtggagcccccagccaagaagccagcacaccagcagaggatgacgaggatgatgacatngacctgtttgg

SEQ ID NO: 19069 - DNA, 526 bp, Homo sapiens
ctccctttcatcagtcttcccgcgtccgccgattcctcctccttggtcgccgcgtccttggctggcgtcagaaaaatggctacaaacttcctagcacatgagaagatctggttcgacaagttcaaatatgacgacgcagaaaggagattctacgagcagatgaacgggcctgtggcaggtgcctcccgccaggagaacggcgccasgtgatcctccgtgacattgcgagascagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggargcccggctgaacgtgctggagaagagctcgcctggccaccgggcacggccccacagacccagcacgtatctccatgcgccaagtggagcccccagccaagaagcagcacacagcagagatgacgag

SEQ ID NO: 19070 - DNA, 501 bp, Homo sapiens
cagattattcagggtagctgttgagattattcagggcagctgttgacatggcataatctaatgggaaaatttgccagaaaccaagatgatattgattagagggagtgctgttttggggaaacaattctctatggatctctgatgtctccatgtcttacaagcagaagcactgactgctgtttgtcctggactatcttttaaggcatatttacatagagatagtgtcttcacgggagcaaagagcacacatgcttactgcccagataatgtttctctgagagcaaaaagcagaaatgcatcctgctcattactaaagattcgtgtttcttaagctcagtgtctctttcctgtggactacaacccactaaatgtgcatgtatcatctgtccctcctagtgtctccttatagaaatggggactgggaacaggtgcaaaatatatgctgatacactgcctactggaattagcttaaagtaataaactcccccttttttctgtgaa

SEQ ID NO: 19071 - DNA, 436 bp, Homo sapiens
ctccctgttcatcaktcttcccgcgtccgccgmttcctcctccytggtcgccgcgtccttggctggcgtcagaaaaatggctacaaacttcctagcacatgagaagatctggttcgacaagttcaaatmtgacgacgcagaaaggagattctacgagcagatgaacgggcctgtggmakgtgcctcccgccagsmgaacggcgccasgcwgatcctccgtgacattgcgagascagagagaacatccagaaatccctggctggaastcaggccccggggctmyagcggcaccakcggagaycacggtgagctcgtcgtccggattgccagtctggaastggagaaccagagtctgcgtggcgtggtacaggakctgcagcaggccatctccaagctggaggcccggctgaacgtgctggagaagagctcgcctggs

SEQ ID NO: 19072 - DNA, 412 bp, Homo sapiens
  misc_feature 87,95..98,125,239: n=a, g, c or t
attcccgtgcgcggcccgggcggccctccctttcatcagtcttcccgcgtccgccgattcctcctccttggtcgccgcgtcctkgknkggcgttnnnnggggtttcaacgtgttggccaggatgntctcagtctccagaccctgtggtccgcccgcctcggsctcccaaagtgttgggattacaggtgtgagccaccgtgcctggccgaggctccttcttttatgaggavcgggaammnmtcctgcaccctggagaccgtgtgggaagacaagcrcaagtatgaggaggccgagcggcgcttctacgaacacgaggccacacaggcggccgctccgcccakcagctgccagccgaggggccagccatgaatgggcccggccaggacgaccctgaggacgctgatgaggcgga

SEQ ID NO: 19073 - DNA, 426 bp, Homo sapiens
  misc_feature 314,349,363: n=a, g, c or t
acacagagccgcggcaccatggcacctgctggacgcccgggggccaagaaggggattttggagcgcctggagagtggggaggttgtgattggagatggcagctttctcattactctggagaagagaggctatgtgaaggctgggctctggactccagaggcagtgatagaacacccagatgcagttcgtcaacttcacatggaattcttgagagcaggatcaaatgtcatgcagacttttaccttttctgccagtgaggacaatatggaaagcaagtgggaagatgtaaatgctgctgcctgtgacctcgccanggaagtggctggcaaaggtgatgctttggtagcangggggatctsccanacatcaatatacaaataccasaaggatgaagctagaattaaaaaactttttcgacaacagcta

SEQ ID NO: 19074 - DNA, 615 bp, Homo sapiens
gatccgcccgcctcggcctcccaaagtgctggaattacaggcttgagccaccgcgcacggctttgcagcaagcgttttgaattttgtggcccggaattcactgcgargactgggatcacccatcacccttccctggtctccgaaaaatgaaacgtgtttactgatacagaaacggaataacggcrctktgggctggggwgggcsgagtgcctcaggcttctggtctccagckgcgsggmactcacacctgccgctgtgaaaatgcagacccgcggggcagkaattccgagtccagsctggrgcgcgatctggaatctgactcgctkgaaacagcaccrcgkggattcggakmyrrgtgagtagrgaamtgmgcctcagcccctcccrcrgccgcccamrgattccaggrtccgraaackcttcctgctgctgcgtcaccccaggaaggcagcgccgcctctgggccgttctgatggaaactggcttcgcgcccagaggaaaacccacaactaaggggccaagaaaaagcctccatggtcccgccctttcagtgaggatcctaatttataccccgagtgtggcccccatcaaagtctgcagtgacagccgagcgcg

SEQ ID NO: 19075 - DNA, 433 bp, Homo sapiens
  misc_feature 239: n=a, g, c or t
gatccgcccgcctcggcctcccaaagtgctggaattacaggcttgagccaccgcgcacggctttgcagcaagcgttttgaattttgtggcccggaattcactgcgargactgggatcacccatcacccttccctggtctccgaaaaatgaaacgtgtttactgatacagaaacggaataamggcactttgggctggggagggccgagctgcctcaggcttctggtctccagctgcgcgncactcacacctgccgctgtgaaaatgcagacccgcggggcaggaattccgagtccaggctggagcgcgatctggaatctgactcgctggaaacagcaccgcgtggattcggatctgagtgagtagggaactgcgcctcagcccctcccgmagccgcccacagattccagggtccgaaaacgcttcacccctgga

SEQ ID NO: 19076 - DNA, 465 bp, Homo sapiens
gatccgcccgcctcggcctcccaaagtgctggaattacaggcttgagccaccgcgcacggctttgccagcaagcgttttgaattttgtggcccggaattcactgcgaggactgggatcacccatcacccttccctggtctccgaaaaatgaaacgtgtttactgatacagaaacggaataacggcactttgggctggggagggccgagctgcctcaggcttctggtctccagctgcgcgcactcacacctgccgctgtgaaaatgcagacccgcggggcaggaattccgagtccaggctggagcgcgatctggaatctgactcgctggaaacagcaccgcggtggattcggatctgagtgagtagggaactgcgcctcagcccctcccgcagccgcccacagattccagggtccgaaaacgcttcacccctggaaggcagcgccgcctctgggcggttctgatgg

SEQ ID NO: 19077 - DNA, 518 bp, Homo sapiens
  misc_feature 517: n=a, g, c or t
cagattattcagggtagctgttgagattattcagggcagctgttgacatggckkkatctaatgggaaaatttgccagaaaccaagatgatattgattagagggagtgctgttttggggaaacaattctctatggatctctgatgtctccatgtcttacaagcagaagcactgactgctgtttgtcctggactatcttttaaggcatatttacatagagatagtgtcttcacgggagcaaagagcacacatgcttactgcccagataatgtttctctgagagcaaaaagcagaaatgcatcctgctcattactaaagattcgtgtttcttaagctcagtgtctctttcctgtggactacaacccactaaatgtgcatgtatcatctgtccctcctagtgtctccttatagaaatggggacctgggaacagtgcaaaatatatgctgatacactgcctactggaattagcttaaagtaataaactccctttttctgtgaaaaaaaaaaaawtycgaamnt

SEQ ID NO: 19078 - DNA, 423 bp, Homo sapiens
aaaacaaataagtttacgtagattggaagtccatattttatttctctagtgacatatttacagttcaatataaattaaaggcctgcttgtacaccaaatccagtcccttgggtggttcagtcaaagaggatggccatagcagccacaaaaggaagcaaacaagaacaagtcctgatggagcaatttatgaagacaggcagcatagagggagaagaacctgtctgtcaaccccacacacgctttcccagacgtctcctgaaagctgagcatttggtatcttaaagcctcttaccagtttggatagatatggatcttccaaaattaatgagctccttaatatcgacactgtttatcaacataaaggatcaatttaggaagattataaaaactgaagtttccggaacaataaatgggagaattaat

SEQ ID NO: 19079 - DNA, 387 bp, Homo sapiens
  misc_feature 70: n=a, g, c or t
ctctgggattcgtgcaagtagcgtgcgtgcccttgtgagtttggagggtgccggtcagcggascgtggantgtatttgaaaagyaatcagtccgaccttcccccatagattcatcctgcctgaaaatcatatgcgtggtttttcctgtttcctgctctgtagctgacatcaggggagmaacgtgaacacaggaaaatggaaatcaacatttgaaacttttaaatggaagctttattggggttccacatatggaaaactgcaaatagcagaagtatgtgactcaataaattattctggagtgaccacatcctctaactgcctcccaggacaagacggagaatgtgaaacaatgctcctgaaggccccttttccctcaaaagaattcac

SEQ ID NO: 19080 - DNA, 586 bp, Homo sapiens
aaaacccggagcgtcggtccccggagtccccgccggcagcgcctcagctgaagaccttggtagaaaaatgctgacttcccctaagcaagaaggaattctggcagcaaacagccattgacttgcagccttttccctagacctgcagcccgcctacctactctgaagattttggagttgccaagcctccacaaccatataagccaatacctttctctctctttctctcttttctctctcttaaactgcaaaaagcaaacaaacaaacaaacaaacagacagcaggttcaaaatggagtcactcatactagtgtcacataaccaaaccaaaacttgcgttatttacttgcaagatttgaccttgtgagaaatcagaagagagataacagtggaatccaactaggccaacaagattttgcttacatctgtagaagaaaagtaaccttgaaatgaccaaccctctatttgttctttatttctgcttttctcttcttttttctgcccataaaactcacccactctgtttagctcatcagagtttctttctactttgtagactggatgctgcccagttcatgaatcactaata

SEQ ID NO: 19081 - DNA, 507 bp, Homo sapiens
aggatttctcaacacatgcttgagtcagggtcataacaataatggcttaagtttactgagctcttttttactatatgccaggcagtattctcaatattttgcatgtattaagtgatttcattttctcaacacccctatgaagcaaatacttctgtgagccccatgttacaaatggagaaaccaaggctcatggagattaagtaagctggtcaactttatgtagataataagtagtgaactctgaatcctgaggccatgtcctcaactatcagactttgctgtttcacgtataattgtctttgaatctgtatctccagaaccctctcttgtcctagcaggagtgtaaaaatgcttacgaatcccatatcaccctcgcattattcagttttgcaccagacgttgtgacctcagccaggaatataacctgtctggagaccaatacacagtgctgcattttctccaaatgattcaagatcttcctagcactcaatgggcctgagaacgtat

SEQ ID NO: 19082 - DNA, 468 bp, Homo sapiens
aggatttctcaamacatgcttgagkcarggtcataamaataatggcstwaagttactgagctcttttttactatatgccaggcagtattctcaatattttgcatgtattaagtgatttcattttctcaacacccctatgaagcaaatacttctgtgagccccatgttacaaatggagaaaccaaggctcatggagattaagtaagctggtcaactttatgtagataataagtagtgaactctgaatcctgaggccatgtcctcaactatcagactttgctgtttcacgtataattgtctttgaatctgtatctccagaaccctctcttgtcctagcaggagtgtaaaaatgcttacgaatcccatatcaccctcgcattattcagttttgcaccagacgttgtgacctcagccaggaatatacctgtctggagaccaatacacagtgctgcattttctcmaatgatca

SEQ ID NO: 19083 - DNA, 481 bp, Homo sapiens
aaagcctgcgaagtcaaatagcagccgcggggaggctcgttcccatcggcatctgtgactggctgcgatcgagggcccgggcggccggccagccgtctcgccgagtgcggactggccggatctgctgtcagtcagcgggaacagacttctccctctccatctggtcaactgcgggrgaaaaattttcgagaatttccagcaggcaaggcagtggccgctttgactgcttgcttcggagatccgagacgacggagaaggcactcttatttaccgaccaagaaagctcctcccccgtcctccgttagctaattaaaacatttttcagggacgtagccatccagagacattccattattgttccattgacctttccctcatcactgagtcctttggagctgagttatgtcaacagctgccttaattactttggtcagaagtggtgggaacaggtgagaaggagagtgctgctaagctcccgcct

SEQ ID NO: 19084 - DNA, 429 bp, Homo sapiens
gagaatttccagcaggcaaggcagtggccgctttgactgcttgcttcggagatccgagacgacggagaaggcactcttatttaccgaccaagaaagctcctccgccgttctccgttagctaattaaaacatttttcagggacgtagccatccagagggatttgcttcctaaggagaagaacttggaaactctgttgaccttggcttttctagaaatagataaagcmhbatcgagtcatgcccgcctgtctgctgatgcaactcttctgacctctgggactactgcaacagtagccctattgcgagatggtattgaactggttgtagccagtgttggggacagccgggctattttgtgtagaaaaggaaaacccatgaagctgaccattgaccatactccagaaagaaaagatgaaaaagaaaggatcaa

SEQ ID NO: 19085 - DNA, 474 bp, Homo sapiens
  misc_feature 389: n=a, g, c or t
aggacacatgacttagttatggtacatacgtgtgcacgttcagattttgaaaacaaatatagccaaaatcagacatatgtgcagacccagataaagttagtcaaagctaatactgtgattcatccataaaaccacttagtggtgattcagagttgcagacaccaaccccaagggccagacattcaaatacagcttcataggttagattcctggctactcccagacacagagttgggcatttatggggaaagacaaattctggagacacaggcagctgggacaggaaagatttatctgtctctagatcaccccccaagtcagacaytkggtgttgaaggttactcatcagtttcccctatggggacatggctcacaatgtgtgggcaggntagtggacagcagggccttgsacacccaccacatmmmcatgtgcatgcacatacacacacacacaacacacacacacgcacacaa

SEQ ID NO: 19086 - DNA, 192 bp, Homo sapiens
taagaatataattgagttacatagaaaaatgtgttatttggttgtatccagagtacggttgcctgtatttatttggcagccctaatccagagagatggtgcaaactagacacttaaaggtgggcttcccctctgggctgtcatacactctgttgtccaaacacatttgtctttttwtttttttttttttttt

SEQ ID NO: 19087 - DNA, 516 bp, Homo sapiens
actctcttttgaatggaatcgggctgattcatcgcyggtttgcagacaragccgcgtcgggtgtgcgccgctgctgctgttgcctctgtcttcgcgtcaccacagaggcaagacaagggtccatatcgcggcatccggctcccgcccgtcttcaggagagaaagaaaaaataaaatatacttggggaagttgtacctgccagaattagcaagagctttctttaagaagacatttgtcaaactcaacaaattgaaggttaacaccttaagagttgtagttactgaccagaaatatggacagacttcttagacttggaggaggtatgcctggactgggccaggggcacctacagatgctcctgcagtggacacagcagaacaagtctatatctcttccctggcactgttaaaaatgttaaaacatggccgtgctggagttccaatggaagttatgggtttgatgcttggagaatttgttgatgattataccgtcagagtgattgatgtgtttgctatg

SEQ ID NO: 19088 - DNA, 471 bp, Homo sapiens
atgaagttgcatgcaggcaaagagagaaaaggaactagggggctggagtctttaagaggtgaggcaaggtaagcaggtttaggactggctagtttgagtaattgtagagggctctggggggacaaggggttgtccctagttgtctgatacctggtcctggggtgattagggcaggtggatattggcccaaaaatgaaagcttgataaagagggtggttgggggtgtgggctctggattggtgggtttgcataggaaaggtgtcgcctctctctagatattaactaaccctggggggggcggctatccctccaggatcagcaataccccagatatcaaagcaaataatacaggaaataaaaagacatggtgaatacaattggcttgactaggcagggtggcttacaactgtaagcccagcactttgggaggctgaggcaggaggatggctggagcctaggatttgagattag

SEQ ID NO: 19089 - DNA, 550 bp, Homo sapiens
tgccgggctgaaaaattttctaagtaatgtctaattccactttcctagtagttacagttcagtgagtgtaattaccgtctgagggttgaaaactggtggcccatgggctttatctatcagcaaagatactttgtttgactcacaatattaaaagcagttcattgattagtgttattagggcactgcctctccagttgatgtcagtccctatcatgcctagtatcttacacctggcctgcttcattctcttgtattaatattacttgcctggcaataggtaataatcctattacatgtcttgcaaaatgtaatcatcagtttacatgttcacgtgagtrrkatttcaacccctgaatgaaactgttctttaatgatttagcttctttgggtgtgtcaggatcatctttgtgagcatttttctctgtgcagtgctatagaggtaaagatatacatcaggaatgtattcttgccattcagagattcataaaattttaatagaagataatttagagattgagtgcagaagctgagaccaagattgggtaaataa

SEQ ID NO: 19090 - DNA, 469 bp, Homo sapiens
atactagatttggaaataatcaaactaggctttgttctgccacaactaggtaaaaatgttacttctttctgactttttgtaaaatcaggatggaaatatatttcatatcattgttatagctaatagctattaagcacttgtatgtttcatactgtgttaagggcttttatatatttctcattgtattccgacagaaccctacaaagtagagacagttccaaatttccagaatgaatgtgagattgtgatacatatgacaaactgcttattaaactgtacagcacctaacaacatgagggattatgcctaattccctacacagtgcatggcatacacaaggactcatgagatgctgttgaagaataaaagcagctctactttacagccataggaagcacatacatattcagccatttgaaaacagtgtgtcttgatgaaagaggattgcagttggattaatatgaacagt

SEQ ID NO: 19091 - DNA, 415 bp, Homo sapiens
accatttccaggctcaaatcactgtggaggaacaagcaacaaagtcttgtcaggaccttatctcagggtaacgattagttaaaaatgaaaggctaaaatattgattttctttagaagaataattgactgtttgatatagagaacacccagtttcttcctgaggaaagctgaacagggctacattagcagcccgcgtctctctgacagcagcaggggctgggtttaagcagcggctgctttgcctggggagcacccgtaaatggactttggtctcaatgctttgactctttgccgtggttttggatgttggaataccggcggtgatctgtcttttataaactcacctgatttaaaggaaagatgagtgaagaaccaaaggagaaaaatgcaaaacctgctcataggaaaaaaaaaa

SEQ ID NO: 19092 - DNA, 839 bp, Homo sapiens
accatgtggcattcccctaccctgaagttatgctttccttctgtgctctgtgctggccagaggtgcctcttgaatcagattaatgtggtttttcaggaaaggacttaggtgaactgaggtttttaccacaggcagtgaatgaccttggttcaccaaatttgcctctgttttgaggggcttggtccagagtgacttgttaatttactctaacttccttgtgtgttgatgggtaagtacactcaaacactgaatacaggtgtgtgatgggtagatttcacagcccttctactaatagtgagtgtgaaggcaagcttgatgcaaaacctcctgacctttcctacctgaagagccctttgacttctaggaagaaaggtcaaaaatgttatcttcagttgtgttaatcccagttttagtgcagcttaggaggctgctagttaggaagatggcagtggctgtaggctgggttgccagaaaagatggtggcctagtcttattattcagatggagaacttagaaaacctgaagagtacccaaattggatttgaatttwaatggacaatggctgtattttttccatgttagaaggatcctaatgaaagcacctgttatttttaagtttctaagggtctagttgttcagaatccccaaggatatttccctaacctcactcagtcacattgtaggagccagtgtagctatggaattatcttaggaactcaagcttctaaaactatccatgtagtcaaatctaggggaaaaagcaaataaaaatagtaaaatttggccgggcacagttgctcacgcctgtaatcccaacactttgggaggccgaggcgggc

SEQ ID NO: 19093 - DNA, 463 bp, Homo sapiens
agtgggacccgaccctgtctccagtgggcgtcttgggccccggctctattctgggctgcgggcctgggaagggctcggccgggtgccaaatgagctgtcctaactctgcggggctgcagcttcctgcatgatgctggggagcttggcgcctgacccaggatctagaaggcactctgggcaggccgcgctccgcccacgaaggtttaaccaccaaggactctgagagctggcaggtctgagtaaccctggtaacaattctcttcaccttatcaaaacctgagctaaaaccaatgcatcagctgatgatgacagcagagagtggcagggctgaggacccaaagtcatttcccaggctggcggagaataaactgccagggagaagaatgagaagacaggagacaaactgtttggaaagctaaatcttccctcttaatgaataaaggtttttgccttgtcttaaaaa

SEQ ID NO: 19094 - DNA, 516 bp, Homo sapiens
caagaaaagatggtgtacatctatcattccttaaagaatagtagagagacacacatgatgggaaatgaggaggaaacagaggtttgtttcaactgaaaacaaatgcctatcctgtgacttgggtggtggttgggaagaattgattatttttgattacaggtaatatgctttttatggctgcactgtggacttaaccattttgcactactcacagagctcctgcatggggatgattaagtcagacatttctgtgatacatgcacaccagttttaagacatactagctgggacctgtagccttataggaatggtataatgtaaaacatttcaaattactaatatcacttactacataaattaggatgccttttatatagaagttggcatcttttatgttatctaattgtagtgtgtctaaaatactcatgaggggtatcaaaaataatgatgtatggagaataaatttacaggaaaatgctacttcaatgacataagtagtatacatatattttgaca

SEQ ID NO: 19095 - DNA, 484 bp, Homo sapiens
  misc_feature 18..19: n=a, g, c or t
cacacacacatgcacgcnncacacacacacacacagaaggtgaacacacaggatgaggccctgaaaactcatttcacccgtgtacctcacccaaaaattcccctttgtactcctatctttatctctaactgacagcatgaaggtagcccgaagtcccctcaccctgtctgtcctcctgattctctagcccagttccctctagctccagcacagactcttatctccagccctgactgccgaaaccctccagccccagctccagcccctcaggaggggactgcgtgggaggaatgactccagcaagccggcagctgacccgtctcctgcctgcacgcctcccgctgtggtccactgccggtggtcttcagctctctcctcgtcccacccccatggtctgctgacagcccagctcagtgcatccctgccatctctgctctaccgctggtcctcccaacaaccaacttacagggtttcactcccgtca

SEQ ID NO: 19096 - DNA, 356 bp, Homo sapiens
atctctgctctaccgctggtcctcccaacaaccaacttacagcttccaattgtggacaagataaggaccattgcccaggctgtctatggagccaaagatatcgaactctgtcctgaggcacaagtcaaaatagatcgttacactcagcagggttttggaaattttgcccatctggcccatggcaaagactgatctttcychcggyytcaccaacctgacaaaaaaggtgtgccaagggacttcatcttacctatcagtgatgtccgggccagcataggtgctgggttcatttaccctttggtcggaacggtgcaccactgacatcatggctcggctggactctggaaagcaggaaa

SEQ ID NO: 19097 - DNA, 203 bp, Homo sapiens
atctctgctctaccgctggtcctcccaacaaccaacttacagcttccaattgtggacaagataaggaccattgcccakgctgtctatkgagccaaagatatsgaactctgtcctgaggcacaagtcaaaatagatcgttacactcagcagggttttkgaaatttgcccatctgcatggcmaacactgatctttctctgtctca

SEQ ID NO: 19098 - DNA, 348 bp, Homo sapiens
  misc_feature 340,342..344: n=a, g, c or t
atctctgctctaccgctggtcctcccaacaaccaacttacagcttccaattgtggacaagataaggaccattgcccaggctgtctatggagccaaagatatcgaactctgtcctgaggcacaagtcaaaatagatcgtacactcagcagggttttggaaatttgcccatctgcatggcaaagactgatctttctctgtctcaccaacctgacaaaaaaggtgtgccaagggacttcatcttacctatcagtgatgtccgggccagcataggtgctgggttcatttaccctttggtcggaacggtgcaccactgacatcatggctcggctggactchgacnannnagga

SEQ ID NO: 19099 - DNA, 351 bp, Homo sapiens
atytyttsyyywaccggytggtcctcccaacaaccaacttacagcttccaattgtggacaagataaggaccattgcccaggctgtctatggagccaaagatatcgaactctgtcctgaggcacaagtcaaaatagatcgttacactcagcagggttttggaaawtttgcccatctgcatggcaaagactgatctttctctgtctcaccaacctgacaaaaaaggtgtgccaagggacttcatcttacctatcagtgatgtccgggccagcataggtgctgggttcatttaccctttggtcggaacggtgcaccactgacatcatggctcggctggactctggaaagcagga

SEQ ID NO: 19100 - DNA, 184 bp, Homo sapiens
atctctgctctaccgctggtcctcccaacaaccaacttacagcttccaattgtggacaagataaggaccattgcccaggctgtctatggagccaaagatatcgaactctgtcctgaggcacaagtcaaatagatcgttacactcagcagggttttggraatttgcccatctgcatggcaaagam

SEQ ID NO: 19101 - DNA, 528 bp, Homo sapiens
cccatatcctaactgaccagtctaaagcatggctcattgtggccaggttaatttttcctgatgcaacacagcacaaaaatgttcgtggcccacaaatcaagtcctaggcttgctcaccaatgccttcaatatttgcccaatataccttttcaactttaatttcccacttcctcgggcacaaaatcttccatctcagtcatttcaggtgaagtccacagcctgagacatcataaccgccgaattcctttattcatgtggaaaagccatcccttggcttttacattcttttctccctgcccatctgaatgctgtcaccttccaagccccagcccatttctccagcccatattaattatgctttttctgaaggtctaaagcacttaactgacagtactatttatcttgtcacttagttaaattcagtaagtgctactactgctcattttttgttttgggagatttttttcaaggagcatttctacattcctggcattgtgtttggtsctcaaaatgttttctcacttaatt

SEQ ID NO: 19102 - DNA, 444 bp, Homo sapiens
aaaagttatccacaatgttttgaagccctaagggtagaaagggactctaaaggccaggccaaatacttctaaaaatgaaagtaaccacttgcaaatcagtaagccttgcttttgaaagaaagatacactgtgtttccttgggggcagataaggaagagtcataacctaagtgttgtcagttcaatattccataaacactaatgagaaccaaggtctgtaaagagagaacggattatttgaaatttaatagatgaacaaaggaaggatcattgtctatagaccatgaggtcttggragacagraaacccaytggtttkgawactttgtagctctgtcagcacatggaaagaaactggttttcctgtaaaactaatacatgtgattattaaaggtaaaaacataacaaatcaaataaaaaaggattaatcatttaaaaaaaaaaaa

SEQ ID NO: 19103 - DNA, 439 bp, Homo sapiens
actttacctggtgggtgaaaatttgatgagaaatttacataactccaaagtacctgatcagaagatatttattgattaaaaatggaaaatcagtaactttacagtgcagaaacctgacagacaccacctcattcaagtgatcaaaattagcatagtcagactgtaatcccagcggtttgggagtcgaggtgggaggatggcttgaggccaggagttggagaccagcctgggcagcatagtgagaccttgtctctacaagactatttttaaaaaattagctggaggggatggtgctatagttccagctagttggggtgagagatggaaagattgcttgagcccaggagttcaagtctgcagtgagctatcatgagctatcatgacactgcactccagcctgcacagcacaagaccctgactctcaaaaaaaaaaaaaaaa

SEQ ID NO: 19104 - DNA, 556 bp, Homo sapiens
  misc_feature 534: n=a, g, c or t
aacaaatcaatcattcctaaatgtaggacccaaacttatatcacagaattgtgtgtgtgtgttgtttggtgagaatgatgagagctgagcattgtgaaaatacaggcgggggtggggtaacagagctgggtaggggtccagggcgcttagattgccttattgtccaggcttagatgcctcttacccagagccatcaggtgtaccctatatagctccagcctttctgcctactcctgagaagataaactgggatcctgcagtctggattcctagaaggagatggaaagcccagccatatccccagtttgacttgaccagtagtaaaactagcactacagtttgatccctttttacctccttgaatatcttcaattcatcaaggatctgtaaagaaggagaggtacaagatatatgaaacccaaatctcaaaacaatgatttagtgaatttcccatgaactttaaacagtgattgcttcaaaatttccaagagccatactctccctccagctgctgtgtgtgtgtgtgtgtataantgcacactattttaacctaaat

SEQ ID NO: 19105 - DNA, 422 bp, Homo sapiens
cctgtaaaatatcccacattttgaatttgtctaattgttttcttacagttagagtcaggataaacatatttggcaagaatactgagtaggtgatgttgtgtcctttccacggcatcacatcagaaacaggtcatgtcagtttgtctcaatattgatggtactgagcttgatcccttgattaaggtagtgtctgccagatttctccagtgtaaagatatcctttccttttgtaattgttaagtaaatttgggatgaaactttgagattgtgtgaatatctctttcctcaaaagagcctaattttgagcctgtttaaaccaaccgaaaaattccggaatcacctgcttttagaaaatcagttgagatcacatgaagactgcatttttaagtcacagcagagttcaaaagaaaaaaaaaaaaggc

SEQ ID NO: 19106 - DNA, 503 bp, Homo sapiens
tacaaaaatggaatcataggcacactttcctccaccttttctcattcagtgctaactcttggaagttcctccaagtcaattagaatagttctattattatcttgaatggcttcataatattccgtggtgtgagtgtaccacactttattccaccattctttagctgatggccatttgctttgtctgcaataatttttgccactataaaccattctgcaataaacctccttaggtaaataggtagctggatatgtaggtatttttctctctttctcatgtactggtagttatattctgaaatacgtttttaggagtgagattgattaaccaaagaatatattaataatttccagttcttatactattagtgatttcgagcatcttttgatcgtaggctttatgatatcttttgctcttcccagaagttttaaatttttaaatgcattatgtgtccatgtttaatacttctgagttccggccaggcatggtggctcatgctgtaa

SEQ ID NO: 19107 - DNA, 168 bp, Homo sapiens
aaaaattctaacatgccgtaagattctataattactactctaagtgatcatttgtggacacgggccaaactcgaataccatttttatcaaagaagagaagtaaatgaaaagttcagaaatgttttaagatggcgaagtgacagtaacatttaaaaaaaaaaaaaaaaa

SEQ ID NO: 19108 - DNA, 548 bp, Homo sapiens
taacgagccaaacaaaaattctactaggccagtataatagggcctgcagagcctgtcatgggttcagggttttcccataaagataggtgtacctcagatactactcctaggtcctggctttaacctcaaagcccctctgcctgtcctgctctgaaacctctggggcagtaggcattgacttctgggctagggagtaaatgttccgtgtccttatgtgagcttcctattacccattagcattgttttatgaagttttcaattttatatccagcctgggagacagagctagactccatctcaaagaaaaaagaagaagaagaaagctaactcagtacactaagagtgatttacatgcctgcaaataatttgtgtctggggtcttgaccctccccaaatgccttgttatttatatctctgcttttagataacagatggtcatgtgtctatgggcttgtaccggcagaggcaacagcaggtccttaagactccccaggtgccatgatgaaaagaaccttagaaaatattgaaataatctcaaaaaaaaaaaa

SEQ ID NO: 19109 - DNA, 515 bp, Homo sapiens
tcgaagtaattacacttgacctgctacctaaaacgatgtaatattacaacttttttgaataatctcaggaaaaatggagaaatgtttatattcatagttaataaacattctagatagtaaccaactgtcatttactgaaaataaaattttacccaggtttattttatttttgagacggagtttagcttttgttgcccaggctggagtgcagtggtgtgatcttggctcagcgcaacctccacctcccaggttcaagcaattctcctgcctcagcctccaaagtagttgggattacaggcatattccaccatgcctggctaattttgtatttttagtagagacagggtttcttcatgttggtcaggctggtctcgaactcccgacctcaggtgatccgcctgcctcggcctcacgcctgtaatctcagcactttgggaggttgaggcagaaggatcaccagagcccaggaatttgagaccagcctgggcaacatagtgaggaccacgtctctacaa

SEQ ID NO: 19110 - DNA, 473 bp, Homo sapiens
tacgaataatggtgtgaagattaaataagacaatgcatgctcagtgctaagttctttgtcctgacatattaatagctcaatgatttccagttattactatttccaaatgtcagacatatcatactgaaatgactttttctgaataaccacaaacaacacccaaggaatagcaaatatatttctttttgttgctaatcctcattcctttaaggcttacatatgattattaaaaattatatcacaaaattgtacattctaaggaaattttggtgttatttagtcttatctgtcgagagccagagacttttcagaacatgccagagttgcctttgaagatgtccctgctcatatttatcaaaatggtaaatatggtaaatacatctttcgttgcaaagccaagagggattgcctcttttgagatgcttttgaagaaaaagtaagaacgtcaggttgcgcacctttaagttcaaatg

SEQ ID NO: 19111 - DNA, 452 bp, Homo sapiens
atcccaggacgatgtcttgcatttggaacctacaaaattttgatttgtcgtttaatatttattgaattagttgattcgctgggtgcaacgaccargaaaacaaatgtgaggacattcctaaactatttccaagtggctctgaattttttattaatttagttctctaacattttgttgtcaggcggtgtgctaggtactaaagaaacgaaaatgcaatccttgctttcagcaagctcactacggtctaacggagacgacttttaacataaatagtaattgtaaaacgatgtgatgagtccaatgatggaataatgaaggaggacggcagagggccacttaactggccaggaaggcttggacatggtgacgcccaccatagatcatgccggataaggaggagcagacctagcgaacaggaggcaaagaccattggaagacaatggggaagagag

SEQ ID NO: 19112 - DNA, 480 bp, Homo sapiens
atcttctaacccttggaggaaaatctgcgctccagcagctgggaccgaggcatgagagcgttgaatcatgagtggcaccgttcgcaaaaattggtgtctttgtacaaagacagtgccacaacacaactcagtgaccatcgggagagcagcctcatgatgggcgatgctccatcagttttctcttgcgatcttttgcatagatcggtcccgccccgcatatggcgatgaggactcaagagacacggaaaacgttttctttctggaaaacatgaaataggctttgtagatggacaggaagtcaagggacaagcggtgcgccgcagagagcgaggacccactcttctattcctttgcggaggcacggacacacggtgtggcccgaaacagcggcaggagagtgagacccgggctccgaccgcggtgacggagtctcactctgtcacccaggctggagtgcagtggcacgatctcggctcactg

SEQ ID NO: 19113 - DNA, 394 bp, Homo sapiens
tagaatgtaaaaattggttaactttacaaatgtcagctagttttgactactaattgggggaaattttagataatttttaaattcaaagttatttataaaatgctagaatttgttttaattttttgtattttgagccacttcacatgaagactcagttgcatttttatcgaatacatttttatcaacagttaaagactatggtggttttttcagagtttggctaagatgttgttaccatcttctttgtttgtggtacaatattttcagtgcaaaagagatgtattcagttaaaaagacaaacctytagatgtgtaattacatggaaaatactagcaatgtgaatgcttttgtagtaaccatcttgtagtacctgtgaaatctataactcagaaat

SEQ ID NO: 19114 - DNA, 354 bp, Homo sapiens
agcgtgtgcagcggcggcggcggaagtggccggcgagcccggtccccgccggcaccatgcttcccttgtcactgctgaagacggctcagaatcaccccatgttggtggagctgaaaaatggggagacgtacaatggacacctggtgagctgcgacaactggatgaacattaacctgcgagaagtcatctgcacgtccagggacggggacaagttctggcggatgccgagtgctacatccgcggcacaccatcaagtacctgcgcatccccgacgagatcatcgacatggtcaaggaggaggtggtggccaagggcgcggccgcgraggcctgcagcagcagaagcagcagaaag

SEQ ID NO: 19115 - DNA, 612 bp, Homo sapiens
tccatttgctaatgattaatacactgtttgggctggccagtttttcatgcatgcagcttgacgattgagcacagtcaggcctttgtattaaaaatgaaaaatgaaaaaacaaattcaaaacctattcaaatgggttctagttcaatttgtttagtataaattgtcatagctggtttactggaaacaaacacatttaaaattggtttacctcaggatgacgtgcagaaaaatgggtgaagcataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacaaccatcaacattgctgttcaaagaaattacagtttacgtccattccaagttgtaaatgctagtcttttttttttttttcccaataaaaa

SEQ ID NO: 19116 - DNA, 484 bp, Homo sapiens
  misc_feature 60: n=a, g, c or t
ctattcaaatgggttctagttcaatttgtttagtataaattgtcatagctggtttactgnmacaaacacatttaaaattggtttacctcaggatgacgtgcagaaaaatgggtgaagcataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacacccatcaacattgctgttcaaagaaattacagtttacgtccattccagttgtaatgctagtcttttttttttttttttcccaa

SEQ ID NO: 19117 - DNA, 493 bp, Homo sapiens
accatgggaacgaaccgccgcgcctcgcccaggacagttacacttagaggccttggcggggcggtgattgtccaaaagttctggtgggcctgtgcattgttggctgtgtgatggatgagaattgtcaagctggagaaaaatgttgcaagtcaggctgtggccgcttctgtgtcccaccagtcctgcccccaaaactgaccatgaaccccaactggactgtgaggtctgattccgaattagagatcccggtgccctagctgtgctgatttgtctggaacttctttggtaattctggaagcttttcctggcagtcaagagagggtgacatcctggggcttgtgacatttccaggggcactcatggccctctctgctctgcttctcctcctgccgctgaccagagcatgggaaatagccctggattgggtagtgggtgtgtggtgcttctctttcccaataaaggctggtgctgacctctaaaaaaaaaaaaaaat

SEQ ID NO: 19118 - DNA, 387 bp, Homo sapiens
  misc_feature 342: n=a, g, c or t
aaccgaaccgccgcgcctcgcccaggacagttacacttagaggccttggaggaaaagagattgccctagggttattcggaaacaatcctgtttgaaaaggtgcatcactgatgagacatgtccaggtgtaaagaaatgctgcacgcttggctgcaacaagagctgtgtagtcccaatctctaaacagaagctgggaagaggacacccaccctggtacctggtccctggcgagagtcttgtgaaaatgaagaacaattgcttatgctgttttcctaatgaggaacacaaggctcactggtacagagttggaaggaatggaggcaagcagagaaaggcccaggntttgtggagcttgatgcttgtataattatggataccttgttttag

SEQ ID NO: 19119 - DNA, 449 bp, Homo sapiens
atgggaacgaaccgccgcgcctcgcccaggacagttacacttagaggccttcaaaagagggagaatgccctcccgataagaacccatgcaaagagctgtgccagggcgatgaattgtgtccggctgaacagaagtgctgcaccacaagctgtggtcggatctgccgagacattcctaaggacggatttcgctcttgttgctcagactagaatgcagtggcgtgatctcggctcaccgcaacctctgcctcccgggttcaagtgattctcctgcctcagcctcccaagtagctgggatttacagggaggaaaagagattgccctagggttattcggaaacaatcctgtttgaaaaggtgcatcactgatgagacatgtccaggtgtaaagawatgctgcacgcttggctgcaacaagagctgtgtagtcccaatctctaaacagaagctg

SEQ ID NO: 19120 - DNA, 456 bp, Homo sapiens
  misc_feature 410: n=a, g, c or t
catgttcaagaactgtaatgctgggtgggaacatgtaactttagactggagaagataggcatttgagtggctgagagggcttttgggtgggaatgcaaaaattctctgctaagactttttcaggtgaacataacagacttggccaagctagcatcttagcggaactgatctccaatgctcttcagtagggtcatgaaggtttttcttttcctgagaaaacaacacgtattgttttctcaggttttgctttttggcctttttctagcttaaaaaaaaaaaagcaaaagatgctggtggttggcactcctggtttccaggacggggttcaaatccctgcggcgtctttgctttgactactaatctgtcttcaggactctttctgtatttctccttttctctgcaggtgctanttcttggagttttggggaggtgggaggtaacaccacaatatctttg

SEQ ID NO: 19121 - DNA, 203 bp, Homo sapiens
ttgctttggtctgcacacctggtgtgtgcatgtgtatactgcttgtgccatctgtgtacccctctccctggagtacacttgtggtcacactacagtggggacatcaagaatgcaatatttatggattgctgcatgattcttaaaaatgaataaaactgtttacaagggaaggagagctaactacaaaaaaaaaaaaaaaaagg

SEQ ID NO: 19122 - DNA, 439 bp, Homo sapiens
actcttccgcttctgtggtctgatcttcctgcggctgaaccgcccggctgagccgacattgccggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgtcttgttcataaattgacaatgtcaataaattgaaatatggttcactgkyaaaaaaaaaaaaaaaa

SEQ ID NO: 19123 - DNA, 445 bp, Homo sapiens
actcttccgcttctgtggtctgatcttcctgcggctgaaccgcccggctgagccgacattgccggcgtcttggcgattcggcccgacgagctccgctttcgctacagcatggtggcctactggagacaggctggactcagctacatccgatactcccagatctgtgcaaaagcagtgagagatgcactgaagacagavttcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgtcttgttcataaattgacaatgtcaataaattgaaatatggttcactgttactcttgaaaaaaaaaaaaaaa

SEQ ID NO: 19124 - DNA, 427 bp, Homo sapiens
ttctgtggtctgatcttcctgcggctgaaccgcccggctgagccgacattgccggcgtcttggcgattcggcccgacgagctccgctttcactacagcatggtggcctactggagacaggctggactcagctacatccgatactcccagatctgtgcaaaagcagtgagagatgcactgvagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgkcttgttcakaaattgacaatgtcaataaattgaaatatggttcactgccaaaaaaaaaaaaaa

SEQ ID NO: 19125 - DNA, 448 bp, Homo sapiens
aagtgcacggaggagttctgggggccaggcggcgccgcgagtctggtatcctgagcttcgtgagttgagcgctgctgctccgcggtggagtcaccgcaccgctcccgggatcatggtgttctacttcaccagcagcagcgttaattcatctgcctacactatttacatgggaaaagataaatatgaaaatgaagatctgatcaagcatggctggcctgaagatatctgggagagaatatagaagacatcccaaaggaagtgctgatggactgtgcccaccttgtgaaggccaatagcattcaaggtaaaaattgtgacagtggagaagaaagtaaatgagatcctgaaccgattagaaaagaccaaagtcgagcggttcccagacctagcagcagagaaagaatgcagagatcgtgaagagaggaatgagaaaaaagcccaaattcag

SEQ ID NO: 19126 - DNA, 406 bp, Homo sapiens
ggagttccgggggccaggcggccgccgcgagtctggtatcctgagcttcgtgagttgagcgctgctgckccgcggtggagtyaasggcaccgctcccgggatcatggtgttctackkcaccagcagcagcgttaattcatctgcctacactadktacatgggaaaagataaatatgaaaatgaagatctgatcaagcatggctggcctgaagatatctgggagagaatatagaagacatcccaaaggaagtgctgatggactgtgcccaccttgtgaaggccaatagcattcaaggctgcaagatgaacaacgttaatgtggtatatacgccgtggkctaacctgaagaaaacagctgacatggatgtggggcagataggctttcacaggcagaaggatgtaaaaa

SEQ ID NO: 19127 - DNA, 514 bp, Homo sapiens
acaggtaatatgaagagaaactgaagaacattgctgagagcagtgctattagaatggatgaatttccttttatttatttttaaaggcttccttattcctctcagtaatgttattgataatgtgtttaaaaattgttagaaagagaactatttgaaatctaaagttagtcgtgttttccatctttaaaacccactacaaagggtttatggaggatctgagatggttagcatatccttattgcaaaagcgttgatgtctcaatacagtgcccttaatgtaattagagacaattttttaaaatccatgctgataaatgtcaggctggtctggtcttgtgagttgggcacaaaatgtaccaattgttgaatgatgaaggccagcatatgtaataataactaaggtcagtaagaaaaatattcttctcaattgtatatgttttgttttcaaagtttcatcagactgagtagccatacttaattagcccagaggcagatgaaagctcatttaggcacaag

SEQ ID NO: 19128 - DNA, 469 bp, Homo sapiens
aataataacaaataaaaattaaaaaaaaaggacctcacagggttttatgagaatcaaatgaggtaatatgtctgaaggtactttataaactaccaagtgtatgtaaatgtaatattgtttgttttcttactttgaaaacctgaatttcagggaaaatctgcccagtcatttcaagttcaaggagtattgtccccaggtcttcaggaacctccgtgatcgatttggcattgatgaccaagattacttggtgagagtccattaaggggtgagggtagccctttctccccagcaactgaggagtactatttgggacagccatatttggagaaatgagagtcttggcaaatataattctttacctttttgtgattgcagcattttcaaaaatttaatgaaaattataaaccttgtccttgggggaaaagatgtagatacattaagaattttggccaggcgctgtggctcacgc

SEQ ID NO: 19129 - DNA, 566 bp, Homo sapiens
ctaagaataggtattgttggaatatacagtttgtatttgtctgctgtgaatcataatcttgaaatttctaatcaagtttgtaaaatttttatagtgaaacattttaatgacaatttaaaaatttatcttctctaaagaatggtcaaaacaatatcctttcagaaatagaattgttctttaatatctttccaaaatgactttggttaaatggaccagatgtatattagttaaaatttaggactaagttgttgatattctttgagtttacaagttaatccttattggagatgtgccaatatacagttagaatatcattaatttgcactgtttggggaccccatttaagaatgctgaattttgccaactaagaagtaagcaaatgcaatttaaaaagtaaatttgagcattctgtattaaatatgtgcagttattatcacatgaagaaacgcagtgtgtcgggctgtaatattaccatatttgctgtcatgttctcccatctcagtgctgggaaatcaccatgtggaaaccaagcaaacgtgttgtgcatcagccggcttgagtttgtt

SEQ ID NO: 19130 - DNA, 517 bp, Homo sapiens
caacaagagagctcattggggcctgacaagagtttgttcaaggggagaatcttggtaagctctcacttcaccctatgagaaaaatgattcattgaatagatgacatttgaaaagggaactgaagatattcagtctgtttcttctgggcattgtccacgggacacaaatgctcttttctgcaactagaggtaaattaaccatccctaggtgggagtgcagagtgcttggatcatctagtgaatggaggatgtgtaaatatgactcaagagtggattcactacgcagttgcagtaatcaagacatgcgggcacaatgataaacatgttgtgcctgtaatcactttgggaggccaaagcgggcggatcacctgaggtcaggagttccacaccaacctggctaacatggtgaaacccatctctactaaaaatacaaaagttagctgggcatgatggtaggtgcctgtaatcccagctaatcgggaggctgaggcaggagaatcgcttgaaccaggaggcag

SEQ ID NO: 19131 - DNA, 458 bp, Homo sapiens
tttgaatgtcaccgtatgcgtgaaattatatatttcggggtagtgtgagcttttaatgtttaagtcatattaaactcttaagtcaaattaagcagacccggcgttggcagtgtagccataactttctgatgttagtaaaaacaaaattggcgacttgaaattaaatcatgccaaggttttgatacacttgtcttaagatattaatgaaacacttcaaaacactgatgtgaagtgtccagattctcagatgtttgttgtgtggattttgtttagttgtgtgtttttttttttttttcagtgaatktctggcacattgcaatcctcaaacatgtggttatctttgttgtattggcataatcagtgacttgtacattcagmaatagcatttgagcaatttttatcagcaagcaatattttcagttaatagggtttcaaaaatcatgtaaggatttaaactt

SEQ ID NO: 19132 - DNA, 136 bp, Homo sapiens
ccctttacaccgcatgggcggacacttggccaccgccggggccttggggtgagcacacgctcaggaggatggacctaaagaaacgcttttgcaagccctgaaaacaacagtgatgaagtagaactgcatgtaacaa

SEQ ID NO: 19133 - DNA, 500 bp, Homo sapiens
attcctaggaaaaatgttgccctcttgtctcaagttctatctttgatccaggacgagggaagcctgtctgccagtctgcgaggctgatgctttttccccctcctcttccacctctgttttttcccaacttgctttaggattagcctccatctctctcgaccccaaacagtggaatttggctgtgcttgggtcgtcttgctttgcaatatcgcctatagttgttggcggttttctgctgaggctgagccgtttgctccagcctccgactaaactcattaagttgggagatttttttcaattggacgggtgtttttaaagtctcgtctttccagccccaaacaaggtgtaacaacgcactcttccttctaaggaatgagatgagagacaaggatcactccagacatctcctacctacggtttggggttttttttcttaaaggcgaggcttgcattcctcagcagctatgtacaaagctccctgaaaccttgtctctctaaag

SEQ ID NO: 19134 - DNA, 429 bp, Homo sapiens
atttttttgaatcctgtgggccgttgaatgtggctgctcgcggtcggcgtgccccgacgtacagcgggccgggaaaagtggcactgaggctctggaacttctgcccagctctccttgcttgtgttttctgtcgaaaacatgatgactgtcctaataaatacggagaaaagaaaactaaggagaaatggaatctcactgtacattactactgtttgttgatgtcaagtggaatttggcagagaggcaaagaagaagaaggagtttatggttttctaatagaagatatcaggaaggaagtgaatagagcttctaaactgaaatgctgtgtttgcaagaaaaatggtgcttcaattggatgtgttgcaccccgatgtaaacgaagttatcatttcccatgtggacttcagagagaatgtattttccagttta

SEQ ID NO: 19135 - DNA, 682 bp, Homo sapiens
attgttttggtgaatttgctgaattgaattgtttttctttctcaaatctgtgatctcttttctttatcctgtttctttgttcctttcgtttgctttcttatttttcttttgttccattcttttcttacttttttcccttttccttttttggggaggctggctagtagtgtgtgagaaaagaatagaagtgaaatttgcataatgaatgtaaaagggaaataaaagtcttttgaaggtagctatactagcacttttgatcatcttcagggcccaaaaatgttgtcaagattttaaaggtttataattctgcttaagctctagtttggacttaggtatcctaactatgttggaggtatttgcattgtttaaagttaggataaaagcaagttcctcctgtgactgcaacgtcttactgattgggacagttgccaggaggataccaacttgatagcagagggggttttatgcaaacgcactcacctccgccttggggaatgaaagggtcacttctgcatcatcactagctagttttctagtgttagagaggcttacaaatgtttgccattctcataagtgttttgaacttgatctttgtgacttgtgcttttttagcttctctcttgaatcagagtatcattgtcttcctccaaggagttagaatttcccagtttaaaacaaaaag

SEQ ID NO: 19136 - DNA, 484 bp, Homo sapiens
ggatggttggatggatggatggatggatgagcgagaacccgcgcccgcgaacaaagagcgaaccaaagcgatgcttcgaatttktaaaacggaatctctgcacccaaatgcaggactggtgacttaaggagctgcgaagtctgatttaccggcctactctcgacctgccccccacccccagctcaggggaccttttgtctgaacgccagagctactgaccaggtcggggggccgcggtggggagtggaagagccggtcctgctgtccgccctcccagccccaggtggaaggctcagttgtcggaaagacaaaagcgatttcttcccactcctgcagggccagaagttcaggctgccccgcctccactgggggatcgcacctgtgaattacctgaggtatgcatttcccagaaccgtgggcgtacccaccttgggggcatgttggttctggggggacacctctccttgcattcaggggctgtgaa

SEQ ID NO: 19137 - DNA, 142 bp, Homo sapiens
aggatcacaatctgctgcatatgcatgaggggacccggccgcgcttcgaggctgtccacactgcgcctgataaaaattattcgggcttgaagatctcggggctcccagagttttgtaaaagtgcatacaaagtcctcaaaaa

SEQ ID NO: 19138 - DNA, 554 bp, Homo sapiens
ttgaagtttttctatttttcactttgccaaaaatgttttacactcacaaagatattctcacttagtcaactcctgtcaaaatgaaggtgaactggcatggcccgatcactgtccataagggagaaagtggctcattcctggtagaagtatgggtggttatcatttcaaaattattgtgattctcacctccctccccacctcagtgttttgtctgtcygcgcccaagaaagataagcaagtatttcctgctggatgggggttggcaggaagctgttaaagatttatgccagagccttgcaggatggagcacctctgggacaactaagagccaaggcccaccaaggagttttccacccgtctctcatggtcacagcgctagtcattcatttttgagaagttgcttcttttacatcagaaaaccagtcaatcatatggagacttcttttgtgatgaaaaagggctttagaagttaaatacatgcatgcacatgaaaacatgcacaaccacagcctcaatcttgtatttagtttggggaagagaagagaatttcctgt

SEQ ID NO: 19139 - DNA, 466 bp, Homo sapiens
ggatggttggatggatggatggatggatgagcgagaacccgcgcccgcgaacaaagagcgaaccaaagcgatgcttcgaatttttaaaacggaatctctgcacccaaatgcaggactggtgacttaaggagctgcgaagtctgatttaccggcctactctcgacctgccccccacccccagctcaggggaccttttgtctgaacgccagagctactgaccaggtcggggggccgcggtggggagtggaagagccggtcctgctgtccgccctcccagccccaggtggaaggctcagttgtcggaaagacaaaagcgatttcttcccactcctgcagggccagaagttcaggctgccccgcctccactgggggatcgcacctgtgaattacctgaggtatgcatttcccagaaccgtgggcgtaccaccttggggggcatgttggttctggggggacactctcttgc

SEQ ID NO: 19140 - DNA, 440 bp, Homo sapiens
acacttggtttcagggaaggggaaagaggtcaccaagggcagaggtgtccaggccggagccaggggccccactgttgggatgctggctgcagtggggcgccccaagcccaggtcccctctgtcttctctttcgactttgcagctgtacttgttttgctcctctacccgcagagctgacatggacccaaatcctcgggccgccctggagcgccagagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaac

SEQ ID NO: 19141 - DNA, 355 bp, Homo sapiens
tataattagaaaactattggctttcaaacaactaagggccaaaagcagcaaaaatgaatgcacaattaaaatgagttcctattaacaaaacaaatttactgtaattatgatagctaggtaatccttgttctcttatatatttatatatacttactagtggcaccaaatattagtatacccagtttgagatgcagtttgttgaaatatatttggacacagccgggcgtgatggctcacatctgtaatcccagcactttgggaggctgaggtggcaggatcgcttgagcccaggagttcaagaacagcctgggcaacatggtgcgaccttgtctctacaaaaaaaaaaaaaaaaagg

SEQ ID NO: 19142 - DNA, 400 bp, Homo sapiens
aaaaatggcaattccctatccctaatctagtactctgtttcttactctgccttactttttcttcataccgtttatcactgccacaaccaaccactactactactacttatttacttctttattgtgaagttcttatcccagaacataagctctttgctcttcatttactcagtaaacatttgtttgttgaatgaagagaaacatagagattatgctatatattgctgaggaaatttaagagctcatcttagaaagttttgttggagaaaagatcttttaaaaatgggctttgattgaagtatagcatttggagagaaaggatgtaaccattctaaactgggaaaatagcatgaggggagacattgggtctggaataaggkaagtgtgtatgggatgagga

SEQ ID NO: 19143 - DNA, 196 bp, Homo sapiens
gataattgtttgtctcctgcagctggcaatgtgccttaacgaaatagctatgtagtaagtgagttgctgtctacatgttttatgccacaaaaatgaatggagtatgccaagaagtgacaagtgtgagagggcagataagtttatttagccataatgtacatgacatgtaaaatattaaaatatataaatgcaaaar

SEQ ID NO: 19144 - DNA, 249 bp, Homo sapiens
gataattgtttgtstcctgcagctggcaatgtgccttaacgaaatagctatgtagtaagtgagttgctgtctacatgttttatgccacaaaaatgaatggagtatgccaagaagtgacaagtgtgagagggcagataagtttatttagccataatgtacatgacatgtaaaatattaaaatatataaatgcaaaaaaaaaaaaaaaaaaaaaaaaaaaaaaaaaaaaaaaaaaaaaaaaaaaaaaaaaa

SEQ ID NO: 19145 - DNA, 486 bp, Homo sapiens
acacacacgagttggtggttgtgctgcccggagcctccagtccgcgagtgtgaagaacggaccagatgggtccagcagtgctgggtcaaggccaggaggggcagccggaagcgcgcgcatgctctggactcctgcagccgccgaaacggtcaggttttccttgttcccgcatgttcagccaatcgtgtttaaggagaaactaacaatgaaaacggactcgttgatggaggaaaagttggaatgcagcctctggtgctgtttgagcgatccctctatcccgggtcgctgctgtgttctggaaaggcgcattgtaccctggatgcagcaggtgtctctgggttaaacaggaatcctattcatcttcttcaccgatatggtctgtggactctgatgagccaaatctgacatcagttctggaacgtctagaagatactaaggagaacagttcggtgaggaaagaaaccaagctattttctcttttcctca

SEQ ID NO: 19146 - DNA, 465 bp, Homo sapiens
ggtgtaacgttcgggctccgtctcaggggctgaagtttgtgaggtgtagtattgagtcctgtttgagctattgttctctttttcctgaaaaatggcactgtcaaagagggagctggatgagctgaaaccatggatagagaagacagtgaagagggtcctgggtttctcagagcctacggtggtcacagcagcattgaactvrtgtggggaagggcatggacaagaagaaggcagccgatcatatgaaaccttttcttgatgattctactctccgatttgtggacaaactgtttgaggctgtggaggaaggccgaagctctaggcatccaagtctagcagtgacaggagcagaaaacgagagctaaaggagttccaggaagcgctcgcccctggccgaggatatgtccttgcaaaacacgagccctcctagtgaagaggggatgtcacccaaagcctaccaccgga

SEQ ID NO: 19147 - DNA, 480 bp, Homo sapiens
catctaggtgtgtgtttggaatttttttcttttgttttttggaaaatggaaagaacaaggcaaggaaggaaaattaatggggaagctgaagggaggaaatgttacagtaatccactgagatgtagtttagtcaaacataggtatatgaactgttaatcttggtggattccgttgggatttgttttttacatctcctttttccttccttgaagaaaaattcttggctgtcccaaggattcttcatgtatattgcaaaatttaatatatttgttcacttgagtcttaagagtaggtcaggccaaggcaggtggatcacctgaggtcagaagttcaagaccagcctggccaacatggtgaaacccctctctactaaaaatacaaaaattagctgggcgtggtggtgcatgcctgaaatcccagctacttgggaggctgaggcaggagaattgcttgaacccgggaggcggaggttgcagtaag

SEQ ID NO: 19148 - DNA, 406 bp, Homo sapiens
acatcggatcgcagggctcccaaaatggcgagtgaggctgcggggactcgctgagcagcggagggggagcgtgcagagccgctgcggccctcacagtccggagcccggccgtgccgtgccgtaggaacatgcacttttccattcccgaaaccgagtcccgcagcggggacagcggcggctccgctacgtggcctataacattcacgtgaatggagtcctgcactgtcgggtgcgctacagccagctcctggggctgcacgagcagcttcggaaggagtatggggccaatgtgcttcctgcattccccccaaagaagcttttctctctgactcctgctgaggtagaacagaggagagagcagttagakaagtacatgcaagctgttcggcaagacccattggcttgg

SEQ ID NO: 19149 - DNA, 337 bp, Homo sapiens
tattctagaaaatgtattatgcatatgaaggatttggttttgtctaactaggggggacacgtgagacacttccaagtttacagattcaggcagaaattgtaaagtcctatagcttttgcatatgtcaaattggcaagtccgaaaacaaaattgcatccatcctttggttatggaaatgttgtaggtattgctaaacaggctgctgaatcaggagcaagttagcagagacattgcatgtttcatgttgctacttgctaaggtatttttcaaatgcagtgggcggtctgaagagctcctgtgcccttgactgtctactttctgtctttttttttttttt

SEQ ID NO: 19150 - DNA, 515 bp, Homo sapiens
  misc_feature 199: n=a, g, c or t
aaaaatgcaaagcaattctagcttcttgccgtaggcttattattggtggcaatattggtattgkaattttgacgctatgctataagtaaatatgttaatgctattaggaaccaagattttcagtgtaaaagaaaagagataaaatacaaaatcaaagaaggtaagagaaaactttagaacattgatttcttgctctggnattktktttttttwtttttttttagccttgctctgttgcccaggctggagcccagkggcacgatcatggctcactgcagccttgacctcctgggctcaaacgattctctcacctcaacttcctgactagctgggactacgggtgkgcaccaccatgctaggstaatttttgkattttttgtagagatggggttttgccaggttgcccaggctggtctcaaactcctgggcccaagagatctgcccaccttggcctcccaaagtgctgggattacaggcatgagccactgsgcctagccagaacattgatttatagg

SEQ ID NO: 19151 - DNA, 258 bp, Homo sapiens
aagcccctcattttggcagaacttaccatgtcgaccagccgcaaattaaagagtcatggcatgaggaggagcaagagccgatctcctcacaagggagtcaagagaggtggcagcaaaagaaaataccccaatcgcaattaccgctcccacttgtgakcccccagcgggctctgcctggtgcgcttcacacagcaccaagcagcaacaagaacagcagaaggggaactgccaaggagacctgatgttagatcaaagcca

SEQ ID NO: 19152 - DNA, 391 bp, Homo sapiens
  misc_feature 391: n=a, g, c or t
aaaagcccctcattttggcagaacttaccatgtcgaccagccgcaaattaaagagtcatggcatgaggaggagcaagagccgatctcctcacaagggagtcaagagaggtggcagcaaaagaaaataccgtaaggcaacctgaaaagtaggaaacggggcgatgacgccaatcgcaattaccgctcccacttgtgagcccccagcgggctctgcctggtgcgcttcacacagcaccargcagcaacaagaacagcagaaggggaactgccaaggagacctgatgttagatcaaagccagagaggagcctatggaatgtggatcaaatgccagttgtgacgaaatgaggaatgtatatgttggctgtttttccccagcatctcaataaaacn

SEQ ID NO: 19153 - DNA, 455 bp, Homo sapiens
attggatgagagtagcccacactcaaggaaagatgaaactagctcacctcttaaagtgaggtgtattacagaatgtggcattatgtttgctggatcccatatctttctcttttgtgattttctcccttgttttggtggtacatactctcatatccgagtgtcttcttgagcatgggctgccttggagaaataaatgttagctgagaaggaaactttctaacattccagaaattctgagtgccaaaactcatctggccccaaggatcgggaaggatattgcagtcctgcgatttacaaacatgtttcctcccagagtcaccccaatctccatgagagtgtgaggccatggaagcaaaaccctcagatttttgtcttttctctatcattcattatgtgatctcaaacaagtccaccaaactttttccccaacatctcaataaaactttgaaagcaga

SEQ ID NO: 19154 - DNA, 390 bp, Homo sapiens
aaaagccctcattttggcagaacttaccatgtcgaccagccgcaaattaaagagtcatggcatgaggaggagcaagagccgatctcctcacaagggagtcaagagaggtggcagcaaaagaaaataccgtaaggcaacctgaaaagtaggaaacggggcgatgacgccaatcgcaattaccgctcccacttgtgagcccccagcgggctctgcctggtgcgcttcacacagcaccaagcagcaacaagaacagcagaaggggaactgccaaggagacctgatgttagatcaaagccagagaggagcctatggaatgtggatcaaatgccagttgtgacgaaatgaggaatgtatatgttggctgtttttccccaacatctcaataaaacb

SEQ ID NO: 19155 - DNA, 351 bp, Homo sapiens
aaaaattaaagaktcatggcatgaggaggagcaagagccgwtctcctcacaagggaktcaagagaggtggcagcaaaagaaawtaccgtagggcaacctgaaaastaggaaacggggcgatgacgcaatcgcaattaccgctcccacttgtgagcccccagcggctctgcctcggtgcgcttcacacagcaccaagcagcaacaagaacagcagaaggggaactgccaaggagacctgatgttagatcaaagccagagaggagcctatggaatgtggatcaaatgccagttgtgacgaaatgaggaatgtatatgttggctgttttttccccaacatctcaataaaacttt

SEQ ID NO: 19156 - DNA, 389 bp, Homo sapiens
aaaagcccctcattttggcagaacttaccatgtcgaccagccgcaaattaaagagtcatggcatgaggaggagcaagagccgatctcctcacaagggagtcaagagaggtggcagcaaaagaaaataccgtaaggcaacctgaaaagtaggaaacggggcgatgacgccaatcgcaattaccgctcccacttgtgagcccccagcgggctctgcctggtgcgtttcacacagcaccaagcagcaacaagaacagcagaaggggaactgccaaggagacctgatgttagatcaaagccagagaggagcctatggaatgtggatcaaatgccagttgtgacgaaatgaggaatgtatatgttggctgtttttccccaacatctcaataaaa

SEQ ID NO: 19157 - DNA, 390 bp, Homo sapiens
aaaagcccctcattttggcagaacttaccatgtcgaccagccgcaaattaaagagtcatggcatgaggaggagcaagagccgatctcctcacaagggagtcaagagaggtggcagcaaaagaaaataccgtaaggcaacctgaaaagtaggaaacggggcgatgacgccaatcgcaattaccgctcccacttgtgagcccccagcgggctctgccctggtgcgcttcacacagcaccaagcagcaacaagaacagcagaaggggaactgccaaggagacctgatgttagatcaaagccagagaggagcctatggaatgtggatcaaatgccagttgtgacgaaatgaggaatgtatatgttggctgtttttccccaacatctcaataaaa

SEQ ID NO: 19158 - DNA, 427 bp, Homo sapiens
aaaagcccctcattttggcagaacttaccatgtcgaccagccgcaaattaaagagtcatggcatgaggaggagcaagagccgatctcctcacaagggagtcaagagaggtggcagcaaaagaaaataccgtaagggcaacctgaaaagtaggaaacggggcgatgacgccaatcgcaattaccgctcccacttgtgagcccccagcgggctctgccctggtgcgcttcacacagcaccaagcagcaacaagaacagcagaaggggaactgccaaggagacctgatgttagatcaaagccagagaggagcctatggaatgtggatcaaatgccagttgtgacgaaatgaggaatgtatatgttggctgtttttccccaacatctcaataaaactttgaaagcacaaaaaaaaaaaaaaaaatgcgaaa

SEQ ID NO: 19159 - DNA, 453 bp, Homo sapiens
gaatttcagtgcctatcgggcagccagtgaacatttgtccatctttaaggcattaaactgagaagaaccactgaggaaagcatgccacagtctttcccaaaatccctgtgtcttaaggaacaaccaagaagttaactggtcagggaaaagatttcttttggaacgcagagaatgatgggagttgtgatccatacctccgtgtgcataatggttgtacctgctccaggaaggcgctggatcctcccaactccatgggaagagattaggacacaaacaacagacagaaggtgaccacaggaggacacagtgagaagctggccatctgcaagccaaggagagagacctcaggagaaaccaaacctgccagcaccttaatcttagacttctagccctcagaacggtgaggaaataaatctctgttgttcatgcaaaaaaaaaaaaaaaaargctttg

SEQ ID NO: 19160 - DNA, 494 bp, Homo sapiens
gaaaaattgctgccaggccctccctcttggaggcagctctcacaggaccctgaaatcttggcctgagattatttccaataactaaatgcagatttgagcaacaagagtcttgatgggaatgttctaattcgtgtctctgttgcaaacctgtcctttcccacagccaatcgcaattaccgctcccacttgtgagcccccagcgggctctgcctggtgcgcttcacacagcaccaagcagcaacaagaacagcagaaggggaactgccaaggagacctgatgttagatcaaagccagagaggagcctatggaatgttagccattgtatggctaggaaccaatgcacttggcagttaatggatctgctgttgctggagtgtgagcgtggacttgatgcagtgatgacaaatcattgcttagaattaatgttttcaaatgtgcaactctagtttttaaaacaaaatttggttctttacattcattatttcgtttttgt

SEQ ID NO: 19161 - DNA, 550 bp, Homo sapiens
acaccagagatggaagtacatgtgatacaggtgtatccctttctgcctgtttttctccctctcataaagcagaggtttgccctgcatctgagaaagaattagaacagaactttcctccatttcattccccacctcactacacttgggccaggcagcgttcgccagtcatggcacttcctacyaagtctgaatgctgtctcagaaacttgctcaacacagccgtatggaccatcacccccaactgactagaattagcctacaagaagaagttttctttcaccttagtgagataatttattatggccataagtaactgaaatgtagcatttggggatgaaaagcacagttaccagccaaagactccctgggggatggcggggggaatatgggcctgtgcgtcagaaagccccaggcacactttcatcaacttcgataawksmrrrggrammmcmrrrgrmskttttyytymamyyyksmmmrsywwttgactctattattttctgaaggcaaaaatgcatgtttgttagaatggaaacagaaaaacattaaa

SEQ ID NO: 19162 - DNA, 623 bp, Homo sapiens
acaccagagatggaagtacatgtgatacaggtgtatccctttctgcctgtttttctccctctcataaagcagaggtttgccctgcatctgagaaagaattagaacagaactttcctccatttcattccccacctcactacacttgggccaggcagcgttcgccagtcatggcacttcctactaagtctgaatgctgtctcagaaacttgctcaacacagccgtatggaccatcacccccaactgactagaattagcctacaagaagaagttttctttcaccttagtgagataatttattatggccataagtaactgaaatgtagcatttggggatgaaaagcacagttaccagccaaagactccctgggggatggcggggggaatatgggcctgtgcgtcagaaagccccaggcacactttcatcaacttcgataaatgcagagggaacaccagaggacgtttttcttcaactctgcacagctattgactctattattttctgaaggcaaaaatgcatgtttgttagaatggaaacagaaaaacattaaaaagttaatyccttaacacaaaaaaaaaaaaaaaaaaaaaaaaaaaaaaaaagaaaaaaaaaaaaaaatgcgaa

SEQ ID NO: 19163 - DNA, 505 bp, Homo sapiens
tttgttgaaaggtcaacatgggtgtttggaagaggtaatgctaatgaggtattcgtaaaattggaggtaggcaactttgcttttgatacccgttatcaccattccattgccccagtaaatgtaaattccttaagtgtttggcacatacgatacgacgtccaatagatacttgttgaataaggtaactttttccttctttttgattattccctgagaaataagtgtcctggtgctgccccctggtggctaaaggatcccttcattgggagcccaaaccctccttggcaatgccgtgggctgggaacatggctctgtttgactgtatagttccccttcctcacaaaggatattaaggatgttaaagggtatcagtggtatagataagagaaatacgtttttctttcttttaaattctatatttgatttttaaaaactttatccaagtgggcgtgaaagtcttaataaaaatgcctacgaataaaagggttacatggacatgtgcaaa

SEQ ID NO: 19164 - DNA, 435 bp, Homo sapiens
tgttaaatattaatgacattgaatgtgcttaatggttttgtggtgatgtagaaaagggtttctcaatcttggcattattggcaaactggaccggtgcatgctttgctgcggagagtgtcctgtgcattgtgggtgctgagcagcagttctggcctccaaccgccagatgtcgagagagcttttccttctcccattgagacaaccaaaaatgactctagatgccgccatgtgtcccccggcgcgcaaaattgccccctgtttgacgatcatggtgtgagacgatgttatcattaccagtagattcatactaaaatatttcagggtgaaattttcacagtttattttcagatagcttaatcagaattgaaaacaggataaaggcaaaaagagaacatttttgaaaaaagaaaagaattaaaaaaaaaaaaaaaaagg

SEQ ID NO: 19165 - DNA, 497 bp, Homo sapiens
tcgcttgcggctgacctttctttggaatgtcgtgagttccatttgtcccagaatacggtccgctaccgctgtgacatgagtgttagggaaggcgggttgtcacgtttctacaagccttccagtcaaaagggaaaccttgcctaagtccttgtagttgagaaatctctaagaggtggaagcaaatactgcacatgcgtgttggtcctgtgagggaaaccagctagtggagagggagaggttgaaggaacagaaaaatgagaagacaactcactggtagagtaacttggaatagatagaaatgggatcctgggcacgtattagttgtggggataggagaatgaatcctttatctgtgactcctgatggggtaaaaaaaagattatggataatcataagctcaggtgtgaggtagggcagagagaaaaagaaggaatttgcacctgatggcttctgttttctctgtaaagttggtgacagagttgtcagtttagtgtaaa

SEQ ID NO: 19166 - DNA, 497 bp, Homo sapiens
aattttagcttggcaaacttgtttcatcagtatctgggcctggtactatgctgaactaggtggtagaaagaaaaatgagacatggccctcatcttcaaggaccttggggtgtaaggcaaagatgcattaattagtggagatatgtcaaatatgcatagaaaaagtaacaactgataaagatcccaaggaagaaaaagaggaagaagacgattctgccctccctcaggaagtttccattgctgcatctagacctagccggggctggcgtagtagtaggacatctgtttctcgccatcgtgatacagagaacacccgaagctctcggtccaagaccggttcattgcagctcatttgcaagtcagaaccaaatacagaccaacttgattatgatgttggagaagagcatcagtctccaggtggcattagtagtgaagaggaagaggaggaggaagaagagatgttaatcagtgaagaggagataccattcaaagatgatc

SEQ ID NO: 19167 - DNA, 369 bp, Homo sapiens
aaaatgacatttagttattttgataatgcaacctgtgtcgattctgctggcatcctcaatcagtccaagtaaaagaaatacaggaagggagagggcttttatttttaaattaagatggcagcattaatttcactaagtgttcttttagaagtaaatgttggaaaatcagcaggaacatgggtgtaatgctttctggtcctccttccaagtaatgccatgagctttgacggtgctgtaattaaatagaaagcaaaactgtggtaagaaaggagtgtggtttgaagtggaaaaattgacagtgctgttaagattccgtgaatggtacagattcatctcttctccgagtgccttcaaaaaaaaaaaaaaaaa

SEQ ID NO: 19168 - DNA, 400 bp, Homo sapiens
atcattttccctgcaggacacccggcctcggtcctgctttagtattcatcccagcttcattactgcagccacctcgcaacccaccctgggcagctgctaaaagggggaaaaattaaagcaattcatactcctggtgacttactgctgcagaataattggtttctgtttgcaaggaacattatcacagcaaagcccagaaaacagaaagggatgatcatggtgattttactgctgcttgtggctatcgtggttgttgcagtctggccgaccaactgatggcagtaaagagaccaccagcagtgacacctgccaatgacagatgcaagcccaacacccttttggtacgcaaaacctgctctcaataaattcccccaaagctccaaaaaaaaaaaaaaaaagg

SEQ ID NO: 19169 - DNA, 144 bp, Homo sapiens
atggaatgtagcaasactccttttatagatgagcaaattgagacccaaagccgttaaacaacttgcccccgacagtgtgatattctctccctatctcgttcgaatttccgtctcgattttaaaaattgagaagggagagaaaaa

SEQ ID NO: 19170 - DNA, 434 bp, Homo sapiens
  misc_feature 393: n=a, g, c or t
gatttcacgttcactctgtaatggctgggggcttcagtaaaatacttaatctccctaagccagttttttcrtctgtaaaacggagctaataataacagtcttaccttgtgtaaatggcacagaattattatgttttctgtgatttacaaagagcatatatgaatttaataatcagaaaagatggcattctagatttaatctctaataaacctaatttcaatggtgggacatttaatgcaaattttcatcagaaaggaaagggatggaggaaagtttaccaagcaaatggaaaatagaaacaaatgggttataatcgtaatttctgacaaaacagastttaaaccaacaaagaccaaaawaagacaaagaaagacattacataatggtaaagcngttcaattcagcaacgaagastaactatcctaaatatatat

SEQ ID NO: 19171 - DNA, 151 bp, Homo sapiens
atggaatgtagcagactccttttatagatgagcaaattgagacccaaagccgttaaacaacttgcccccgacagtgtgatattctctccctatctcgttcgaatttccgtctcgattttaaaaattgagaagggagagaaaaaaaaaaaaa

SEQ ID NO: 19172 - DNA, 170 bp, Homo sapiens
atggaatgtagcagactccttttatagatgagcaaattgagacccaaagccgttaaacaacttgcccccgacagtgtgatattctctccctatctcgttcgaatttccgtctcgattttaaaaattgagaagggagagaaaaaaaaaaaaaaaaaaaaaaaaaaaaaaaa

SEQ ID NO: 19173 - DNA, 162 bp, Homo sapiens
atggaatgtagcagactccttttatagatgagcaaattgagacccaaagccgttaaacaacttgcccccgacagtgtgatattctctccctatctcgttcgaatttccgtctcgatwttaaaaattgagaagggagagaaaaaaaaaaaaaaaaaaaaaaar

SEQ ID NO: 19174 - DNA, 532 bp, Homo sapiens
aatcatgcaatcaaccatttactgagaacctgctttgttgctcaactctgtgctggcgactctcaggaagacagggaagggatcttggaagccccatgttgaaggtggcagagcaacaaaaattgaggaaaccctgaatccctgaattactatttggagatgaccacccactaattcggaacactcattattgggctttaggagaatgagaagttctatcatgtttgagactccgtacatctttggatttgttttaacagctagttttaccctggctaacatggcaattgacagcctctgagaggagatttggagaatctgcttttttaacaagtactccaggggagtttgagaatcactgctgaaascaaggggagccagccacccaaggatttaacgctgaccaaggaacaccacgctatttgcattttagaatgacagcaagggagcagaactctgcccccttcttgtctgccaaggagaacaatctactgactcaaaagaaaagaaaactttggtaagagaaaattga

SEQ ID NO: 19175 - DNA, 519 bp, Homo sapiens
  misc_feature 483,503: n=a, g, c or t
gcagtgatgtcacggcaggtgcggccagcgttccgagtcgaggacagttggcgacactgaaaattcagcgtctccgggagtctctctctttgtagtctttgcccagggccttgccaggcaaagggtagcccgacgaccagcagcctccgctacttctgggcgctcgctagaaatacagattctcgggccccaccccgacctacttggtcgtatctgtgatctgtgaacaggacctttaggtgatttgcatacactgtaaactgtgaaagccatcagtgtagtggaaggagcatagaatttagagtagagagacatggttttggaccctggttcctgctttccttgtttcatctgtgctgccttagaaaattgtcatgagcccgggcgcggtggctccggcctataatctcagcactttgggaggccgaggctggaggatcccctgaggtcaggagttttagaccagcctgcagtcttaaccanaccttgtaccaatttaacanttcattatactctgtg

SEQ ID NO: 19176 - DNA, 658 bp, Homo sapiens
gcagtgatgtcacggcaggtgcggccagcgttccgagtcgaggacagttggcgacactgaaaattcagcgtctccgggagtctctctctttgtagtctttgcccagggccttgccaggcaaagggtagcccgacgaccagcagcctccgctacttctgggcgctcgctagaaatacagattctcgggccccaccccgacctacttggtcggtatctgtgatctgtgaacaggacctttaggtgatttgcatrcactgtaaactgtgaaagccatcagtgtagtggaaggagcatmgaatttagagtagagagacatggttttggaccytggttcctgctttccttgtttcatctgtgctgccttagaaaattgtcatgagcccgggcgcggtggctccggcctataatctcagcactttgggaggccgaggctggaggatcccctgaggtcaggagtttgagaccagcctggccaacatggtgaaacccgcctctactaaaaatacaaaaatttgccaggcgtgatggcaggtgcctgtaatcccagctactcaggaggctgagacaggagaatcgcttgaacccgggaggcagagattgctttgaggcgagattgcaccactgcactgcaacctgggcgtcagagcgagactttgtc

SEQ ID NO: 19177 - DNA, 303 bp, Homo sapiens
aaggttgttttttcccaggaggccgactccgccgagtcggtgrcggctgcaggctgggagggagaagtgctacgcctttgcaggttggcgaagtggttccaggctacccggctagtctggcacggccccgtcttctgcctcctcctccgtcgcgtggcggcgggaactgttggactgcgcggcctcgggaacggcccaggtccccgcccgcaggtcccgggcagataacatagatcatcagtagaaaacttcttgaagttgttcaagaaaaatttgaaagtagcaaaaaaaaaaaaaaaaagg

SEQ ID NO: 19178 - DNA, 369 bp, Homo sapiens
ttgtttttaaattacactactggtgatagaagtgtatgtcaggtaggtagatggtgaatgaatatttgacttaggacagcaaactggcatggcagctgtacagatgacctggcatttaatcccaggtgtgtttgagcccaccatctggaagccattcctgaaaacaaacacgatttctctaccttttgttttcattttcaactgtgaggtttgtatttcagtttagaaaatactcaagttgggccgggtgcagtggctcacacttgtaatcccagcctttgggaggccgaggtgggcggatcatgaggtcaggagtttgagaccaacctgtccagcatggtgaaacccgtctctagtaaaaatacaaaa

SEQ ID NO: 19179 - DNA, 500 bp, Homo sapiens
tatactgatgacatacagatttagtcctcatctcttccttcaactgcaggcctctgtgtccaacttccttcttgactcctccacttggatgaataataaatagccgcctcaaatattttaaagtccaaaacaaacccttcattgaactgtttgttccctcttttcaaccatgccttgtccatgtggacacccccaccccaaaagtcatccttgatttctttttctttaccccctctgcccacatccaacccatcagtaagtcttgtcagttctacttccaaattatgtttttaatgttattcccatttctcagttccactatcaccaccacgactatttcttgccatagtctcatttcttgccatagtctcatttcttgccatagtctcctaaatggtctcccagtctctagtcttgctgtcttataaattcctctccagtcagtagccagagttatctttcataaaatataattttaattttacaaaaaaaaaaaaaaa

SEQ ID NO: 19180 - DNA, 293 bp, Homo sapiens
cttcatgtgttttttggctgcataaatgtcttcttttgagaagtgtctgttcatgtccttcgcgaaggacaagataccttaaagataagttttcgataaagaaaagccttcattttcctgggggaaatgaagcacttgatgccaaggacattagtagagggctagaaagattgcctgtgttgaaagacatatgctatatcccaaataataaaacaaacgagatccctggggctcattcatgtgacttttcaataaagtatgtagactgtctaatataaaaaaaaaaaaaaaaa

SEQ ID NO: 19181 - DNA, 558 bp, Homo sapiens
attttgggaagagctttgttatggttgtggactagccgcctctgccgggtcgacaagctggggacgcgtcctcagacgagcgtctagtccctggccatagctccgccgctgcccgttggtgtctcacctttaactctccttatgctgggtgaaaacaaagagtgatagattcgtgtggcctttcaaatgattgtgaagtggtggaaatggatccaaaataataagtgacttctctaccaaagcatagaagattcttcatatctccttccagtggctcaatttagattttgggaaggagcagaacaagtgaaacacagaaaactgaagagaagaaatcctcattttggacctatatttctccttgactatttcttaatatccatcctacccatcgttctaatgttttaactttgctctgaatttataaatagtaaaggccaaagacatagaatatacatttagtagctttataccaagaaatttgccttgaaagctgctgttcgtggagggaaaagtgtagcaaattcctgtctatttttattttttatttttttttaa

SEQ ID NO: 19182 - DNA, 471 bp, Homo sapiens
taaatattgctcctcagccagccccgctacagagcctggtatttcctcttttaagaaattgagagcaagtaccttttacctgggaaggggaaactcatcaaatgctatctgctcttgggacccaatcctgagttactttatcagattaacctgatagtcaccagaactccattcaaacagaacacaggactgttatatttgggtcagtaaaggacaaagatctggtgtctggactgcaggtgctgtggtatcgttggaagcaaagatggaaaacaaagcaggagatgaagggttcatagagataaacttcttcctattttgcctgggattccaggtagcagaactggagctcagacctcttttggggggatcctaagcaatacttttgctgctcccttctggtccacatcacaagtctggagaatctaaaacaagctgggcaatgagaaaatctaactcttcatgtgttat

SEQ ID NO: 19183 - DNA, 563 bp, Homo sapiens
taaatattgctcctcagccagccccgctacagagcctggtatttcctcttttaagaaattgagagcaagtaccttttacctgggaaggggaaactcatcaaatgctatctgctcttgggacccaatcctgagttactttatcagattaacctgatagtcaccagaactccattcaaacagaacacaggactgttatatttgggtcagtaaaggacaaagatctggtgtctggactgcaggtgctgtggtatcgttggaagcaaagatggaaaacaaagcaggagatgaagggttcatagagataaacttcttcctattttgcctgggattccaggtagcagaactggagctcagacctcttttggggggatcctaagcaatacttttgctgctcccttctggtccacatcacaagtctggagaatctaaaacaagctgggcaatgagaaaatctaactcttcatgtgttattcccaataaatcagttatgacataaaaaaaaaaaaaaaaaaaaaaaaaaaaaaaaaaaaaaaaaaaaaaacaaaaaaaaaaaaaaatgcgaa

SEQ ID NO: 19184 - DNA, 385 bp, Homo sapiens
gtgcgtgcgcgcgcccggtccgcgcctccgccgctttttatagcggccgcgggcggcggcggcagcggttggaggttgtaggaccggcgaggaataggaatcatggcggctgcgctgttcgtgctgctgggattcgcgctgctgggcacccacggagcctccggggctccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatggg

SEQ ID NO: 19185 - DNA, 88 bp, Homo sapiens
cattttagatgtaacctcgggtatggtgaaagacccaccggacgtcttggacaggcaaaaatgccttgacgctctggctgctctacgc

SEQ ID NO: 19186 - DNA, 513 bp, Homo sapiens
catgtgtaacttgatgtggtggatatgaggatactttcagttttgataacagaaaatgcaactcaaattagttaaaacaaagggaatttgaatttgaattacatacgcttatgtaattgaaaagaccaaagggagtgagggcccctggcatggtttgatgaagggtacaggctttggccctgtttttctataattctcttggctttaccctgtattagcttttttttctcaaacgggcttccccagtagtacaagatggctgcctttgtatgtttcctcattcctggagagraagtagatgcttcctacaaatacagtgcaaaatcctaagcttgacactaattgaaccatcttgtgctccaaaggatcactgtcttaaaatctgggtagctttctgtgtctagaccagtggcttttaaacttgagtgtgcattagaactacctggaggacttgttaaattacagattgcagccgggcactgtggctcatgcctgtaatcccagcactgttgg

SEQ ID NO: 19187 - DNA, 464 bp, Homo sapiens
ttcacttaatagtccaaagtctcttaaattcctgctgcagacatcaatagcttatctatattctcaaacaccaaaaggaaaagttgaatcttgctctctttggtatactaatgtagtggtatgctaagctggctcataccaacttagaaaagctgattgtaaaattttcattttgacagctggttattaaatgcagccattattaaaaatcaaatcatacaaacttataattaaatcaattacatttaaaacaaaggtaataaatattcaaagcatatcacttcctaatttgatcttgatgctcttgaggtaatttacgtccatggtacctgtgtggtggaattactatataagatggtgtgctactgtgcaccttgtctcatctccactcttcgtgatagcatgttggtagcttgaaatcagcctggtgggagtattaccatggacactggcaaaagctacag

SEQ ID NO: 19188 - DNA, 472 bp, Homo sapiens
tcgagacctgacggttttatgaggggcttttccctcttttgctcagcatttctccttgctgccgccagtgaagaaggacgtgtttgcttccctttctgccatgaatgtttcctgaagcctctccagccctgtggaaataaatgattattattcttcaagaagaaatccactaacagcatccttttcagaatgaagatctgaaaaggaagagattatctcctctttaatgctgtatcccaaagcctagaagaaccagagacttactagctaatcaataaatattgctgagtaaataaatgacagacatttgcatgcaggcctcaaggagcagctgaagtgatagaggtagaatgaggcaataaattattagcaaagagagcggagtatttacaggcagcgatatactaatgaacctaaaaatttggagaatatttggaaaaataaaagagcttgcatccctggaatgcaacga

SEQ ID NO: 19189 - DNA, 473 bp, Homo sapiens
ttactgttgcttctatatgatgtaaactttaaaaattaaggctcaaattttagaaatacacagaggacaaacatacactctaaaacatgtttatttcagtctaaacaaatgttttgtttatggatattagtgtttttgagaaatcactcagaaaatgttacttcatggccttgcaatgcttgatgttagtttagcacatacaagtgcacttttatacccattgtttaggaggttttatttttaaaattttcttttggataatctcaaaacaataaaggcatttagtgagtacaaatttggaaatcccattttatttttatatctattttcattgtttatcttattgtttgagacagaaattgttaccatgtgatgatgatttccctgttgttttactgtacaaatatctgcctaattgtaaaattatgaatataaaattttaatattgtataataatctttcttggaggattt

SEQ ID NO: 19190 - DNA, 518 bp, Homo sapiens
aaacaaccacagctttttcaaattcaaaagccagatgattttgacatgactagcagattcatatagttgcaaattgggcaataattagataattgctaaaatactcacaaatatccaggtatggtgacagcaataatatgaagaataaccactaacatttattggacactttgcatgtaataagccttctttgaagcatttgcatggacattactgagtactcacaataaccaatgaaatgggaatattattaaccactattacaggggaggaaacaaaggtccaaaggctttattaaattgtccaagtcacacagtttggaaaaggcagaattgggattacaagttaagagtatcttatacatcattagtactaaaaatgtatattgattagagctgctgaaggctagtggtgaaataactcaatttaagtcagaacaccttgacttagtcttaccatgtaaacaacacctaccagttaatgagaaaagatgactactctaatggagaaataagcaa

SEQ ID NO: 19191 - DNA, 380 bp, Homo sapiens
  misc_feature 269: n=a, g, c or t
aaccgcccaacggctgaggagtgcggcagcgcgccagagactggcgggcagctccgcccgcggccgggatgcactaggcaaagccagctgggctcctgagtccggtgggtacttggagaacttactacgtctagctggaggattgtaaatgcaccmaatcagatgctgtgtctagctcaagattttctccatccccttattttgggccagtggctgtcattacatatgagatgagtctcttgaagactacagatgggctggtgaattanbrgatctccgtcaagtgcagtaaccagttcaagttggaagtgtgtcttttgaatgcagaaaacaaagtcgtggacaaccaggctgggacccagggscagctgaaggtgctg

SEQ ID NO: 19192 - DNA, 449 bp, Homo sapiens
agatgtcaataggggtttgaaaagtttcacatatccttaagaatctagaaggctacatgcatatgttcagctatgggcatgacctcatggctgtgggtatgcttaggaaaggcctgaaaaggcctaagctttcacctctggctaaccttgaggctcaaawkggaaagcaawkggtaaggcagttgtcaactgcykggctgagtgttaaaggcatacctcaacacatacacagagcccatcattaaagtctggaaggcatactagttataggcatttaaagaaatcattgtccaatcattagttgataactaatctaattgagcaaaaattttagtggtcacatacaacaaagaatgcaaattgtacacaatcagttcagaataataacarcacaaacagcaatgacaacaaactcttgggatgacgtagaatctgatttaagagttgac

SEQ ID NO: 19193 - DNA, 214 bp, Homo sapiens
ttacatgagaagatgtccctagcatgtcattgaagaaggaaaaaataggcattggagccagcatgtgcacatagcactgagctgatatatacaacatccttatgtatgaaactgaacatggatgtctgtctacaagtgtttctttgtatttgcaaggatgtttgcaaaaatgtcagccctgggtgctaggatttgggacttctttttccgtgtg

SEQ ID NO: 19194 - DNA, 550 bp, Homo sapiens
aaaatgaatattgcctttacttgttattccttccagcagtctcaacacatttagacaaaatatttgtatttgagacacaatctgccgagagtagacaagaaaggcctttatagttagaactggacttgaatttcaatcttgtaactttcaactaatggaaacttgggaatttgatttatttctctcagccagttttctcatctgtaaataggagaaaaaacataattatatattctatttatttatggatgaataaaaggtgaagtttttagcacaatgcctgtcaaggtaggctcattttaaatatttgttagattccctctccttcagtacatctggtattgatctgaaactttacagttaaaaattaatgtaggtgaagaaaatgtaaagaacctcacttaatgatttcttttatttttgataaatttgtccaaatgctatgcataagtaatctgtcttcgagaaatctaaaataaaatgagaagtttgtttatggaaagtcatgataaaataatgggggaaagtattttgctgggagtcagaagac

SEQ ID NO: 19195 - DNA, 165 bp, Homo sapiens
tgttatgtatcaagctgttaccgaattatatcggtgttagccgttgctgtcatcatctccattatccttgtatttcagacatgtgagctttggaaattaaaatctttgaaaatatgaaaaaaaaaaaaaaaaaaaaaaaaaaaaaaaaaaaaaaaaaaaaaaaaa

SEQ ID NO: 19196 - DNA, 444 bp, Homo sapiens
ccttatcaccttgaccacctttgccttatgtaaatttcatctattctataaagtcacctaaaaatacatttttccttaacataactcactttgctttcagaaatagacttaccttaatctaatggttctaaaccggggggtggttttgattcccagtggttatttggcaacgtctgaagacatttggtggtggtctcatctggttggggggtttacaactggcatctagtaggtggagacccaggttgctgttaaatatcctacaacacacaggccagctccccactggaaagaattatctggtcctgggcctggcacggtggctaacgcctgtatcccggcactttggggggctgaggtaggcagatcacttgaggctgggagttcgagaccagcctggccaacatggtgaaaccccatctctactgaaaaaammrwmamwwm

SEQ ID NO: 19197 - DNA, 130 bp, Homo sapiens
aggcattgaggcagccagcgcaggggttggttggagggaggagagaakwcagaggakcacttawkgtgcaaagcagcctattttttcttcaataaaaattgttaagagaaaaaaaaaaaaaaaaaaaaaw

SEQ ID NO: 19198 - DNA, 406 bp, Homo sapiens
caacatcataaacaaattccttgaaaaataaaaagtaccaaaattcattcaagaagaaatagataccagcctgagcaacatggcaaaatcccatctctacaaarsatcaaaaaaaaarraattggtcgggcatggtggtgcacacctgtaatcccagcttgtcaggaggctgaagtgggaggatcgcctgggcccagggaggtcaaggatgcagtgagccatggtctcaccactgcactctagcctgggtgacggagtgagaccccgtytcaaaaaaaaagaagaagtagataatctgaatagccctatatctatagaaacttaatagtgctgggagatataggtattattatcctcattttacagatgtgaaaattgaggctcagagaagtaaagtytattgyty

SEQ ID NO: 19199 - DNA, 315 bp, Homo sapiens
cacgtccagataatttttgtgttttttgtagagatggggtttcaccaggctggtcttgaactcctgggctcaagccatctgcctgcctcagctcacacctgtaatcccatcactttaggaggccaaagtgggaggattacttgagcccaagagttccaggccagcctaggcaacataatgaaaccctgtctctacaaaaaaacttaaaaaattagccaaaacatttaaaaaaattagccaggtgtggtggcatgagcctgtagtcccagctgcttgggaggctgaggtgggagcattgcttgagtctgagaggty

SEQ ID NO: 19200 - DNA, 552 bp, Homo sapiens
catgaaggtcaaggatgaaattctgctgaaatacagaggaaaaagaaaaggtgaagaaagtatcacctgttatgtgctttagagttatgtactgtaaagataaaccattggaacagaagccaatatcagatacttaaagtgaagacatcagaatagaagaaaggatatttacacgcagattaaaagggtttaatattctttaaaatgtgaattaaaatagttttgatttctttttaaggaaagcatgcttacatttgccttttattgctggatttctcaactcatcctagtaggtactaatggagaaagaaacatgttctaacatatcctcagggtttgcctaaagaggtgattttccatcaaacacttacattcactgaaagaaaacagtttatgatgcatctgaaagaaagcatgcttacatttgccttttatagctgaatctataaacccatgtaatatgaatcaatagaaaaggaaacatgtcttakaaaggtgtttctccctyaaacacttccattaactgaaagaaaagttttcatgatgcttttt

SEQ ID NO: 19201 - DNA, 424 bp, Homo sapiens
atagtgtgaaaagattacaccactgtgatataggggaaagggcacaggcctttcaaatccctgccctgccgtctcttaactctgggaccgtgagtgggctgtgtggcatctatgaactttggtttcctcttctgcataaaagagaataatgatacctactagagaattgttgcggtgatttactgagactgaaatgcgcctaatggaatgcggccacgtgagtcttgctgtgtcgtccaggctggagtgcagtggtatgatcttggctcactgcaacctctgcctccagggttcaagtgattctgctgcctcagtctcctgagtagctgggactacaggtgtgcgccacaacacccagcacgttyacgtycacgttcttcccaggaaggctggagactttyacaggaatgacwgcatctatgak

SEQ ID NO: 19202 - DNA, 161 bp, Homo sapiens
atgaattttatttctaagcctttaagttacctttaaaatgtccacttagaaaactgtgttattatgacagatctagaaatagagcagaaagcatccaatcctagtktttccttccatcagdgaactaggaaattgcaatcctacatgtyggctgtcaattw

SEQ ID NO: 19203 - DNA, 467 bp, Homo sapiens
tgtccagggctcgctggaggattgggaaaaagctgatgtggggaaggcctgttctgtagcaactgaaccaacaaaatacgtacgtgaactcaggaaccacatttcctcggtccatctcctgcagccgtgtgacctcagggaagtgcccatgggcttctcaagaggaaacgtgtgtctgcctcatgtgttatttggattcacacacagctgtgtgcccagcacatagtcagcattctgtaggtgtttgataaataagtaacacggaaagcctcatggattcacctagcctgtctctcacagaccttcccaggtttccttcctgagcactggaacctyaggtwccccaaaaccttaggagaaggcttwaattaawttcatgccacctttcagcacakaktwcatttgttggcaaakccattcaggtggaccttcmacaggagccgycttctcatttttaattcttactt

SEQ ID NO: 19204 - DNA, 420 bp, Homo sapiens
rcaaactcctgggcttaagtgatcctcccaccacagcctcctgaatagctggtactacagatgcataccaccatgcctggcttattattattattattttgagataggctcttgttctgtcacccaggctggaatgcagtagcaccatcacagctcactgcagctcaatctcccaggctcaagcaatccctccacctcagcctccagactagtaattattaaattttttgtmsagacaggatctcgttacattgkccaggttggttccgagctcctggcctcaagccatcctcctgattatcygggattacaggcatgagccacagtcccytgccctgctgrwtcttaawcaggctttcggttagtcctyyctgtkyttagctccatstttatccccacttygaaaggtgcctaatgctm

SEQ ID NO: 19205 - DNA, 468 bp, Homo sapiens
  misc_feature 19: n=a, g, c or t
cactttatccagctagtanattcctactgatcctcctattcattctttgagaatcagttctaatctgaaggtttttctccccacttatcctggtctctgccctgaggcagagaatggcgtgaacccgggagagggagcttgcagtgagccgagatggcaccactgcactccagcctgggcgacagagcgagactccttctcaaaaagaacaaaacaacaaaacaaacaaacaggattttcctaacctctttctgacctgatttaaggtctctctggtaactatcatagcctaaactgctgtattctgggacttaccattagagcttcccaaggcaatctggagaattaaaaaggaaagtaaagtgcttgtagtaactagaagaatctgtatatcaaaattccatttaactattaaaacttaaagtaaaattatggttacatgttcaaaattaaacctgaatacttcag

SEQ ID NO: 19206 - DNA, 236 bp, Homo sapiens
caattcttaaatattttattgtgctaacacaaaagttttattttatttggagtgcataagatacagaaacrrttctttatgatcttacatctctgtttttttaatattgcaaataacataccactttgacataggcagtttctcacttacaaaagtaaaatttgaaatgatcagyggtcaccccatctgtatatttktgccaccactaccaraagagccatgtcattaaaaaaaar

SEQ ID NO: 19207 - DNA, 74 bp, Homo sapiens
atgttagctgtggccactgtggatttttcgcaagaacattaataaactaaaaacttcaaaaaaaaaaaarraag

SEQ ID NO: 19208 - DNA, 184 bp, Homo sapiens
gtgatacattctgcatttagaaatatttgcgctgaaagtgtctgagttacttcttctcatttctcttccaggtgttttattccaaacgtctatgctgctttgttcactgcagctcttgykcctttgacgtgcctcgtggtggtgttcgtggtgywcatccatgcctaccaggtgaagccacagy

SEQ ID NO: 19209 - DNA, 299 bp, Homo sapiens
actctagccccctcccgcgggagtcgcggcgctgcgggtaggacccgggttgcgggagaccccaggttcggttgggattcccagccagaacggagcttaagccgggcaggcgagcgaatgacggagtagcgagctgcacggcggcgtgctgcgctgttgaggacgctgtcccgcgcgctcccaggccgccccgaggcttggggtcttcgaaggataatcggcgcccggggccgaacagcgggggcacacggggcgctgccgaagtgcaaggccacggccagagctcgagcccgacgcgc

SEQ ID NO: 19210 - DNA, 61 bp, Homo sapiens
aacccaactcccccgcccgccccgtgcaggctgtggagactcccttcccgggggagggggm

SEQ ID NO: 19211 - DNA, 423 bp, Homo sapiens
agagactcagactgaatgtgagtgaataaaagagttcatgattatgagaattgtgacttctttgggggacttatttgaggacaaacaaatttcctgattcctcgactcccttcagcctcttcccctctgatgaaggcatggggaaatccgttgaagcaaacattctagcatgccttctcttcaaacttccttcatgtttgtgctcggccaggaacctactgccagcagagggaggtagaagccatcatggagggcgacgaggaggacagaggctgctgctgctgcaaaccaggccacttgcctcacctgctgtcctgcaacgctgcctttcacctycgctggctcacctgggaaatcacgcagacccagtacatyctggagggctacagcatcctggacaacaacgcggccaccatgctgcag

SEQ ID NO: 19212 - DNA, 260 bp, Homo sapiens
aattcactttgctgcttgttcgcttctcccttcctcaggcttcttctgatggttttccgtctcctgcccgagcctttcctttaaaaggaaaactttactgcgatacccttttccccttggaggagaggattaaaagttccaagaactggtgccgcccgtgccatttgggcgctgggaaggtgctcggcggcggggttcccggtcccaccatgtgcactaacatagtyttacgagtggctcawagcgctgcagcttccgcw

SEQ ID NO: 19213 - DNA, 164 bp, Homo sapiens
tcccctcgccgcatccactctccggccggccgcctgcccgccgcctcctccgtgcgcccgccagcctcgcccgcgccgtcaccatgagccaggcctactcgtccagccagcgcgtgtcctcctaccgbcgcaccttcggcggggccccgggctbcccgctcggm

SEQ ID NO: 19214 - DNA, 164 bp, Homo sapiens
ctggacaaatgacttgaatagacagttctccaaagaagatatgcaaatggctcaacattattaatcattagggaacattgttaataattagtggtatctccacagtgagatatcacttcttacccattaggatggctataataaaaaacamaaaaaaaaaaaaa

SEQ ID NO: 19215 - DNA, 146 bp, Homo sapiens
  misc_feature 141: n=a, g, c or t
tttkcaacatggcagccatgcgctggcgaarkcggcagcggctgttaccttggaggytgctgcaggcccgtggctttccacaaaattctgcacccagcctgggcctaggagcgaggacttattcccagggcgactgctcgnattcs

SEQ ID NO: 19216 - DNA, 58 bp, Homo sapiens
cttttgcgttctctttccctctcccaacawgscsgcctcagcaaaaaaaaaaaaaaaa

SEQ ID NO: 19217 - DNA, 103 bp, Homo sapiens; identical to SEQ ID NO: 8028

SEQ ID NO: 19218 - DNA, 352 bp, Homo sapiens
caaacagaattaccagataagccaaaaatactgcttctaggtatacgccctaaagaactaaaaacaggtgttcaaataaaaactcgtatacaaatgtttatagcaacattatttataatagctaaaaagtgggaaaaaaacaattgaccatcaatggatagatggataaatgatattattcaatcataaaaaagaattaagtggccgggcacagtggctcatgcctgtaatcccagctacgtgggaggctgaggcaggagaatcacttgaacctgggaggtggaggttgcagtgaactgagattgcgccactccactccagcctgggcaacagagactcggtgtcaaaaaam

SEQ ID NO: 19219 - DNA, 167 bp, Homo sapiens
ataatatttaccaaagtaggattttgagggtgggggtgctctctctgagggggtgggggtgccgctgtctctgaggggtgggggtgccgctgtctctgaggggtgggggtgccgctctctctgagggggtgggggtgccgctttctctgagggggtgggggtgccgc

SEQ ID NO: 19220 - DNA, 541 bp, Homo sapiens
gtacacagccggtccaaggcggtgcgctgggggccgggccgcgtcgcaggtatcagaaactacaaccagcgatatccagattctgctatttgaacctatccagagtcaggggttctaagaagccacccaaggtgtgaaactggtataccttgccaggctcccgctctgcacacccagagggaaactggtaccggagtgaggattggaagaatcgtgtctgtaaaccgcctgccagccactcccttctccaggctctgtttctgcaccctgcacttaagcccagcttggtatccgactgtcccgtcctactttgggacctttgccgtggtggtcctttaccttgtgagtcccacctgtcccttttgcacttgtccaaacctatcctacaatcaaggcctacctcagaagaatatttttttcgtaacaacctttttgatttcccttgccctttgcccatctctgcctttgctgatgccccataaagtttatgagtgctghgtgtgtcaacagccctyaccataatctgagtactcatgtgatc

SEQ ID NO: 19221 - DNA, 467 bp, Homo sapiens
cataaactttatggaacattgaacatgcgaaccgtgtacttgtgccaactgttagttagttgaaactcttctttctttgaatttacgtaattttctgtctagactggccagtgagtaataatcatgtctgttcttttgtgagtagtgttattaaaactatgtttttcggattttaagataatagatcaaaaatgaatttctgtctaaatttattcaaagaacaaacttcttcgaacatttaaaatggttctggttacaacataatgtctttggcagcaacttggatggaactgggggccattattctaagtggagtaactcaggaacggaaagccaaatactgcatgttctcacatataagtgggagctaaattataggtacacagggacgtacagagtggtataatggacattggagactcagaagggaggaaggtaatggataaaaaactacctatggggtacag

SEQ ID NO: 19222 - DNA, 464 bp, Homo sapiens
  misc_feature 457: n=a, g, c or t
agaactcggcccgtcgagggagctgagagcagctccactggcccgaccccgcgggatgagaagacagcttggctccccgcaggggccgtcggaaaatacccctggggttggtctgcgaccatgacgagcgaccctattggcccaataccgggaagcgaggcggagcttcctcttctccgagccccacctgggctttcagcccgcctcaggactgtgcgcctgcgcgaagtgcactggctgtgagctggacctgggctgtcttgtgtatttggatttggacagccaactacgtgactgcagccgggactggggacgatggaagcggactgggtagtacctgttgagcctaacaaagggtacaaccccagagtactggtgcttgagcaaggaatccccctgctcacctttcatgtgcaagtcctgtttgaaaatcagtacttcacagtgtaataaaatncacctgg

SEQ ID NO: 19223 - DNA, 371 bp, Homo sapiens
atttaagaagtgtagaatatctcaaaacttttttatattgattacacattaaaatgattatattccagatatatgcagttgactcaagcaatgcatggctgagaggcaccaactccctgtgcagttgaaaatccgggtataacttgactccccaaaaacttaactactaatagcctacctatcggttgactgttgactgcagccttaccaataagataaacagtcaattaacacacatttttcatgttgcgtgtattatatactgtattcttacaataaagtaagctagaggaaagaaaatgttattaaaaaaaaaaaaaaaaaaaaaaaaaaaaaaaaaaaaaaaaawtaaaaaaaaaaaaaaaaargyt

SEQ ID NO: 19224 - DNA, 247 bp, Homo sapiens
tacgtggatttggtagacmmaccccggactgggatcatggcagccgwkactcggaacgtggcykgagcakaggcccsaccgsccyagaagcgctactaccggcaacgtgctcactccaaccccatggcggaccacacgctgcgctaagcacaaacacaaagtasgatcccagtgcattaggcagccagtctcgggagaaggggaacttgygccccagaaagggcagttacccggccagggtcacaty

SEQ ID NO: 19225 - DNA, 321 bp, Homo sapiens
taacatactctactaaaattatttaatcttgactttgtatgaaagtaccttcttcttagttggaaatttgcaagtgattttaggttggcctgtgcactagaatttatattgactttgaattagacagacatgggtttgagtcttgacctgccagcgtactgtgttcccttagacaagctctttaacatctctgagcctaagtttcctcatctgtaaagtagttatcattttttccagggttctgttcttgycttaaagatgaaagataatcgattaaacgatactctggttaaagatttattacattcsgctgggcgcggy

SEQ ID NO: 19226 - DNA, 221 bp, Homo sapiens
atgttttggataaaaataacattccaatcactattgtatatatgtgcatgtattttttaaattaaagatgyctagwtgctytttataagaccaagaaggagaaaatccgacaacctggaargatkkkygtttwcactgcttgyatgatrwwtcccattcatacacctataaatctctaacaagaggccctttgaactgccttgygttctgtgagaaacaam

SEQ ID NO: 19227 - DNA, 177 bp, Homo sapiens
caacaacaaacaaacgaagctatctgagtgaactgctaatacagaaacttaatgtagacctgtttggggtctactattgttttagaatgaaggaattgtcattattgtgcgtatatataattwgtaaataaamagtawggakatgatacggtkttaaaaaaaatcatggtaaggctw

SEQ ID NO: 19228 - DNA, 469 bp, Homo sapiens
tgacagagttttgaaagctctaagtgtctatttttataggtaggtaaaatgacattctgagaaaataggttattgacttcataaacataaagctagtaaaaggcaaaaacaggattcaatttccaaatttgtatacccaagctcttataactcagtatctccagtactccaccacactcttagtacccattgatactccactattaaaaagagatattgctggtcacagtggctcacaactgtgattccagcactttgggaggcagaggccggtggatcacctaaagtcagmmgttcaagaccagcctagcaaacatggtgaaaccctgtgtctactacaaatataaaaaattagctgagtgtggtggcatgcgccagtaatcccagctgcttgggaggctgaggcctgagaatcgcttgaacctgggargtggagcttgtggtgagcccagatcacgccattgcacty

SEQ ID NO: 19229 - DNA, 477 bp, Homo sapiens
caaatggtttgctaacccttgctcagccccacaacccactaggagctttaaaatacttaatataggatttggatttttttttttataaagctactcagataagtgtgaactcacgttcccatgtaaaatggaaattcagaattgcattgtctttggagaccatagtagtgggagagggaaaagtacctttagttccacccttggccagcaggtggtgagttttggactcagaccctgttgacaggtttgagctaaataaagctttggaacagaacagtgacactagtgagaggaatcaaggaagcagcatgtaccttctgactggctgattctcaaccaaatatacagagtagagggaatatgatagagtggaaagagcactggattgagaatttgagcttgacctcagagaacctcatgttaaagccttactatcaggaaacaraagctatcaacaaggcacacagtgttaatggg

SEQ ID NO: 19230 - DNA, 444 bp, Homo sapiens
atagaaaaactttatatggtgctttttgccagctgtgtccctggtcattgagcacaacatgtaacagtttgcccatggactattttgggaaaaacagtcgtttcatcaagggtatggcttgggtttgaaattttgtttggatcacttgccaataaactggcttccaaaaatcaaatatgaaaaatgttaagagaattggaaactaaggcagggagctctgcttgccaaattttaactattactaacctgttagaaaatatgatcgcaggccaggcgtagtggctcacgcctgtaaccccagctactcgggaggctgagacaggagaatcgcttgaacccakkaggcakwggttgcagtgagccgggattgcaccactgtactccagcctgggggacagagcaagactccatctcaaaaaaatgaawawaaaaaaaaaaaaagct

SEQ ID NO: 19231 - DNA, 419 bp, Homo sapiens
gagcaggccaagaccttaggacattgggatttttgtgggaggagagtaataggtaattagacactgattgtgtggtagaaatactgcaggggaaaaggtcgccctcttatgcatcaaagagcaatacctgttgtttagcaaagagtgatgaaaaattgatcttgttttgaaattgaagagagaggccaggcgcggtggctcacacctgtaatcccagcactttgggaggctgaggcaggtggatcacctgaggtcgggagttcgagaccagcctgaccaacatggagaaaccccaattgtactaaaaatacaaaattagccgggcgtggtggcaggtgcctgtaatcccagctacttgggaggctgaggcasgagagtgcttgaacccargaggcsgavgttgtggtgagccaagatcm

SEQ ID NO: 19232 - DNA, 338 bp, Homo sapiens
attccctcagtttttatctgagaatgtctagaatgtcttaatctttccgttttttgttttttttgttttgttttgtttttttttttttgagagggagtcttgctctgtagcccaggctggagtgtgtagtgcaatctcagctcgctgcaacctctgcctccctggttcaagcgattcttttgcctcggcctcccaagtagctgggattacaggcatgcaccacaatgcccggctggtttttgtatttttagtggagtcggggtttcgccgtgttggcaggcagatcacaggatcaggagatcgagaccmtcctggctaacacggtgaaaccccatctm

SEQ ID NO: 19233 - DNA, 334 bp, Homo sapiens
taagttcttcctttgggtctggttgttmwhtgtacattttaaaaatatatagcccaccatggtggttcatgcctgtaatcccagcactttgggaggctgaggagggaggatgcttgagctcaggggtttgagaccatcctgggtaacatggtgagaccctgtctctacaaaaaataaaaaaattmscttggcatgtacsatgtgtgctystacttycagctacttgggaggccagaggtgggaggatcacttgaacccaggaggtggaggttgcagtgagctgagattgygccamtgcactccavcctgggcaacagtgcaaagaccctgcctm

SEQ ID NO: 19234 - DNA, 196 bp, Homo sapiens
gccgccgccgccgccaccgcctcccgcttcccggtgtcgcgcggctgccgcccttcgcggtgcaacagccacaaaacccgccgcctcgggccggggccgcactcgggaacggggcgtcgccgmtacagccgctgccttgggagccggygagcggtccgcgcggyyccgggcaccacgggggcgggagcctgaggar

SEQ ID NO: 19235 - DNA, 505 bp, Homo sapiens
tgacactgaaagtaactagtaaataaagggtgaacttcttaattattcgaaaactgcttttaatattaggatatactcttttagctcatcttcgctggtcttgaggcttattataattgtcaaatcaacaaagtttctaatagagaagtagaagaaatatcttttgagatgtaagtagcttggtctgtcttctaaagtaatacatacctgttaaacttgaggtatttttttcatactgaaggcattctaaagtttggtactgtcacaaaacagtagtttacagagcagaagcacttagtattagaataagcctgtaggtgtgaaggaataagtgttgcaaaatagttatttatccaagctgtcaattaattgattgaagtagttatcaaaatgtttctgkttctttctttggtatctattaactggtcagtcaaaagctattaaagaatgtttttaaagtcacctaatgctgccagtttgttaaatttggtatacattttaagaa

SEQ ID NO: 19236 - DNA, 513 bp, Homo sapiens
ttctgttggtctctgccttccagggaacaggaattttaggattcaggtattagttatctctaaaaattatcttgagtagttaaaagtctttgaatgctcaaaattaactattctagactccttctgggaagtatgatggcaattgccctatgctatggctcagtagttacggyttttgccgtatcacaggggcagactgggttcsattcccggcacaggaagtwagacttttttggtcttaatatctggataaccttwctctatkskcttctcctcagcagactatcttaaatttttcgttctctgcacctgggaggttaccttcagtaaatttgcaaaagccasaaatattggccatttggcctggctaaagtcaggtaataagaaattttaaaaggactttattaaagagtgctatggttaaaaatcagcttaattaaaaagtggatattcmmgctctaacagcctgtactcccttgggaaaamcaagaggcaccagagaactttccctgc

SEQ ID NO: 19237 - DNA, 308 bp, Homo sapiens
gagcgaggaggcgcggcctcccgaggaggggcccggtggcggcagggccaggctggtccgagctgaggactctgcaagtgtctggagcggctgctcgcccaggaaggcctaggctaggacgttggcctcagggcaggaaggacagactggccgggcaggcgtgactcagcagcctgcgctcggcaggaaggagcggcgccctggacttggtacagttgcaggagcgtgaaggacttagccgactgcgctgctttttcaaaacggatccgggcaatgcttcgttttctaaaggatgctgctgttgaagc

SEQ ID NO: 19238 - DNA, 467 bp, Homo sapiens
ctcgattaggcgtatgggttttgaaaaagagatttttcagaagattgtcagcttcagtattcacgttccatcgwrtcatctgggtctgttagtgtagtgaccctcagtgcagtctgtcccagcgtttatgtccttgcttcctctgagcagaggcctccatcttagtatcaacatatttaaagaaattgatggtgttcatcaagctggggcctgtggcagttgttgcctgagcaccaagtaacccaagccacctatgtgacaacttctgggcccaggagtaatttctcagcattgagggtaaaataggatggagtgctctgttgatcatttgggagatgtaggttacctgatttgtgccttadgatgcakygtgaagcagaagtccatattgcaattatgattttagaaggaactaagcattttactcacacccacmgcagcmagaatgacttyctgcagcagatatt

SEQ ID NO: 19239 - DNA, 401 bp, Homo sapiens
ttttgtttctttttctttctttctttcttttttttttttttttttaaattccaggcacatgatgctcgaggggggcctactataatagcaaacatcgattggggaggggaagaccaaaaaaattgttcatgaactcatgaacaattgagtgtggaaatgaactgcagtattttcacacaatagaatacttcctggcagtgaaaatgatctacagatagacaaagcgacatgacgctcagaaacttaatatgcaagaaaaagcaagtcacagggtaatatgtatgtatgattcaacttgtataaagttcaaaaatctgacacactaaacaatctgttgttgagaagggaaatatatcataatthhwktttcctttgagacagagtctctgttgccaggctgg

SEQ ID NO: 19240 - DNA, 476 bp, Homo sapiens
gggtgggaggtcccggagtaacttctctccaggctgaagggcggcgaggcatagtcccgagaagtcaccaaggccatctggagactcctggctttctgaactttgcgcgttaagccgggacagctgctttgctgcccggagagtagtccgcgccaggaagagagcaacgaggaaaggagagggactctggcgtcccggcaggcgagaggcgaggctgagcgaaagaaggaaggacagacggacctgtctgtcagagttcggagaacactggctctcagccctgagacacaggcctcagttaggacgctcggcgcccaaatctcatcagttttattgcctgctcgattatatagaaaaatacaaaaaatctgcattaaaaatattaatcctgcatgctggacatgtatggtaataatttctattttgkaccattttcttgkttaactttagcatgktgktgatcatggatcatactc

SEQ ID NO: 19241 - DNA, 369 bp, Homo sapiens
tttattcactgatatattccaaaaaatgtgttattttaacaaggaattagttttttaattctttcactgaaaaaggaaaaagcmgtaaatgattkygttaaatgtcattggcaacttaatcagaaactaatccaaacaactttaggccttctagattaaagcatttgtcccttactagttacatttacctattaaaattgacttamsaattytggttatgagcacgcaggagtctcacataaactgacagcacaacttggagacaatgtayyaatatyttaaatctcatgttttacaaacttttagagcmsaagtctgtgttaaatcactttagagatgacttgcacaattctgcttgygtgtgtgtgy

SEQ ID NO: 19242 - DNA, 85 bp, Homo sapiens
aaggtctggagcgaattccagcctgcwkggctgatragcgaggcattagtgagattgagagagactttaccccgccgtggtggtt

SEQ ID NO: 19243 - DNA, 63 bp, Homo sapiens
ctctccgccagaccgccgccgcgccgccatcatggacaccagccgtgtgcagcctatcaagct

SEQ ID NO: 19244 - DNA, 453 bp, Homo sapiens
gacttggaatctaaaacaaaagcaaaaagataaggaaaatattaatgaaaaattgaaatggaggctagccttgatccagaaggtccaccttctcaccttcaggacacatggcttaatgagcagatgatgctctttgactgggatacaggacttgatgggtgggacacaggctgaatttcagctttcactcttcagtgggatcttctagtgcatggtgcaacctgcataattatatatagcagccctgcaccttctacataataataggcctagaaagagattagaaacaaaatagaaacgaaaggaaaaaatagaggaaaatttatctgagctaaagaaaggctcagttgaagtcattagtttgaacagccttgctgattgtcaagagagtaagtgcaaaagtatccataattagtctgcattcagatgcaggaacctggtgctagagaagct

SEQ ID NO: 19245 - DNA, 136 bp, Homo sapiens
gggttatctttgtctcgctgcctcgcgctcactcgctcaactcggcgccgccgcggccccacgctccgggcccgtcctcgaggcgcgcggcgcggggcgcgggcgccggggcctgasgcggcgggcgacgcccggg

SEQ ID NO: 19246 - DNA, 459 bp, Homo sapiens
actaccatgcgccgtgcggcccgtgcgactcgccggacctcgcgggcgtccctgtacggagccctcggccggtcctagcagggattgtccccatttccagctccggagcgggcggctgcgccccgctcgtcgaggagctgcgctcacctcaggggcgggcccccgcctgcgttcgcggcgccagcagaagactgatttttggaaatatgtatttgggagacagtcacgtcctattgaataccttgtgctggtgctgccatcgaaaaatctggttacactctggggaggactgctaccactgcagaacctgaaccacttcggccgtgagatgagtgtccggcctgagcaggcacaccatgaatagatacacaacaatcaggcagmtcggggatggaacctacggttccgtyctgctggggaasaagcattgastctggggagctgatcgctattaaaaaw

SEQ ID NO: 19247 - DNA, 522 bp, Homo sapiens
ttttgttgaatttgctcactgctttcttcctggagctcaagacagtgcctagatcaacacaggcactcaataaatatttgtagaaagaatgtataagtatccatggccaggcgcggtggctcacacctgtaatcttagcacttttggaggccaacgtgggcagatcatttgagcccaggagtatgagaacggcctgggcaacatagggagaccttctctctaaaataaattaaaaaaaaaataggcccggcacggtgggtcatgcctgtaatcctagcactttgggaggccgaggtgagtggatcgcttggggtcagacgttcgagaccagcctggccaacaaaatgaaaccccgtctatactaaatatacagaaaaattggccgggcatggtggcgcacgcctgtagtcccggctggttggggaggctgagacgggagagtcgcttggactggggaggcsgargttgcagtgagctgagatcatcccattgcactycagcctgggtgacagagcgagactt

SEQ ID NO: 19248 - DNA, 492 bp, Homo sapiens
  misc_feature 366,383,390,393: n=a, g, c or t
agcctgcaggacaacgagctggcggcactcgcgccggggctgctgggccgcctgcccgctctagacgcgctgcacctgcgcggcaacccttggggctgcgggtgcgcgctgcgcccgctctgcgcctggctgcgccggcacccgctgcccgcgtcagaggccgagacggtgctctgcgtgtggccgggacgcctgacgctcagccccctgactgccttttccgacgccgcctttagccattgcgcgcagccgctcgccctgcgggacctggccgtggtttacacgctcgggccggcctccttcctcgtcagcctggcttcctgcctggcgctgggctctgggctcaccgcctgccgtgcgcgccgncgycgrctccgcaccgncgscctncgnccgmcsagaccgvcagacccgaaccccgatcccgacccccacggctgtgcctcgsccgcggacccggggagccccgscgctgccgcccaagcctgagcg

SEQ ID NO: 19249 - DNA, 490 bp, Homo sapiens
ctctacaaaaaatacaaaaattagccgggtgtggtggcacatagctgtagtcccagctacttgggaggctgaagtgggaggattacttgaacacaagaggtagaggctgcagtgatcgcgccactgcactccagtttgggcaacagagtgagaacttgtctaaaaaaaaaaaaaaagaaagaaacacagaaaaggtacagtgaaaatacaatataatcttatggaaccattgtcctatatgtggyccatcattgactataacattgytgtgtagcacatgactgtaattycttttacttattktctttgwtgwgtgtcctcactaacaagaacctaacttcatgagggcacagatattttctgtttgaatcatcatactttatttccagtgtctggaatactgcctagccacatagtmaattcttaaaaaatatttgtagaatgaatcacgtatataaagcttttaacagcacagtatgtgattcattgc

SEQ ID NO: 19250 - DNA, 477 bp, Homo sapiens
tgtctatcagtaaactagatcattaacactgcgcctgcccctcctgctcacgggcacgttaggaacatgcgcttggataaaatccaagccagagatttagaaaccagtgcgtggtgccagctctcagccttggaaccacaagcccatttttcttaaaaagggatctggactggcatccaaagagatttcagtcccctcatgtaggtttaaccaccatgggcaaggcagtctctctcccaggtattcctctcactaggtgctctgctctagaaatgaagtctaaaagcagccccatcaatacagaacagagttagaaccacccggagagatttaatctggaatcccagcaagttgtgaaatggaaagactagtcggccagagagctgaggtctcacagtgtgcaaagaccagtcctcagtatctgcacccatccatttgagtttcargtgaagcctargatttgggagctcaatacaa

SEQ ID NO: 19251 - DNA, 366 bp, Homo sapiens
ggccccgccttggtggcggcgccccctcgcggtccagaggcagacgcatcgggwrggctcgggtctccagcccggccgggaggagggaccgggtctgcggagcggggactcggggcctcggcggggcgcgcacacgcaggcggrrcggcccggrrwrcggggcctctgcgcggctgaccaggctcccagagcgtcagcgccgcccatggccgagccgstccagccagaccccggggcggccgaggacgcggcggcccaagctgtggagacgccgggctggaaggccccggaggacgccggccccccagcccggaagttatgagatccgacactatggaccagccaaagygggtcagcacgtycgtg

SEQ ID NO: 19252 - DNA, 519 bp, Homo sapiens
cattatagatagaagtgtaattaacattcctgtacatgtattttgctacttgtgtgggtatttctgtaggatgaataactagaaatttattggatcaggtttcacatttgcagttttgaaaactactaccaaaaagatttcaccaatttacaactccatcattagtaagaatgcctgtttgcctatagtctgccaaccctgaatccttaaaaatttttgccaatctggtaggcaaaatttctttcttttctttgaatattaatgaggaggaacatcttttcatgtttcttggccatttgtatttcctattatgaattgcttttgcccattttcctttttttaattatgaaagtctaatgactaccttctcattgkataaaaaacacagttctttgaatagagagacccttttctccaatgctaccaatcacattccacttaccacagtttaacatacatcctctagtcacctttycgtacgaatatacatacacataaaaacactttttacataaatag

SEQ ID NO: 19253 - DNA, 480 bp, Homo sapiens
tcttacaaggtctgtttggtttaatcccatctcagagcctaggtaatttcacagcctttgcaatgtcagaatgttgagtggagaagggtaggggaaagagaaaagaagatactcattcctgatgttaccactcgcttagccatacaaccttcaacagatgactttctaacctttggggtgtctttgatctgtaaaatggagagattgaactaggaaatctctaaggtcctttatagctctactttttctacattatatggttttacctccctagtgcctaacccaggcaaggtgttatagaaggccctcaataaaatataacatactcggtcaatcggggcaagatggccaaataggaacagctccagtctgcagctcccagtgagaccaacgcagaaggcaggtgatttttgcatttccaactgaggtaccctcttcatctcattgggactggttagacagtgggtggagcccacagag

SEQ ID NO: 19254 - DNA, 78 bp, Homo sapiens; identical to SEQ ID NO: 7868

SEQ ID NO: 19255 - DNA, 419 bp, Homo sapiens
attgtgactttgggccaggctgggggaaatgacccgggagggtcccatgcggctacataaaattggcagccttagaactagtgggaaggcgggtgcgcgaagtcgaggggcggagagagggggccggaggagctgctttctgaatccaagttcgtgggctctctcagaagtcctcaggacggagcagaggtggccggcgggcccggctgactgcgcctctgctttctttccataaccttttctttcggactcgaatcacggctgctgcgaagggtctagttccggacactagggtgcccgaacgcgctgatgccccgagtgctcgcagggcttcccgctaaccatgctgccgccgccgcggcccgcagctgccttggcgctgcctgtgctcctgctactgctggtggtgctgacgccgb

SEQ ID NO: 19256 - DNA, 375 bp, Homo sapiens
ttgtttgtttgtttgcttgttttttgagacmsagtctcgctctgtcacccaggctggagtgcagtggcgccatctgggctcactgcaagctccgcctcccgagttcacgccattctcctgcctcagcctctcgaggagctgggactacaggcaccggccaccatgcccagctaatttttttgaattttttttttgtattttttttttttttagtagagacggggtttcacagtgttagccaggatggtcttgatctcctgacctcatgatccacccgcctcggmctcccaaagtgctgggattacaggcatgggccamcgtgcccggcctmatttttgkatttttaatagagacggggtttycaccatgttggty

SEQ ID NO: 19257 - DNA, 177 bp, Homo sapiens; identical to SEQ ID NO: 7812

SEQ ID NO: 19258 - DNA, 287 bp, Homo sapiens
tggagtgtttttttttttttttttttttgagacgggatctcactctgtcacctaggttggagtgcagtggtgcaatcttggttccccgtaacctccaccaccgggctaagggatcctcccgccccagcctytcaagtagctgggaccataggtgcacgcctctacgtccggctaattttttttgtatttttggtagagaccggatttcaccgtgttgcccagtctgttctcgaactcctgagctcaggcggttcacctgctttggcctcccaaagtgctgggattty

SEQ ID NO: 19259 - DNA, 266 bp, Homo sapiens
ctctgcgtgcgccggarrctgccgwrgcgggwrggccgccwracttctcctcccggccagttctcgagcgcctcaccgggcctcgccctgcagcctcgctctcgctggcgctgcgcggcctaggggactgggctgctggcctccgggtgcggggtgggggcaggctccgacctggggcgtcctggccgcgcgagccgcgggatgggggcccgggccgcggaggaggcrccgctggygtgtcccttggtggagagggcgctgccggy

SEQ ID NO: 19260 - DNA, 58 bp, Homo sapiens
aaatttccgctttctttctgcagcaggaaccgtgrmtgctggacaagaggggtgcggy

SEQ ID NO: 19261 - DNA, 204 bp, Homo sapiens
gagccgtcagtccggcggccgcggggcmmgrmgggcgcgamrctgccwmcksaccggcgcaggctaggwkggggcggyytgagtgccgtagccgagccgkkgctggagcgctgykgtctgacctacgagaaacagggcaaccagcgccgtccccagtgacaacctccccacatacaagctggtggtggtgggggatggggrhvy

SEQ ID NO: 19262 - DNA, 329 bp, Homo sapiens
agagtccggctgcctggggcgggcggcgcgtgtctgcagctgctccgggtagcccgctaggcgcgccgtccccagccccgccgccggccctcggtgcgcccggmcgcctgcacccmcaggagcagctgctgtgaataaacacagaagtggagctgggggactgattagaagccwmattcastgcacctgggccccagcaggcccagccaggcgtggaggaagaggcattgmggactttscttacctgtwyttccagctyacccactgycagcagagaatgctgtccagtttcaacgagtggytttggcaggacaggttctggttaccas

SEQ ID NO: 19263 - DNA, 72 bp, Homo sapiens
gagattgctccactgtactccagcctaggcaaaggagctagactctgtctcaaaaaaaaaaaaaaaaaagct

SEQ ID NO: 19264 - DNA, 348 bp, Homo sapiens
gttttaaaaattattacacgagatacagcctttatttcttggcctagagcagtaattatcattttgggatttaaatatgattctactgttgttgatggctcttttacaaaagttctttccattaacaaggtccaatactatatttaaaaaaatgtccaagaggccctttgagctatatcacctgcttgtctttagcagaatcctgaactggataactttaaaaagtttgtcagcctaagaaaatggaagagtgggtaactgtgtggctaactgatgctgtgaccgttaccacgcatgggactgggcactttatgaacggttttacatttggaatcacaaactgaagag

SEQ ID NO: 19265 - DNA, 439 bp, Homo sapiens
  misc_feature 382: n=a, g, c or t
tcatttgctaatataaattcagttyyattttaccattttagagactactaatgattaaatgtasaaggagagggtgcacatgtttttatgtggagtgtttaaaagataaatttataccactgtaatgtgcatcttttattaaaagagaaattggttgaactgctaggttgaatgagagacttcatctattggactattttttttaatccaggcatatggtctttagtaatggcttgtaatttgtgaaaacattaatttgggggttttccctgttttcagttgtccatgtacacatagtcattatattagaaaagaaatctgttcaacaaacttgbttaatttgkttaaatcaacatagcatgaaacaccamataaaatgttngacatagktttacttttagcttkctcatatgktataacttcactcagattgattctt

SEQ ID NO: 19266 - DNA, 330 bp, Homo sapiens
ctttgcctgctgcaggtcctgtcaacctgcccacaggcatctctcgcgtccccactggctaccctagcgacctcaagccagtcacctggaaccagcaccagctggcccacctacagcagatgtgcarcgaggctartgggacgccagcccctggcctgacaggcaagcatgcggcaggacgcgagttggcagggcctggctttgtgggcaaggcccctgsctacccgcaggaactctgcctggcgcartccttccatytgaagccacccctggaaaagccgaccccatycccaccagkcaacggsatggcagccccattggsctacccca

SEQ ID NO: 19267 - DNA, 319 bp, Homo sapiens
catcagaaggtaaattggaaagaggccgggcatggtggctcacacctgtaatcccagctctttgggaggccaagacgggtggatcacttgaggtcaggagtttgagaccagcctggccaacatggtgaaacacccgtctctactaaaaatacaaaaattagcggggtgtggtggcacgtgcctgtaatctcagctgctccggaggctgakgcaggagaatggcttgaacctgggaggcggagattgcaagatcgcaccactgsaccccarcctgggcaacaaagtgagactccgtcgcaaaaaaaaaaaaaaaaaagct

SEQ ID NO: 19268 - DNA, 313 bp, Homo sapiens
atgcggatgcgctcggttagaacgcagttcttggtgccacgactgggagacagtcctcaggccctcccctcagggagctcactgtccggggagggacagccagcaatagttcctggccggccaggagaggcagaggcagaggaagggaagggtcagctgccttgaggtccctgcctgctaacctgacggtatgctttcaccatgccggtgaccccagccccaggaccacgagcaactcgcctggctcccttctctccgtctgcctcctggccgcggggcccggaragctgggagccagarggtgtaaatgaag

SEQ ID NO: 19269 - DNA, 160 bp, Homo sapiens
tctagaaattcatgtaaatggaaatcatatttatgtctggcatcttttwttttttcctattttaatactttyatgttcaggggtacatgtgcaratttgwtacataggtaaatgtgtgwcatgggggtttgyggtatagattagtacccattagttattw

SEQ ID NO: 19270 - DNA, 90 bp, Homo sapiens
ccggagggcggagcttccagtgagccgagatctgcgctccaacctggggacagagcgagactccctctsaaaaaaaaaaawamaaaagct

SEQ ID NO: 19271 - DNA, 110 bp, Homo sapiens
gttggacatgggttgtaaaaataaaaccaggaacacacaaacagacacacacacaaacacacccccacctcctgcaattaaacagtagcatcgccaaaaaaaaaaaaaam

SEQ ID NO: 19272 - DNA, 132 bp, Homo sapiens
cagcccaacactggagcgtctcctgctcgcgcacgccakaagcagctcggggtctctccgccgccccttggccatggccgytgtgcckacrgcgcccgytcccctgcgctccaggggcccccgccgctgcad

SEQ ID NO: 19273 - DNA, 101 bp, Homo sapiens
agcctgggggacaggccggcgcggctgggagckgrtgggcggmcggkaggccggagcabcacggccghaggacctggarctycggctgcgtcttcccgcav

SEQ ID NO: 19274 - DNA, 265 bp, Homo sapiens
gaaagctatcttcctgcaccggcggccgggtgagggcggtgggagggagcggtgcctgcgctgtggccatgtctgtgtacgcagggggccggggccccgcgaagctgtgccctcaggccggccccggccggacacccttacccctccatgggtccggcagagggcagtgaccggcaccttctgtgcgtcctggactcctctgagaaacaggagagctcaaaggatggctactgacatgcagaggaagagaagcagcgaatgcctt

SEQ ID NO: 19275 - DNA, 325 bp, Homo sapiens
agtggatagcttaagcccaggagttcaagaccagcctgggcaacatggcaaaatcctatctctacaaaaaaaaaaaattagccaggcgtggtcgtgcatgcctgtagtcccagctacttgggaggctgaggcaggagaatcgcttgaaccctggaggtggaggttgcagtgagccgagatcactccattgcactccagcctaggcaacaagagcaaaactctgtctcaaaaataaaaaataaaagaaaaaacagaagaaaataccaagtgtggcaaggatgttgagaaaatggggcccttgtgcactgttggtgagcatgtagaa

SEQ ID NO: 19276 - DNA, 171 bp, Homo sapiens
agagcgcagcgcgcacgcccagcgagttccagaggcgccagtggaagctgcggcggcggtgtctcgcgttcggcgggatttctcttcgctccggctcggcctaggtctacgtccccagctccagccgccggmtcggactcggtctctgacccccaactbggtcccctagty

SEQ ID NO: 19277 - DNA, 90 bp, Homo sapiens; identical to SEQ ID NO: 7855

SEQ ID NO: 19278 - DNA, 182 bp, Homo sapiens
ggagtgcaaaaaattggctgggtgtggtggcgggcgtgtgtcgtcccagctgcttgtgaggctgaagcgggaaaatggcatgaacctgggaggtggagcatgcagccagccaagatcgggccgctgcactccagcctgggggacagagcgagactctgcctcaaaaaaaaaaaaaaaaagct

SEQ ID NO: 19279 - DNA, 59 bp, Homo sapiens
aagctccagcggcggccacggcggcagttccagcggyggctacggyggtggcagttcck

SEQ ID NO: 19280 - DNA, 353 bp, Homo sapiens
caagtggtggggattacaaaggtgcatagttgattaagggtaacttagagctcaagatagagtgtgtctgccacagaaatgaccatcaacgtcgctgttcctgtttcattgcatcatatttgagccatagtataaggtaggagtgacagcagtagcagcagaactgggacatccacatgaaggatgtgaatcaaaccaatacattttttctgcaggatcctgcatcacagcaggtgaagggtatccacttcatgtggagacagatgagccaaaggtagatgtaaatctcacttaaaagggccacctggctctgaggaaactatagacacagtccgtagtgatgaatatcagaa

SEQ ID NO: 19281 - DNA, 107 bp, Homo sapiens
tagcaaaagaaagaatgagggaattaaaatgatacactagaaaatatttaacacaggagaaggcaacaatgtagacatagagaaatttaaaaagacctaagacatac

SEQ ID NO: 19282 - DNA, 377 bp, Homo sapiens
attctagaaacagtctctccccagctcacttggctgaagatactaaagagaactagatgttatctagtgttatcctgctgatcccaatttcctatagttctggcaccagaaaatcctgaatgataggtttttctgaagctgctgacatcgggtcagccctcaacaccatcacctttggccatgttcaggaagtactcaaagatcatggctcaaaagtctgcagagcagagacaagagattgacaaagaggtgttgatgagggcaataaaagcaaaggtggctttatcacggtgagctacttctcacaggagtcgggatccacatctgcagactacacaaaaacaaacaacacagattaaaagcacaatcaccattga

SEQ ID NO: 19283 - DNA, 270 bp, Homo sapiens
tgttttatttttgtagagatggggtcttcctatgttgcccaggctaatctcaaactcctgggctcaagtgatcctctcacctcagcttcccaaagggattaaaggcatgggccatgatgctcagccacagttttcttttcttttcttttctttttgtttttttttgagaaggagtctcactctgtcgctcaggwkggragtgcastggcgcaatcttgtctcactgcaacctycgcctcctggattcgggcgattctyccgcctcagctt

SEQ ID NO: 19284 - DNA, 348 bp, Homo sapiens
actttccctctgagtccttggacaccttacctaacctcttggaagctcctgtctgtgaagggtgtgcacagagagcttcggtagcctgcgaagcagccattttcacttccacggagcagatgctggcctgggtgctggaatatggaaatgaggaagatcctgcctgaggatttcatgacagtgctgcgattaccgacgtgagccactgtgcccagcctcactttaaaaaaaaaaaaaggttatgaagcatytcaacacaagacctcctttgctcatcacaaccacccagtgaagcaggcaagacaacagaaactycccacctgtgatagatgtgaggcctgaagtcts

SEQ ID NO: 19285 - DNA, 338 bp, Homo sapiens
  misc_feature 288: n=a, g, c or t
agctcccttcccggcggcctttgcgggaacaagatggcagcccccatacctcaagggttctcttgtttatcgaggtttttgggctggtggtttcggcagccagttctggtgactcagtccgcagctatagttccagtaagaactaaaaaacgtttcacacctcctatttatcaacctaaatttaaaacagaaaaggagtttatgcaacatgcccggaaagcaggattggttattcctccagaaaaatcggaccgttccatacatctggcctgtacagctggtatattngatgcctatgttcctcctgagggtgatgcacgcatatcatctctttcaaa

SEQ ID NO: 19286 - DNA, 63 bp, Homo sapiens; identical to SEQ ID NO: 7774

SEQ ID NO: 19287 - DNA, 80 bp, Homo sapiens; identical to SEQ ID NO: 7777

SEQ ID NO: 19288 - DNA, 101 bp, Homo sapiens; identical to SEQ ID NO: 7753

SEQ ID NO: 19289 - DNA, 108 bp, Homo sapiens; identical to SEQ ID NO: 7744

SEQ ID NO: 19290 - DNA, 101 bp, Homo sapiens; identical to SEQ ID NO: 7753

SEQ ID NO: 19291 - DNA, 108 bp, Homo sapiens; identical to SEQ ID NO: 7744

SEQ ID NO: 19292 - DNA, 496 bp, Homo sapiens
ttgttcttattaaacaaatacgtaaacaaatactggaaaagcaaaggttatatttgggagtaaaatgtatcttaaaatgcatgttcatcttttgctgagggaggaatagcttcttgtatgtccactggatagtaacagtggttcttttttggaattttatttttacctcttttgaacttctaaatcggtccctttattttcttaaaacatttgctctcttttttgtttacagattaaagaagtatggatcaattttagtcagttgataatttcatttakgaaacattgtcttgctcattatagagagttaagactgtgcataaaatactgaagtgcctcttttttattaggctcatatgtttgttcttgcaaagcgagwtgcctattgtgattggtgttagatctgtaagaagctgtgttttttccacaagaataatcgacgaccagtttgagagcatctctcgcgttctttttctgtctgcttactgtccttgac

SEQ ID NO: 19293 - DNA, 108 bp, Homo sapiens; identical to SEQ ID NO: 7744

SEQ ID NO: 19294 - DNA, 63 bp, Homo sapiens; identical to SEQ ID NO: 7774

SEQ ID NO: 19295 - DNA, 108 bp, Homo sapiens; identical to SEQ ID NO: 7744

SEQ ID NO: 19296 - DNA, 108 bp, Homo sapiens; identical to SEQ ID NO: 7744

SEQ ID NO: 19297 - DNA, 80 bp, Homo sapiens; identical to SEQ ID NO: 7780

SEQ ID NO: 19298 - DNA, 108 bp, Homo sapiens; identical to SEQ ID NO: 7744

SEQ ID NO: 19299 - DNA, 108 bp, Homo sapiens; identical to SEQ ID NO: 7744

SEQ ID NO: 19300 - DNA, 108 bp, Homo sapiens; identical to SEQ ID NO: 7744

SEQ ID NO: 19301 - DNA, 80 bp, Homo sapiens
tttttcgcaacgggtttgccgccagaacacasgtgtcgtgaaaactacccctaaaagccaaaaaaaaaaaaaaaaaagct

SEQ ID NO: 19302 - DNA, 101 bp, Homo sapiens
acagttaactttaggaccmymgccaaaagatagaaacagcataaacgtcaaaataaaaagaagccaataaagataaacacaaaaaaaamaaaaaaaaagct

SEQ ID NO: 19303 - DNA, 489 bp, Homo sapiens
  misc_feature 440: n=a, g, c or t
atttaattcagcaggactttgttgaccatacattatgagggaaatatttaatactatttggagactgatatattttcctcttatctagagtaaaataaattataagaagtgatgaaaacaaccatttaattagacttaagtaagtttgaaaagcaactctgtgaatttaagtgtttttaataatttcataggtgtctcattctataaactcaatggctattgagttaatcttcaagttattttcctacgggcccttttaagagaaggttggaaagaatgaaccatgtttaccagagatgtttcccaagatggacaacagactgaccatgttgattcagaactaagtactaataaaaaggagtttaataagaagtctaatagaaatcaaattgtatttatcaactttaattctattttaatgcacgagtcctaacagccanacgactaatatgctgacatttcttaattcattttttctgactgtgctcc

SEQ ID NO: 19304 - DNA, 108 bp, Homo sapiens; identical to SEQ ID NO: 7744

SEQ ID NO: 19305 - DNA, 81 bp, Homo sapiens
ctttttcgcaacgggtttgccgccagaacmcaggtgtcgtgaaaactacccctaaaagccaaaaaaaaaaaaaaaaaagct

SEQ ID NO: 19306 - DNA, 81 bp, Homo sapiens
ctttttcgcaacgggttysccgccaramcacaggtgtcgtgaaaactacccctaaaagccaaaaaaaaaaaaaaaaamgct

SEQ ID NO: 19307 - DNA, 81 bp, Homo sapiens
ctttttcgcaacgggtttgccgccagaacacaggtgtcgtgaaaactacccctmmaagccaaaaaaaaaaaaaaaaaagct

SEQ ID NO: 19308 - DNA, 205 bp, Homo sapiens
ttaagcatgttaacaaaaatagcaaaatatgaaaataagctgggcatggtggcacacgcctgtaatcccaactactcgggaggctgaggcatgagaatcacttgaacccaggaagcagaggttgcagtgagccgagatcatgccgccgcactccagcctgggcaacagggcgagactctgtctcaaaaaaaaaaaaaaaaaagct

SEQ ID NO: 19309 - DNA, 102 bp, Homo sapiens
cttttcggagggtgsygagctagtctgcggmcgctgtataccctcctccacttcccgctgcagccaataaaggccgttcctaccataaaaaaaaaaaaaaaa

SEQ ID NO: 19310 - DNA, 80 bp, Homo sapiens; identical to SEQ ID NO: 7780

SEQ ID NO: 19311 - DNA, 108 bp, Homo sapiens; identical to SEQ ID NO: 7744

SEQ ID NO: 19312 - DNA, 108 bp, Homo sapiens; identical to SEQ ID NO: 7744

SEQ ID NO: 19313 - DNA, 109 bp, Homo sapiens
cattggtagcttgatggggatggcattgaatctgtaaattaccttgggcagtatggccattttcacgatattgattcttcctacccgccgcaaaaaaaaaaaaaaaaaa

SEQ ID NO: 19314 - DNA, 385 bp, Homo sapiens
acacaattcattaattcrgcaggactttgttgaccatacattatgagggaatatttaatactatttggagactgatatattttcctcttatctagagtaaaataaattataagaagtgatgaaaacaaccatttaattagacttaagtaagtttgaaaagcaactctgtgaatttaagtgtttttaataatttcataggtgtctcattctataaactcaatggctattgagttaatcttcaagttattttcctacgggcccttttaagagaaggttggaaagaatgaaccatgtttaccagagatgtttcccaagatggacaacagactgaccatgttgattcagaactaagtactaataaaaaggagtttaataaggaaaaaaa

SEQ ID NO: 19315 - DNA, 101 bp, Homo sapiens; identical to SEQ ID NO: 7753

SEQ ID NO: 19316 - DNA, 108 bp, Homo sapiens; identical to SEQ ID NO: 7744

SEQ ID NO: 19317 - DNA, 169 bp, Homo sapiens; identical to SEQ ID NO: 7766

SEQ ID NO: 19318 - DNA, 63 bp, Homo sapiens; identical to SEQ ID NO: 7774

SEQ ID NO: 19319 - DNA, 133 bp, Homo sapiens
tattacaaagctataagatagcatagtactggcataaggataggcatataaatcagtagaatagaaatgagattctaaaaaagtgatactgcgtagaaacgccattacatttatggttaattgatttttcaga

SEQ ID NO: 19320 - DNA, 80 bp, Homo sapiens
ctttttcgcaacgggtttgccgccagaacacaggtgtcgkgaaaactacccctaaaagccaaaaaaaaaaaaaaaaagct

SEQ ID NO: 19321 - DNA, 108 bp, Homo sapiens
gaggttgagacaagagaatcacttgaacctgagaggcagaggttgcagygcagcctgggtgacagagggagactccggccccctcccaaaaaaaaaaaaaaaaaagct

SEQ ID NO: 19322 - DNA, 119 bp, Homo sapiens
aagatggattttggagatgttgcctgggctggtcttgaactcctgggctcaagtgatccacccamctvakyytcccaaagcgctgraattataggcatgakccactgcgcccggcctaa

SEQ ID NO: 19323 - DNA, 101 bp, Homo sapiens
acagttaactttaggaccatagccaaaagatagaaacagcataaacgccaaaataaaaagaagccaataaagataaacacawaaaaraaaaaaaaaaagct

SEQ ID NO: 19324 - DNA, 80 bp, Homo sapiens; identical to SEQ ID NO: 7780

SEQ ID NO: 19325 - DNA, 390 bp, Homo sapiens
taaatttgaaataataataggtactggatttatgcaaatgtctttgtctgcgtcttttgagatgagtatcaggtttttttttttccttttatcatctgatgatgaacttaatgtttccatttgtattaatggaatactaagtccctctgtgatttctgaaccaagctattcctaggcctgagttttattttgttgacacagaaataaattagaaggccaggcgtggtggcatgtgcctgtagtcctagttgctgaggtaagaggattgcttgmsssccaggagttcaaggctgcagcaagctttgattgcgccactgcactccagccttggcgacagactaagacgctgtctcaaaaaaaaacaaaaacgccaaaaaaaaaaaaaaaaag

SEQ ID NO: 19326 - DNA, 168 bp, Homo sapiens
ctggacaaatgacttgaatagacagttctccaaagaagatatgcaaatggctcaacattattaatcattagggaacattgttaataattagtggtatytcamcakkgaratttaayttytwmccawttrgrwkggtwttattaaaaaccaaaaaggggaawaaaagcy

SEQ ID NO: 19327 - DNA, 387 bp, Homo sapiens
tgattatgtgtcttggggttgctcttcttgaggggtatcttagtggtgttccctgtactttctgaatttgaacttgggcctgtcttgctaggttggggaagttcttctggatgatatcctaaagtgtgtyttccaatttggtccattctccctgtcactttcaggtatgccagtcattcatgggtttggtcttttcacatagtcgcatatttcttgtaggctttgttcactccttttcattgttytttctctaatcttgtctttatgccttatttcagcaaggtgatcttcagtctctgatatcctttcttctgcttcatcgatttgtctattgatacttgtgtatgcttcaagaagttctcatgctgagtttttcarctccatcag

SEQ ID NO: 19328 - DNA, 169 bp, Homo sapiens; identical to SEQ ID NO: 7766

SEQ ID NO: 19329 - DNA, 169 bp, Homo sapiens; identical to SEQ ID NO: 7766

SEQ ID NO: 19330 - DNA, 108 bp, Homo sapiens; identical to SEQ ID NO: 7744

SEQ ID NO: 19331 - DNA, 101 bp, Homo sapiens; identical to SEQ ID NO: 7753

SEQ ID NO: 19332 - DNA, 404 bp, Homo sapiens
aacctaatcaagcctgggcaatggcgggcgcccctcccgcagcctcgctgccgccttgcaggttgatctcagactgctgtgctagcaatcagtgagactccgtgggcgtaggactctycaagccagtgagatgaactcggtacctcagatggaaatgcagaaatcaccgtcttytycatcgstyacgctgggagctgtagaccggagctgttcctattcggscatctttgstcctycctgsaactaactycattcttaattgggtctcactctgtcacctaagctggartgcartggcgtgatggcgtgatctcggstcattgsaacctytggcttccargctyaagcagtccttccamcttarcctyccargtarctgggactacacgtgcgtgccacacgtg

SEQ ID NO: 19333 - DNA, 80 bp, Homo sapiens; identical to SEQ ID NO: 7777

SEQ ID NO: 19334 - DNA, 499 bp, Homo sapiens
gtttttaagcatgtcagaaggattttttcctgacatggtcaattttcaggactttgtctcctgttttgcttagggaattaatagagaaatgagaagttttctaaatcagaacatgtaggagagatttaaagtaacaccctgattgtgtaattaattcttagttgtaaattcattttgatggtgttaattctctgcctgaggctcgaagctagtttattgcacctatggtgctatactcattggatacccaacgccaacaaggccttaagaaaggaaagatttgccctgatttttaaaattttttttcttttttaaaaaagaacaattgtgttacaacacagacacattatttgttcttagttctgcttacaaaagttagcaaaaatactcaatccttttaacattttataaatgaataatgaaaaatggtgggcttgtactcatcttcatatgatatatatttttaggttaccaagttagtttacttttctcacagtga

SEQ ID NO: 19335 - DNA, 63 bp, Homo sapiens; identical to SEQ ID NO: 7774
